United States Patent 6,812,339 (POLYMORPHISMS IN KNOWN GENES ASSOCIATED WITH HUMAN DISEASE, METHODS OF DETECTION AND USES THEREOF) - sequence listing, part 21

SEQ ID NO: 12589 - DNA, 102304 bp, Human
  misc_feature (1)...(102304): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggggtatgcccttcagttgaggcatatgtgctgtccagagtggcttggcagagaggaacctagaggaaaaattcccagatcccctcccttctgccccacgatttcctacttatatctcccattagccaattaaatacttaactgaatacttaaatttaaaaaaattccagcctgggcacatacatagccagactccctccctacaagaaaaaattttaaactagctggacatggtagcacgagcctatagtacaacctactcgggaggctgaggtaggaggatcgcttgagcctaggagattgaagttgcagtgagttactgtaccactgctctccagcctgggtgacagagcaagaaggccctgtttgtttaaaaaacaattatttgttgttcatctgaaattcaagcttaactgggcatcctgtgttatttgctaaatcgggcacaactctgagcaaagaacaccctactccctgcacacacacactcaggagcccaggagggcatgatgtcctgagcatggcaggaggccagcccttgagcaaggatggagcccccactgtgtacccccagtcaccaacccataatgtagactgctaggcctatatctctctcacccacctgtctcactcactccctcccaacgtatttgaatagataacaaccagtgtagaatctgtgtccaaaaatgccactcagaaagctaaaagtacagctattatgagccttcccttgctcagaaaccatctaaaatacttgtggaccagatgaaataaaaacatttccaggtttattccagcaagcaagcattttcctggaagcttcagtattctatagctggtaacttaagaacactttttttgttgttaaggcacaaaaattgtaaactcatctctttgtggccatgagcagctttttttttttttttttttttttttttgagacagggtctcactctgtcacccaggctggagtgcagtggcacaatcttggctcaccacagccttgatctcctgggctcaagcgatcctccttcctcagccccccaaatagctgggactacagatgcatgccaacacatctggctaatttttggggtggtttttttttttcgaacctcaatcagctttttaaagactatcagccaaatttgcagcatagtctctgacagagcagacagtaagaaaagttatttattttgagacagggtctctctctgtcacccaggctggagtgctgtggtgctaccttggctcactgtaacctccgcctcccaggttcaagctgttctcctgcttcaacctcctgagtagctgggattacgggaatgtgccaccatgcccagctaatttttgtatttttagtagagacaggtttttgccatgttggccaggcttgtctcaaactcctgacctcaggtgatcctcctgtctcgacctcccaaagtgccaagattacaggtgtgagccaccgcgcctggccaagaaaagtgaccttgagccctgctgtgtcatcaccttcttcttatactgctgagttgggcatgaaggacttggaatgagtcagtaataagaaaatttttatttttggtgggggtggttacatttcttcaggactcttccagaggcgagtttacaaacgaatgaactggtgaataagaatatgtccagatgtgtgtgttaatgaattctgcttatcttttcctggggcacagaggacaccccagtgctctctcttcttggcctaagaagttgggaacctacttgggaaactcttcttatttaaaaggctaaaatttggatgttctgttttacagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttggggcacatcatgcaattacacagttttatccagatgatgaagttacagcaataatcgcttccttcaggtatgtgttctttcttccttttttatttttttagttttaatatttatttatttatttatttatttatttatttatttacttattgagacagagtatcattctgtagcccaggctggagtgcagtggcacgatctcagctcattgcaacctccacctcctgagttcaaacgattctcctgcctcagcctccggcgtagctgggattacaggcgcccaccaccacacccagctaattttttttttgtattttttgtagagatgaggtttcaccatgatgcccaggctggtctcaaactcctgaccttgggtgatccggccacctaggcctcccaaagtgctgggattacaggcatgagccaccttgccaggcctcttcctttctttttaaatgtcattatgctaatgctgcctcaaaagcaaaagccttttgttttctatttaagcaaaccactggtccctttagagagttgaaggataactgacagtgtgtgttcaatctgagcttggcagtgttggaactgttggttaacagatactcaggggctgggcctgggaggctacttcccacctgacctacatatcatatcaagtacagctggacccaagagctctaccagtgagtgggaacagtgtttcttaccgggtaggaggagacgttaaaatcaccctggccatgtggggctttttaaacagtgcaattgcttgagctagagagttctgggctatagtgtgctatgccaattgggtatctgcatcaatatggggattccccccactaccaccaaaagcaggggaccaccaggttgcctaaggaggagtgaactggcccaggtcagaaacggagcaggtcaaaactcctgcactgttcagtagtgggatttcacctgtgactagccactgcattccagcctgggcaacatagtgagaccctgtctcaaaaaaaaaaaacccccaaaaaaaagccagtgcagctctctcgtcccttcagttaccctgccgcccctgccttccacctctccccaccgcctcccagtgctgatgtagcccccgtgcaccgtggggcaggaagagatggaaagtctgtctctggaaatgagacaggccctaagcctcagaccatcatctcagtactccactttgttttttaagagcaagctagatgaggtggagggttgtgtgtgacagggataagctaagccaggacttatatctggaatactctgttttcccagggacccagctgtcatgtctcagaatgctgcagacgggcaggtagatgcttctcttcttgccaccccttttgtattctccactctttcctcttagccaggaggtgttttgcttttctgtttttgtttttttgcatcaggacttcgttgcgtgcacagttttagaattgggttggcctgtggttgttaaaagcacaaaatgaggtcagagccacacagggtggaagcaagagcctttttcctgcaatttctccactttggagtggagccttctttgatctgttacattttcactttctgtgacatgatacttggcaccatcccatactgtgtcatgccttttagtgaatcattttgtttccttttcagaaaaccacctcacaattaccacagacctaactactcaggttagtgtgccaacacttccacaagatgtgcccttttttttacattttttcccccaggttgtaggcttgcttagtggataatcccttagcctccaggcagaaaatgcaacttccacattactctggctgagtctctcggcagccgttctcagccagtggctaagactgcttaggagatttgactatattttttctgcatcaactataaaaagcagatgtcttacaattacatagacatagcttctgaagagataagtaaaactatcatttaataataagtgaatgaccgaggcaggcggatcacgaggtcaagagatcgagaccatcctggccaacgtagtgaaaccccatctctactaaaaatacgaaaattagctgggcgtggtggcgcacgcctatagtcccagatactcgggagactgaggcaggagaattgcttgaacctgggagatggaggttgcagtaagccaagattgcaccactgcactccagcctggcaacagagcgagactccatctcaaaagaaaaaaaaaaaaaaagaagtgaatgaggagtagtttaaagatttcaagaacagcaagctggcacattggtctcattgggtgtcacctaggaggggagcatagccctaccttgctgtctctctggacttggccagtgtatgactgtgggtgagctgcctcatcttccctggtctattttccaaaggaagagatggacttggaccatgtgactgccagctctacttctgctctcagatgccatgagctgttcagaggacttaaattgtagagttttaaaattttgattagtcagtttcttgttttggacccatctctttagagtacagaagatgacctgggtattattttgagaactttagaaatttggagtagaatttattctactgtgtgttttcagcttattatatataaactcattctaaaggagaaaaatcttatttgacctccaaactaagcctgaaagcaaatttagcgatcagaatttttgcaaatgatgagcatttcttttttgagacggagtcttgctctgtcgcccaggctggagtgcagtggcgcgacctcggctcactgcaaactctgcctcccaggttcatgccattctcctgcctcagcctcccgagtagctgggactacaggcacccgccaccatgcccagctaagtttttgtatttttagtagagacgggatttcaccgtgttagccaggatggtctcaatctcctgacctcgtgatccacccgcctcagcctcccaaagtgctgggattataggcgtgagccaccgtgcctggccatgatgagcatttagttgaattaggtagcatacaggatgataccaaatttgcctgtatatgattcttcaactttattaagataatgttcaggggcacagtagttgtacagtgattcagtgaaataaattatagttgtaagagttaaagaaagaggaaagaaacatgaaatgcagcttaacagttaaagatgggtttattttagagaaataagcctgagaggggctcctggccaattttggtgaggagcattatcttttatagactaagagtatatattagtttcagggtagggggcttatcacaagcttggaatgtttgtatgttggggagaagtttatagcagggttggaatgtctctggtcagatgggaggttatcttggggctgacatctctctggccgaaggggacgttatctcagggctggcatgtctcaggtcagggaggggtttggagtgtttttggttggagatgttatttgttttttatggtcatgctgaccttagccattaggctgatgccctttagatttaggcggtttttaatcaaggtgaactttagaatgacagtgcttgtccaagatggcgatactcctgctctgtcaatagttacttaatcaagatgacaaatatttatataatttcttggcaagagaggatgatgttggagttgctaaatgtgcattgttttttaggtgaggacactgagccccatgagcagggtcactaggcagtgagctagtcttacttaaacagggagcctgatttgcatacctgcagtgacctctcttctcacatctcctgggccctaaggaaatctactgtggctcccaggaacagtgaagagttaaaaaatagttttaggctttcaatataagtaattttgttagaaattcattagcctgcaattttgctggagttgccattagcgacatctatgtggactatgtttattcaagagaatgtgcaattaaaatcactaggggcagagaacatagatgtatattggcagaggtcaaaaggactctagagagaaacacctggtattttcagtttggtcatgggaccttttttttctaaaaggtattaggatcacacatagaaattcccgtaagaataggcagaatttatgtgaatttttaacatgatgaggtctctagattgaggaccccatactttgtatctgcactcattctttaaatatggcacaatcgtgagttactagagactgaccctgtgttttatctttcttttcattatactttaagttctgggatacatgtgcagaatgtgcaggtttgttacataggtatacacgtgccatggtgctttgctacacccatcaacccatcatctacattaggtatttctcctaatgctatccctcccccagcccccccaccccaacaggccccgatgtgtgaaagttcccttccctgtgtccacgtgttctcattggtcaattcccactgatgagtgagagaatatgcaatatttggttttctgttcctgtgttagtttgctgagaatgatggtttccagcgtcatccatgtccctgcaaaggacatgaactcatccttttttatggctgcatagtattccatggcatatatgtgtcacattttcttaattcagtccatcattgatggacatttggattgattccaagtctttgctattgagaatgatgctgtaataaacatacgtgtgcatatgtctttatagtagaatgatttctaatcctttgggtatatacccagtaatgggattgctgggtcaaatggtatttctggttctagatccttgaggaattgccacactatcttccacaaaggttaaactaatgtacactcccaccaacagtgtaaaagtgttcctatttctccacatcctctccagcatctgttgcttcctgactttttaatgattgccatttaaactggtgtgagatggtatctcattgtggttttgatttacatttctccaatgaccaataatgatgagctttttttcatgtttgttggccgcataaatgtcttcttttgagaagtgtctgttcatatcctttgcccactttttgatggggtcgtttgtttttttcttgtaaatttaagttctttgtagattctggatattagccctttgtcagatggatagattgcagaaattttctcgcattctgtaggttgcctgctcactctgatgatagtttcttttgctatgcagaaactctttagtttaattagatcccatttgtcaattttggcttttgttgccattgcgtttggtgttttcatcataaagtctttgcccatgcctatgtcctgaatggtactgtctaggttttcttctagagtttatatgatttcaggtcttacatttaaggggaagagaagggaaagcatctggtctttggtcctaaaacagcacctgtcctagttgaagatgtggtttagagtatctaatggcccagagctttggttactcctcacaccttccattgctcttacaccctctttcccgtagtggcccctgctgttatatagctctctcccttccaaaggaagaaaggactgtgataaagtcatttactctaaggaaagctgtaacattcactggtgatgtcattttagacaccaagaaatagagatattgtaaaaatcaatacacatatgcaagtacacactagttatcaaaatggccatccttgcacatgaaggtgttttccggcaattcattatttgttggctgcatagttaactgagggatggctgaacattgaggcaagttgggcagacctggtccctgtcctcctgctcatggttgtgaacagaatggaggggaagggccaaatcaaacgtcaggtgcggcagcgctaaggtactgttgccttcagattttagatttgtccctgacgtattaatttagaggaggaggaactggcaccaggactgggggaggtacacttctgcctctcaggagcaaccgcatcttgcaatcaaatctcagttaattgaaacttggggaagaaagatggaaataataggagctcatggacatttaagtacgaatcccatgtactctggaaagactaagggagatttggcatcatgcacaagagtgtccctgaaagatttttaaactacttggtcttggctcgtgtgtgtgtgtgtgtgtgtgtgtgtgtgtgtgtgtgtgtttaaattattttaatagtaatgtatgtattttgtcaaaaacttggaaaataccaaacgtacaaagaaagaaacaatggcttataattgcaactctgagaaaaattttccaattatatataaataaattaaatgttcttgaaattaatcttttattgcatagatgattatatatcctgtttcattcagtttatattatgaatatttctgtatattattaaaagtcttcaaaaaaatttttttgttttttgagacagagtcttgctctgtcacccaggctggagtgcagtggcgtaatctcagctcattggaacctccacctcccgggtttaagcaattctcctgacttagtctcctgagtagctgggagtacaggcgcccgccaccatgcccagctaattttttgtatttttagtagagacagagtttcatggtgttagccaggatggtcttgatctcctgacctcatgatctgcccgcctcggcctcccaaagtgctggtattataggcatgagccactgcgcccggcaagtcttcaaaatattttaaggtattttattgcatagatgattacatattctgtttcattcagtttatattatgaacatttctgtatattactaaaagtcttcaaaatattttaaggctgctatatgccactgtaatctgctgttgtgaaataaaagcaaatatagaaggatgcaaatgaaattataaaattaaaaattttttatttttgtaaatgaaaaattctttttaaaatgctgagtttggggtatatacaagggaagaaataactgatgttctgctcctagcctaggtgccctcttgagctatgcttgttttatgctaataatctccctctttttttcctgtttcacttggatgtctgttattgttgatggagccaggagtcatctttgattaataggtgtagaaaacattcagtgtctgctacaggttgaggtccctcgagagcattcacctggcctcctttatgagacttgagtcagtgggctgggcctcctccttggtgctgtagccactaacctgcctcacctgtatccaatatcagctcgaaactagcatatccgtttgtccaggttccaggacactgcttggccaagacctttcactggagtctccaaagaagggtgtaatttgggatatatattataattagctctgatgtctagtatagcaagtaaacagccctctagcttgggtggaaatgtgccctggtcaggcgcaacactccagaagggcagcagccaccagaccagacgacagggaagcccagctcccaagcaaaaccaaaaactggtgggagtcttgtggtgaggggaaagtatttgttgttttctgtttagtctagggattcacactgctttttaaattctggcatagttcccagtggctaaagctggaatgattctactgtttcattaaattttctttataaaaatgttaagttggggccaggcatggtggcttatgcctgtaatccccgcactttgggaggccaaagagggaggattgcttgagccagggagttcgagaccagcccgagcaacacaataggaccccattgctacaaaaaattaaaaaaaaaaaaattaggcagacatggtggtgcacacttgtggtcccagctactcaggaggctgaggtgggaggatcgcttgagcctcggagtttgaagctgcagtgagccatgatccactccagcctgggcaacggaacaacactgcctcgaaaacaaaacaaaacaaaacaaaagtgggtagtttgcgtctcctgacatcctgtttcctttggggcccccatctccatgcatctccatgcaggctcctggtactgtggatgctgtgttttcggggcccccatgggctctctgtgctgggcttttccctcccatcttgccttactggggctgatgcctgttgccggttctttattctgctgctcttggtggcaatgagaacagaatctagaaaataaaaatctaatttctttaaccaaactatctgctggaaaagctgttattaaccacagatgcctgatactttctgacttgcgacctgttcacaagacttcctttcagctcgaacttccttgcccttggcttaccctgtcggcaccatgtgaacggtggcaggtaaaaacagggcgcttacagtggacctatttcttaaaattatttttttcatttttaatttttttgacatggtaaaacatatatataacataaagtcccccatttcaacccattttgagtatacaattcagtggcattcacgtttttgtgcaaccatcagcacacgttgcacatccatctccagaactccagtagagtaaccactactctattttttatttttattttattttatttatttatttttcttgagacagggtttcactctgttgctcaggctggagcgcagtggtgcgatcacggcttattgcagcctcgacctcccaggctcaagcgatcctcccacctcagcctccccagtagctgggaccacaggcatgagccactgtacctagctgttttttgtttgtttgttgtttgttttttttgtatttgtagagacagggttttgccatgctgtccaggctggtcttgaactcctgggctcacgtgatccttctgcctcagcctcccacagtctactttctttctctgtgagtttgactactacaactacctcatataggtggcatcatacaatatttgtcctttttttgtatttcttttaaaaagactctagagcataactgctacttccaagtcatttctgagcaggctagactggtagtggtaaggactgagggttagagacatgctgtgtgtgtataagatgtgcctgggctaacccagcctgtgctgccctggggtgatgggtttctgcagctgctggccatgcagctgtacccaggtggttcctgtctagacaccatggctgagtatgtgccatttcttttgtcttccctcattcagatgtttgtatttggccaaaatctgatgagatttttataccattttttttaagcagtggtagaacattctgactattcaaaaagtcttttttccactccagcccccagccctctccctgtagggaatggagattacccatctcttgggtatctttccagagatattcaatccctatgtaatcctatgtatgtctgtatgtgtgtgctagtctccagcatggtgtgttaatctaatagaatgctactcatagctgtggttaaatcaatacccagggtatttttttgtagctatggaaattctgttttcagctgaatcatgtaatatgctataattatattttacttcttgtcttagtctgttttctgttgcttataaaagaatacttgaaactgagtaaattataaagaaaggaaatttatttctcacagttaaggaggctgggacattcaaggtcaaggacccccatctgataatggtcttcttgctgatgcgactctgcggggtcctaaggcaacgcagggcatcacacggcgagggggctgagcgtgctcatgtgctagcttaggtctctcttcctcttcttataaagctgccagttccactcccattaattctttatcccattgttaatccatgaatggattaatccattcatgagggcagagtcctcatgacccaatcacctcttaaaggcctcacatctccatactgccacattggggattaagttttaatacaagttttgaagggaatattcaagccatagcacttaaggacttagcacttaattaattaattaattaatttgagacagggtctcactctatcttccaggctgcagtgcagtgtgcgatcatagcccactgcagcctcaaattcttgggcttaaacaatcctcccatcttagcctcccaagtagctggggctacaggcatgtgccaccatgcccagctaatttttaatttttttttgtttttttttttttttttttggtaagagatgggttctcgttatgttgcccaggctgatctcaaactcctggcctcaaatgactctctcaccttagcctcccaaagtactgggagtgcaggcatgagccactgcacccagccccatagcgattcttgagtagctttttgattatcttgaatttaatagtttcctaagtatcaatcactcattcttctctaaaggaatgtatgcatctcctcacaccacaacaaaattatcagtactgatattcatttatttatttaggagatgcctgtcctggcttcttcccttctgcctctgtctaatcaggttccctctgggtctggggtccagctatctttactactattctgaggatcctctatgcctcctgtggtccagctcctgtttcctagagcccaggtcctctttcttggcttctactcttttgttttctactttcctaaactttattaaagaaaaaagtaatggtggtaaacctctagaacttactcaattttctgggattcctcccccgagaatgtgatatattgatttccaaacatgccggaagtatacatggttcccaattgtactaaatagactaaataggtgaaaagctgaagtcctaaagtgttcatcttccaacttttcccagcctgtggtctgtccttgcatcagcaataattgcctgaacagctgctatggcttcattaatttttgtctgtagctgtctgagctcttctgtatacagcagtcacagaatttgagtagcttcattaagaactgcatctcctgtgtcaaaaccaagaatatgtttgtctaaagcaacaggcaagccctcttttgtttgatttgctttagcaactgcatcctgtgtcaggtgctcctgaaccaaaatttgaattgccttaagcattaccaggcaatcatcatgacattgaacctgaagcaggttagccaaagccattacaccaggcttaaaatcaggattatttacgtccaaatttatcaatggttctgcatttttagttgcattgtcagcagtttttgcattatcaggtactaagtccttgtatttttcagcattatctccatattcaaatctaacagctaaaccaagaagccagtcaatagcttcttgtcgatcttgaatctttaaacgacagttaacatctctgagatacttttgaaagaactcgggccagtcactgctgtggatgtttcttaaattacctctgtcttcagtcttgtagtatctgattttctggtcttcaagccaaacagtgaagtttctaaattctgtttcatctttgcagttgaaaccggcggggttgtggtagtcaagagccgtcagctttcattggaacatgctccccgcttctcactctctttggcttttactcttttactttggcaaggagcttatccgtcactaacttcctgggacttgcatgcctgaaaatgccattctttttcctaccttcaccttgaggtagtttggctgggtacagagttcgaaaggaaaatattttttgttttaactttgaagtcactgatatatttcctttgagttctgggttgctctagagaagcaggatgtaattctgattcattcataagtgatctgcttctgttctctctggaagcttttgggatcttcacctcatcttagagttgtaacgttccctgatgaagcccccatgtggtgggtcttttttctcctactgtgctgcccagccgggggcccggttaggaaacacccatatcttcagtgctggggcactttcttgaacttccccccttccgcatccactctccgcgtttcctctggagctcctcttacatggtggttgggatgcctagattgctgttctgagcccggagcctttctggttgagcctccacagagactgagcctcctgtttttctgggcagagggaggagagccagggacagcccctccagtctccagccccaccccacaccccaccctcccagtgggagcctttcccttggatgtctagaaagcgacaagtataatgatttatggaaaatctttgctgtaatataggtggcatgggtcaggccttgctaattaatgcaggtgcctatttttaccagacaactgctaagcccttcctgccttgaatgactaaagacaaacttccgattgagttctctttgcattctgcatgctccttttctatttctggtgtgtatcctccttgctggttggcttaaggttctcctgggcatcttacgcagtctgatttctacagtccagggtgagctgccagacggtcctttgtgcctcatagtttctcggcttctgggggctctgcacctccgctttgtacctctggtctgggtgcagtcccctcaggctgccttcctggggctgtgccccacctccctcccggccttcactttctctctggtccctgtctccctgagtccagctgcaagcctgctgccactcccgggtcccagaccttgaggcagagccggtcttcaaaggcacaagtgtcctcagtctgtccgatctcatggttcactctgttgagcccctgggtcttgcctcaagaaaatgatgcctcttctaaagtggatttgtgaaatatgtagaagcaccccctcttcagtagccttggtttccctttgaactccaaagattagatccatctgttgtgcaggatcttcaggaactgctgaaagccagggtcaccgctcaaccactagtcattgcccacgatgggcaggacatcattctaggcacagaattctcccatctttcttcagcccttcctgtcaccatgatatccagggggctaccaggagagggtcagccagctccttatttggagatatttgtcctgtgtattctcttttcatcttctcctggtaacctctaagcattgtgacatccagccactgccccaaagcatgaaaggatctggcctttccttgatccctgggacctcccccatgcccaccattcattcatcaggtgcattccaaaattatattgctcctacaaaagaacgaggggaaaggggaagacagagcatttcaagtcaaagggatgccactcagatttacacatcaggaaatgcaatgacaggggactgttaactcctggatcctgggaacagtaaggaagtaatgttaacctgagtagctctgaccccccgagttctgactgatgccattgttgagctgtgtcttagctgctctatttatcacaggccaatgaggatctgcaaaatggtattgttgggaagaagtaaatttaaaatgtttagtgttcagaaaactgaattcaacctaaggaaactctgtctcattcagacctggggacctcactcactaccacatgtctgctccagatgctaaccaggctgtgctatcctctggcagctgccacccctgcctatcaggccatggttcaggatggagccccctctacccttgacagcttcctggtttcttttaagccttaagcctcagcccttcacaggttgagggatgagatttattttgtttagaaataaataggttatacagggaagcaagcttctaggaaggaaggtggaacttccatgtttttcttctttttcttcgttcccctggtcatggtcttctttgctgtgtttaaagaggagtgtctttgagccaataaagaaatcctctggagagcatctgaaagtatttaaaaatgttccccggctgagaacggtggctcatggctgtaatcctagcactttgggaggctgaggtgggaagatggcttgagcccaggagttcaaggctgcagtgagccatgatggtgcaactgcactccagcttgggtgacagagcgagaccccatctaaaataaaataaaataaaatgtgcatttcaacatgtaaacaccgggcatgtccaccccaggagagatcattaagtacccagggacttgcaccttaggtgcaccttcaagcacttgacctgtgactgctgcaaatacagtcatgctgtcagtgagagaccttacaaaatgatggctagggccccagaaagttctaaacaggacaaaggctaccagctctccatttttatagtcattgcagtcctggtaaattaggtgaatattgaaaccatacaagtatgttaaatggaattagggtctagtctcaggaggtcatttgggatatggaacagttgcccttggcccctaaaaacccatggagcccccctagtcattgtgaccaccaaaaacaactccacaaatttccaaaatgccttgagggggcagtaccccaatgcagagaaccactggtgcagagtctaccatagaaatcaagacaggtggccgggcatggtggctcatgcccataatcctagcactttgggaggccaaggtgggtggatcccctaaggtcagaagttcgagaccagcctggccaacatggcaaatccctgtctctactaaaaaatgcaaaaattaatcgggcatggtggcgcatgcctgtaatcccagctactcaggaggctgaggcaggacaatcacttgaacccaggaggcagatgttgcagtgagctgagatcatgccattgtactccagcctgggctacagagtgagacagaatctgtctcaaaaaaaaaaaaaaaaaaaaaaatcaagacaagtgatagcacatatattagtcagggtttttccaagaaaccgaacctataggatctgtgtctacagctttatctagaaagagagagaaagaggaattattttaaggaattttccttagttccttaaattaactcctaaattatttattaattcctaaattatgaattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattattccttaaaataattcctctgttttaaggaattagctcacacacagtgggggctgacaaatatggaatcaacagggtgttgggtggagacccatgaaagacttgatgttgcagtcttgagtcctcaggcagtttggaaacagaagcccctctttccctggggacctctgtctttttcttataaggccttcaactgtttggatggggcctgcccccatcatgaagagtaatgtgctttactcaaaggctgctgctttaaatgctagtgacatgtgaaaagtaccttcacagcaacatctaggctagggtttgaccaaacaactgcgtacaatggcctagccaagctgacatataaaattaactatcacagcatatgacaaagaagttgaagaagtttccatcctataataggaactcaaagggtagtcactgtaaatatcttcatgtgtttttctttgcagcataaccagtgtgcagcgttcagacaatgggtcgtatatctgtaagatgaaaataaacaatgaagagatcgtgtctgatcccatctacatcgaagtacaaggtaagtccacagaccagagtcccattgccagagaactgtttgttttagggcctgtgttaaatgttttgtgtataatactctagagttttgcctgcctatttataactctgtatgcaaaccttgcaaatctatcagcactgaaattttacaaggtactccactttgtagtctataagtaataatgaaatgaattcaattcctgaagtttgagctctattataggcattacaggtgagataaaaagagattttggacttccttgtccacagattattgacaataaaaataagctgaagacttctttttaagaagcaaaatgctttctactatccagtttccagtactggtaccagataccactcacctggtcaagtggctgttggcttattattcagcatcttttcctgtcttgcctatgcagacagtgaaaccctggagggtgagtggttttcctcgactggctcaacagctcagcctgagacttcttttgggcactggtatctgtcaggtgcatggttcagagaaattccatgacatcatatgaaggtccatggggatgaagagtgagacatcaggctaggaaaaggcaatctctgccctcagggaacttgaactctaatgggcaatgtgagctgatgcacaggtgaaccaggccaggtgagcccaggtcctggtttggtgccctgatttgggggtttgcatgcctggttctgcaatggcagtgctgcaaggaggaagcatctttattatcaccctcagaggtcactcctcactacccctgggggcttccctctgggggccttgtgcccctcctctctgaggtgcccctcttagcagagccattaggtcacctcccttttctactttatcctgaccttccttgtcacaggctttagagcaggtgattagcttttcagtcagaaacatctcccactgaaagtctgctatgctacccattcttttgtgaacctgaaattgatgcccaccaatgtggagggaagcctcagggagcacagatggaaggaggaggagtgagtggggaagacagaggggagggggaagagactccctcagaggagtctcttcatgacctttgctctaggcccatcccaggctggacagctctttctcagggttacgtcaacatcagccaaagagggggtttcctacatttgcagctaatttgggaaaaaaatatttacaggagattttatttgtcagaatcccagaaaaatgcccagagcaggaacatattaagtccaaacagagtttcaaaaaaaccttgaaacaggataaaagaattccatttcacataactgccacgtcattcctgctggaaccagatctgtgagttcccaatccccaaaagaacacaattagctggactcgttatatttttgaacacctgccccaaatgagtactgactggctttctctgagcttccttgggaccttgattttggaaagtacggtagatttaaggattgtaactgcaactgtgtttatacagttttcatgagaatttgctttgaaaagcactcagccttatacaaggctgtggattttaaaattccttatgacccatctgaaagtcacacacataatagaatgtcttcgtaccatggacagatctattacatagctttgttttactctgcgtttattttggtaagaaatactgaaaacctgccaactagtcagtcccaggagtttgagcaacacctgatgtaagaactgcctgtggcctgccttctggtaaaaccagttctgagtcactatttatagcccctttggcaaagcatcctagaaagctggcttaaagtagactggcaggaattagcctctgtgctccttcttatccaacttaaggaggtgaaaactgattaatacagacctgcctgaggctgtagataaagaactcttgtttgccaaggctgggcgcggtggcacgcctgtaatcccagcactttgggaggccaaggggcaaggatcacttgaggtcaggagttcgaggccagcctggccaacatggtgaaaccccatttctactaaaaatacaaaaattagccagacctggtggtgtgcgcctgtaatcccagctacttaggaggctgaggcaggagaatcacttgaacccaggaggtagagattgcagtgagccgacatcaggccactgcactccagcctgggtgacagagcaagactccatccccacccgccccccacaaaaaaagaaatctattgccaagttctagtccagtttccattcccctttgggctctgtctctgttttcagatctgaaacattcttttgtgtaacgttttctccgcaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggtaagtccgagccgtgggcttattgatttattctctaatatcggacaggatcaaaagtttggcgacccttgctgtgcaccactagcaggcagtggagacagatgaaaatacaggtgtggcagcaaagttatgggaccaggtagacaggaaggcaggtgggaatcacaggtgtgagaattcacaggccaaggtggggaaacaggtgagggcctctgggggtacatagggttaagttgttgaagtggccagaatccctgagcccaggcagcaggagccctgctcgcatctcccattgtagctgtggccttgctggtctgtcaggtcttgcgtttatggaaccactgatgtgaagacctcagtggatttgacaccgagagagtggattcatcatggggagctattgcaggaagtgtgagcccttgggggattgtggctgaatggacattccatggtcgtcttgatttccatccaaatgaaagtggcccagttttagtcccgcacatcactgatgatgctcttgtcaataccactgacgtttcccatgcactgaagtcagtgggctcttctgtggctcctctcattgcatctttcagcaacatcaggcaaggttaccacactccctccctccttcctttctccagggactgctgtatgcctgaggctgttctaggccttcaggacacagcgtggacttttggaaacactgtcctggcttccatttcattgagtgacaccaattcattgctcctcctttgtcattgactggagttttgaatggcagggctcaatcctgggtccccttcttttactctgagatgcttccccttgggagagtttctttgggcccatggtttaacaccatctataagaaatgaccttgaactccagcccagacccctctcctgagttgcaggctcatgtatccaaccgcctccttggcattgccacttgctgggtacataggcatctcagaatgaaactcttaaccccagacttgttccactccagaattctccatcttagtgaatgatatcaccattttcccatccttcctttttctcatttttcatgttggcatcagcagttctgtcagttctgctcctacaatacatctgaaatctgtcttttctccaccctgctgccagcaccctggtccgtgtcactgccagctcttgctgtcgcctctgcagtagcttcctaactgggcctttttgctcccagccttgtccccactcccaactaccctcctgggtggcagatgacatcacctgcctgctgaaaaccctgcagtatctcccttctgtcttagactgtcacccagtccttcctgccctttccctaggggctgcgtgtcctagctccttcctatctatccaacccagccccatcccatgctctccatcctgcttgttaggcacgagtcacattgattgtctttcacttctctaggcacatcctgttccttcctgcctcaggacctttgcactgtctcttctatctgcttgcagtgttcttccatcggccctttgtcccatgacccaactcatcacttcttcagagaggccatccctgatcactcttaactgttttaggtcccctcaatcccatattcctgtgtactcctccattgcacttgtcaccgtctataattacccagtttattcattgggtctccttgtctagcttcttagagaacatatgctcagtaaggacaagagctttgtctctcccattcacctctgcactgccagtggctgaaaaggtacctgcctcctagtagtactcagtaaatatttatggctaggatggatcagtaagtgaatgccagcccctacctattaactctgaatcacttttctaacccgtgacttcaggaggaatgttatggttttctctccttcatctgagttttctttgagtttttttagggaattaagtaactttttattcaaaatcaattttaaaaaatagactctaccctttataggatgatcactctgaaatcccataaagacttattttcattgaggtaaaattgacatacaattaagtgcatagaattcagttgtacaactcagtgagttttcctaagtgtagacacccatgtagctaccacctcggtcaagatatagaatattgccatcacttcagaaagtccttcatgatcccttccagtgggtcaccatctcccataggcaattctgttcttatatctgtcatcatagaataattttgcctgttcttgaacttcaaaaaatggaatataaagtatgtacttttttgtgtcatacatactttccgtggcttcttccactcaacatgatatctttgagattcatccatgatgttttatcactagtacatcatctttatttttatttttattttcagaaggagtcttgctctgttgcccaggctggagtgcagtggctcaatcttggcttactgcaagctccacctcctgggttcaagcgattctcctgcctcagcctcctgagtagccgaattacaggcacctgccactacgcctggctactttttgtatttaagtagagacagggtttcagcatgttggtcaggctggtctcgaattcctgaccttaaatgatccgaccgcctccacctcctaaattgctgggattacaggcataagccaccgtgcctggccagtacatcattttttattgctgatatagtactctgttgtattaatgtgttaatttggtttatccatttgtttggtaaacattttggatatttgtggcagttggctattatgaataaagcagctatgaatatttgagtgcaagtcttttggaggacatatgtttttattttgtcttggataaatgcctaggagaggaattgctgcttcatatgtttaacttttaaagaaactaccaaatggttttccaaagtgattgtgccatctttcattccagcaacagtggatgagagagttccagttgctcatcgatatgtttaccaacatttgatttggtcagtcttcttaagtgtagacatttagtggatttgaaatctagtagattattgtggttttagtttgcatttcatttccctgatgtctaattttagacaagacttagagaagattttagtgtctcttcttgtgcttattaatcagtcatgtctcttttttggtgaagcgtcacttcaggtcttttgcccaattctataaaaatcctagaatccacttgacaatgtttacacaaaaatacctgctgtgattttgtctgcaatcgtattgtttttatagataagtttagaagaaaaagacatcttgacaatattgagccttccaatcaatgaatacattatatctcttcatttatttaggtcttctttaatttctctcagcaatttttgtagtttttgttgtagaggtcttacaagtcatttgttaaatttttttttattttaaaattggaattgtatgtacttaaggtatacaatgtaatgttttgaaatacatagtgaactgattattccagccaagctcattaatatagctatcttttcacatagttaccatttgtggcggagttcggggggcggggagggagggaggcgacaggggagggcatgtaggaggatgagaacacttaagatctaccctcttagcaaatttccagtatactgtgcaattttgttaactgtgctgtacattagatctctagaacttattcatcctgtggactaaaactttctaccttttgaccaagtcctcacccacctccacccacccttttaaaccacggttctattctttgtttctgtgagtttaacttttttagattgcacatgtaagtgagaccatgcagtagtttttcttttctttgtctggtttattcacttagcataatgtcttccagtttcatccatgttgtcataaatgccaggattttcttttttgtacacgctgaataatattcccatatatatatatatatatatatatatcccataattttttaatccatttatctgtttatggacacttacattgtttccgtgtctaagctattatgaataatgctgcaatgaatatgggaccacagatacctctttgagatcctcataccatttcctttggatatatatacccagtatgggaattgatgaatcatatggtagttctatttttaattttctgaggaacctccaaactattttccttaatggctatgccaatttacattttcatcaacagtgtacagccaatcagaatgcattaatttagtacttatgtactaataaatagcatatttgattttatttcccaattatttactattagtaaatagaaaatagatttttgtatgttttataaaaatagggacaaaatctgtccatctctgtttgtctagaacttttctgtatgttttctcaaaattagaagtgtgtttttgtgacaagatgtgcaaactattttaatacccaaggctgtagtttgtcttagcttggagatctgatttatttctaaaaggtcagttacacccttacaacgaccacctattttgcatttcaagttctttacaatttaattttactttttaaaatttgaagcttttttttttctttggtagagaagacttgggctcacgtttttttccagggtgttacgtgaaaattctcaaggtggactactaggtttagctggaatcaatctgacagtgttcatatcatcagtaccctttaaaagagtcattggaattacatgatgatctgaaaagtttaggagacagacccagacagcagggcagcctaatccaatcatccttaaaaatctgaacagtcagaatagaactgtagcatacagcctgttggtcacaggaacaagaactatttgttcatttgcatctcaccaaattcttacatgcactgatccaacaaatgagccaaaacttaggctccaaaaatgttcattttcgtcttctaaaactctataaagtctatccagggtagatacctgtctgagtttgtccagctgaccagtgcacggggtggtggaaccgagtgttgttgctttcccactgtacacactcatggaatccacagtaccacatgctgtcagggcaatggctccacactaatcttccctgttattgttccagttttagtgtatgtgctaccaaagcgagcaccaccagtatttctttaggagggatatctaaatgggagttgaagggaaaagtgaacatattttaaattttaatacattctaatctccctccaaaaaggccttgcaagttggcaatctttttagtggaatatggtaatatgtgccctatatcacatacacacagtattcagtcttgactttttgccagtctgatggcaaatactctcatctgtcagaatatctgatttacgcctctgcctgtttccatgagaccaggggggctcttgaaggcaggaactgaaggattttttggccacatattcaggggtctggttcagtgcctggaacatggtagttgtagaaatgaccagtaggagagcacttgcggcagcattcaccagaaggtgcttctgaatgtgggtgtgcatgatgaattcactctccatcaggggccatcgggtaccaaaaaccaaaaactgaaccatgatgatggaaatcctcactaacatttcaccagctgttctagagtttttagagtagcgacaaatgtgtctgtaaatgaagaactcttacttaaactgctgagtcgaaattctagtttctaaatcaatacgcagtataccgcactgctcaggcagttttcctatttgtgaagggtttggaaagtggggctgctgactttatttttcttagtgacagtatttattaaatgcctgtttcatagtgaagatggtctagctcatgctatacagtgaagtgaaggcctggaggagtaatcatatattcaagccagaaacctgaaacttacccagattcttctctctcgcccatccaacagtcatcaccaagatctgtacattgttctctcttttttttttgttttgagatgcagttttgctctgtcgcccaggctggagtgcaatggcgtgatctctgcttatcgcaacctctgcctccagggttcaagtgattctcccgcctcagcctcccaagcagctgggattacaggcacccactatcatgcccggctcatttttgtatttttgtagagatggggtttcaccatgttggccaggctagtcttgaactcctgatctcaggtgatccacccaccttggcctcccaaagtgctgggactacaggcgtgagccactgtgcccaggccctgtacattgttctcaaatgtcaattgtgctcatttcttcctctgcccttccaccaccatggccttaattcaggctttcctggttcatcgccaggactgttgctgtcacctcttacctgtggtccaatctttctcgttctcatccccctaccccaccaccatagtgagtgatgctccaccttgtgattaaagaggttctcctaaaatacagagcttctcattcctggcatgactccccactacatgcaggttaaaatctaccattttaccctgaagtctgagacccattggggcttcagcctaactttcccacggtctccgcctgcctcacctgcaaaggcacctgcttgtgagacctgatgaacttttcgcaggcccatgagcgactgtgccttcttgccaagctgccttctcattgtctggcaaacccctgttcacttgacacacagatcacggctctcctctgaaaaccttcctggtcacccccttgtctgtatattcacaaggcctcttccccattgcattgaagaacaaaccctctatctatttgtcaggcctccaagaagacttactaatcaagtgattattatgtatgatttattagttaggttagccccatcacccagcacagtgcctggcacataagaactatgtgaatgaatgaatgaactaatgagcaaacaaatgaattacaaatagtccccgagttttaggtcctttcactgggacaaagggacatcatgataatgaagtaacttgtatttataaaattatttttacatttaaactcttatctcttttctcatttatatctccagctggtcctgtaaaattaatagaacaggatctttaatgtccattctgtagacccaaagggctaaaacaagtccagggaggaagggcgtggggcccaggctgctgactgtggggattgtgctgggctcacaggggttactctcaaaagtcagctagttgctgactgttcccttgtgtctgcgttttgtaacattataaaagaactacgtaaaaacttatttttaattaatttttttttaattttgaggaagctttagtttgatacctgagtcccttccagtaattcatgtatgaggaactaggtgctgaggtcagctttggggggccttgtgcagagtagctgcccctgacatgctgatgtaaataaagcagtgagtgttcccaggggacgccattctatctgaaattgacccctaagtaaactttgccgaccccttctactgagggaatgctaagtggtttaaatagccgattgtttggactgctttgagcaagcattgtttatggaacaggaaggtcatatgccttttccctcttgatacaagtttttatttttcctctgtgttgtatgagctttctttaagggacatgaaaagaagtactttgtctaaaggacattattctgagtgaacaaagccaatctcaaaggttacgtgctgtacaattccatttagataacattctcaaaaggacaaaattttgctaatggagaacatatcagaacaatttcaggggttaggtttgggggtaggatgttctataagggggtagaagagggagcttctttttggcaatggaacagttctgtagccacaaatctgtacctgtcataaaattgcataaacctatacactcattcttccccccaaaataaaacaaagcagaaactggtaaaatcttaataaggcctgtgttttagttaataatattgtaccaaagtcactttcctggttttgatcattataccatggttatgtaagatcttatcattgggtaaagctgggtgaaggatgtacagtaactctgctatttttgcaacttcttgtaagtctaaagttatttcaaaataaaaagtttcttttttaaagaattttatcatgggcaaaaccaaatcccaaaataaagagcagaactgcaaagagctttagcttcatggtgttcaatggtggagtgctttataagttagtgggtaagcatgttctcactcataggtgggaattgaacaatgagaacacttggacacagaaaggggaacatcacacaccggggcctgtcatagggtgaggggaggggggagggatagcattaggagatatacctaatgtaaatgacgagttgatggatgcagcaaaccaacatggcacatgtatacatatgtaacaaacctgcacattgtgcacatgtaccctagaacttaaagtattaaaaaaaaaaagttagtgggtaagagctctagctttggcatgtagactgatgccactttgctgtcatgtatccctgggcaagttactcaacttctgtatataaaatagggataatagcagtgtctactacataaaacatttatgaggtttcagtgaaataatgaatgtaaagcccttggtaccaggattgcctataggaatgattgaaatgctacctattatattttttgtgttgttatttttatatgcaatagttactaactcattgtcaattttgacctgcctttctgttaacagtggtgggcttgcgttgatctttcaggcttttcttttttaaaaaatacacattttatatttaaatccacatctaggaaacagctaagctagcttttgttttagttagctggatataattattaatatccttgtaataacagaaacaacagtaataactagaatttatacaaattagttcataatgcccacagtactttctgtaaagaattactttgaatcacatagcaagctgtgataattaggcagttttgttgttgttgtgtttagagacaaggtcttctctgtcacccaggctgatgtgcagtggcgtgatctctactcaatgtaacctcaaaactcctgcactcaagcaaatccccctacctcagcgccccaagtagctaggactacagggataagaagcttttttcaaattttttgtaggacgggatctcactatgttgtccaggctagttaggcatttttaatacccattttacatattagaaaaacatttggagctattaagagacctgccttctttttttcttttttcttttttttttttttatgtcacccaggctggagtgcagtggcgtgatctcagctcactgcaagctccacctcccgggttcacgccattgtcctgcctcagcctcccaaatagctgggactacaggggccagccacctagcccggctaattttttgtatttttaatagaggtggggtttcaccgtgttagccaggatggtctcgatctcctgacctcgtgatccgcccgccttggccagtgctgggattacaggtgtgagccactgcgcccggcgagacctgccttcttaaggtctattctccatgtggccgctggagcaatcctgatacaagtcagatcatatcagccctctgctcagagctctgggttttctacccaactcagagaaaaaggcaaaaggcctctcccacatgttgcctctgcctagaacctccccaggcccccgagtatcaacttggcccatttcctcactcctactctttcctcagaggccatttctcaaggaaccacctctgatacccccccgcccatcatttaaaattacagcttgcttccccacccatcctgaccctctgatcgtcttctgtttttccatagtacttatcaccttctaatatatcatacatcttacttatcaaggttattatttattgcccatttctccccctgaaaatgtgagctctataagggtggggatcttggttttattcatggatatatcccaagtttctggaaaaaatgtctggcttgtagtacatactcagtaaatatttgtcaagtcgatgaaagcagagcagatagagaggtccaagttaagaagctacctcacttatgcagcatgatcttccatttgttgcttcctttggtagaaagatggacactagggaaaaaagaaaaagaagggacagaattgtttatctagttaatttgcgggattgcttaatccagaactcaaagaactggctcaactgtgctcttaggagttgctccctcagcaattcggattgtccttctctcaagggaacatcctgttactgaatgttccttaaaaatatctgtcagagctgtgtcataaatatcttttctcaaaccagcagaggaccaagcaagaggggcgtgaaccatcataatggagttgggtgaaaaggagaaattgctctaagagggacgacctacccactagaagaggagttggctcaggagattgtgggggttccagtgcccggggccattcaggatagagtgggtgggagggtggagacttagggagttggatgctttttctccctggaaagtcacaagggtttggggctgtaaatgtcaaggtctattccagtctggtagttactgttcatccacacagagagaactggcgagtgagagggagctgtcttctcctagtgtacactcattgctatggtcaatccaggcttataaacgagtgtctagttgggaagccagtgccattaagccattaaagtttagctgaaaaattaagcaaagaagactatatttggccctaagtgctgtctggttttggagaaatttacctttggtttgaactagtttcctcttctctctactggtatctctttggcctatgggcaccaaccacctgaccttgtacactgttttaatacattgtgtggttactgccaggcaattcagacttggtgtaggtgtcttgtgctaggacatttgctatagattgtttttttgaccttgggtgcactatgaaaagaaacacacaggagaaatgactgtccatttgacctgaagtcatgttctgtgataatgtttccctttcagcattaataaacctgttaggactaaagatcactgggcctgaaatctgctactataggatcctactataggttctataactggataatggatctcagtgaaataaacctccggttttaccacagggctggctcttccccttatgacaagtttggaatgtaattttgtagtttgtattcaagggtttcctaagagttttgataataattgaagtcaaatgactaattttaaactgccaatgtctcctccaatatataaaaaagataagttagtaactccctgtatcttctgattgagccaaggccaatttttctaaatataagccaggttttgcaagttcatgcagcctggtggttgaaatgggcatatcacttgggagcttaggatctggaaggttaaaagtgatgccaaggcatgaaaatcaaagtgttaaaggcctcactgtgaaacagtgatcagcagagcatggaccccttagtgggatcagtgtctccatcctcatcctatatgtatcttctttcttaaaatcaatgcttgacaacgtgcccaaagtccagttacttcgccagttctccctttccacctccctattttcctttcatctcttccttgcattacaaaagaaaaaagacctctcttgcttgtctggaatcaccactatgaagcatcagttctcaatgctttggtctcaagatccttcgtttgtttgtttgtttgtttctttttggttttttgtttgtttgtttttgtgtgtgtgtgacagagcctgactctgtcgcccagcctggagtgctcactgtagcctcaacctcctaggctcaggtgattcagccatctcaacctgccaagtagctgggaatacaggtgcatgtcaccatgctcagctaatttttgtgttttttgtagagatggggtttcaccatgttgccccagggtggggcaacttctggacttgaactctcgaacttctggactcaagcaatcctcctgcctcagcctcctgtagtgctgggattacaggagtgagcccactgtgcttggcctcaagatccttttacagtcataagttatcaagaaccagagttcttgtttatgtgggtcatatctatctatatttactgaattagaaattaaaactgaaaacttttaaaacacaaaaatacacaagcatacacttcattggctaatacatctatgctatggcatcatcatatatcatatagcctctgggaaattcttttggaaaattccatcatatattcctgagataatgagaattaaaagagcaaacaatatattattattatgaaaatagttttgactctgaggactacagaaggggtctctggaatccccagaagtctcttgaccatattttgagaatggttgctgtggtgcattgtcttggggttaagaaatttccagagacagaaaattccaaattttggctggacgtggtggctcacgcctgtaatcccagcactttgggaggctgaggcaggtggatcacctgaggtcaggagttcaagaccagcctggccaacatggtaaaaccctgtctccattaaaaatacaaaaattaaccgggcgtggtggtgcatgcctgtaatcccagctacttgggagactgaggcaggagaatcgcttgaacctgggaggcggaggttgcagtgagccaagatcatgccattgccctccagcctgagtgacagagcgagtctcagtctcaaaaaaaaaaaaaaaaaaaaagaaaagaaaattccaaattttgtccagcaaagaaattgctcttccaataaagttgtacttatgtttaagaatcacttacattgttttgattaattgcatcctaataatgagtataatcaattcagaagaaaatatttttgcaatttcaaggtatatatatgtttttgttgccaataagttcccatggtttaagcaaaaactttcaaatgtgtaccattaagatgaaattcttggggctggtagaagagtcatggtggaaaacttgctgctggggaagagtcgttacagtgggtgttggtgtcaagatattcaaggtacctcaaattacattttttgaagatgtttaaattacgaaaaatttaaggatgcaaacttcaaaatgtgtcagagtccacgtatatttttcaaaattctctaggagtaatacaagcagaagatataaagaccccgaggcagagtatcacagggatccttttatagatgtgtgtgtaatgggtgtgagagaaatattcctcctcagtgcaataaatattttctaattcactacacaaactagtagcagtttcatgcctcacttgagaagaagtgaccaaaatatgaaagtagatggcttctaccaggagtttttgtttcttagcactttaaattttctttctttttttttttttttttttttttgagatggagtcttgctctgtcgcccaggctggagtgcagtggtgtgatctcggctcactgcaagctccgcctcccaggttcagccattctcctgcctcagcttcccgagtagctgggactacaggcgcccgccacaacgcccggctaatttttttgtatttttagtagagacagcgtttcacagtgttatccaggatggcctcaatctcctgacctccgcccgcctcagcctcccaaagtgctgggattacaggcatgagccaccgcacccggccggcgttttaaattttcaagagaatttaattaagcaatccagcttagggtttcctcccatctgagggaagtattcctcgtctttgaaaattaagatactgtgaagtagcagtcaaatcctctccataataccatgttatttttgaagaaatgaaaggttaccaccgaatcataggacagagatgtatgggtttgcttttccctgagggacccgtgtgtagtcagggaaacgcagacactggtgacaaccttccatctagatggaaaataacaaaaacccaccagcactgattttcttttttatgcacatttaacccctcaggagaagcactaatataaaaaggatcagacatgcattttttctacagcgtctctcagtcacagctctctgccatgtagtgaccacttggctgcagccggggcgcagtcgtggccatgcagacatccgaccaggaacagcttttctaggctgatgcctgctgtgcttccctcagcaagtttttttccctttcattcttcaaatattttattactgttattagtgataagctttgagtttaaaaatatctgatggaaaatttcctacacatgtagacagaagacacaaaataagcttttctgccaagaagcaaatggtggcatattttcaacaattttatgaagatactactgtatgtcagatgatgtttctgtgtgccacagatatagaagtttccagattcaactacatagtaaatacttgtatagttgtaattctaaaaaataaccattcaggtcgggtgtggtggctcacacctgtaatcctagcgttttaggaggccaaggcaggtggatcacctgaggtcgggagttcaagaccagcctggacaacatggtgataccccgtctctactaaaaatacagaattagccgggcatggtggcaggtgcctgtaatcccaactacttggaaggccgaggcaggagaatcacttgaacctgggaggtggaggttgtagtgagccgggattgcaccattgcctgggtgatgacagagtgagtctcgacctcaagaaaaaaaaatttcaaattttaggattgttttagacttatagaaaaacactggggataatacagtgatttcccataaaccccacccccactttcccctatcgttagcattttacattggtgtggtgcatttgctacaattgatgaaccaatacggatacatcatcattaactaaggtccatactttagtgatatttccttagctttttacctcctgtcctttttctgtcccaggatctcatccaggacaccacattgcatttagtcatctatgtcttattaggctcctcttggctgtgacaatttctcaaactttccttgttttgaatgaccttgacagtgaaggggtgggttgctcctccacacctgtgggtgtttctttttaggtggaacgagagacttggaaaagaaaaagacacagagataaagtatagagaaagaaataaggtggcccaggggaccagtgttcagcatatggaggatcctgccggcctctgagttcccttagtatttattgatcattcttgggtgtttctcggagagggggatgtggcagggtcataggataatagtggagagaaggtcagcagataaacacgtgaacaaaggtctctgcaacatagacaaggtaaagaattaagtgctgtgctttagatatgcatacacataaacatctcaatgtcttaaagagcagtattgctgccgcatgtcctacctccagccctaaggcggttttcccctatctcagtagatggaacatacaatggggttttatacggagacattccattgcccagggatgggcaggagagcaatgccttcctcttgtctcaactgccaagaggcgttccttcctcttatactaatcctcctcagcacagatcctttacgggtgtcgggctgggggacggtcaggtctttcccttcccacgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtgtaacaaagcacatcttgcacagcccttaatccatttaaccctgagttgacacagcacatgtttcagggagcacggggttgggggtaaggttacagattaacagcatctcaaggccgaagaatttctcttagtacagaacaaaatggagtctcctatgtctacttctttctacacagacacagtaacaatctgatctctctttcttttccccacagacaggttttaggtatcactggtcaggtgttttgtagaatgtcccacaatttaaaactgactggtatttttttcatcattagcctggggtttttttgttctcgggaggaaggccatagaggtgaagtgacattttcatcacctgtttccaagggtacattctgtcaacatgatatagcacttgatcatctggctcaggtagtttgtcagtttctccactcaaaaattttctttcttttttttttttgctctttccataatgtacttgttggaaggagtcactgtatgcagcccattaaggagtggggagttatgctccacctctttgagggcagaatatccaataaactatttggaattattctgcaagaaggtttgtctattctctccaatttatctaattatttgttgatatcagtagagactcctggatatttttttcttctttgggttataatccaaagctactttattttcctgctcaaattgttccagctttggccattgggaactctttgagttagctgctgtgtctctttgacatgccccatcattgtctcgtgtgtgtgtgtgtgtgtgtgtgtgtgtgtgtgtgcgcgcgcgcacgcgcatgtgtgtgtgtgtacgttgtgtgttgtgtttgttttatattttactccagacttatatatttcctgctccaatctgagaatcagccatttctccaaggagccctggttccatttattggagaatggcattagaaaacaagatctggctaacttgtcttcctatttaaaattaataaatcaattttttaaagatgtcttcaaacctctgaaatgatagaatttttcatttagcactagtgtcttctcttcgattagttataacgccttgcatttatatgatgcatccttgtgaattgaccagtttttactattaaaaaaggattcattacaacacatcatctgagatttttaaactgtggcttttattttgctatttctggtattctgaaatatgcatagcatagtggccctgtatgtactggggggttaggcagcaggatcaggtgagcctcagaacccactttccttgatattggggctagcgatttgcagtaaaaatctaaatgatcctgctttattacctaatgtctcaccattcaggatctgaataaatgaaagcagctgccttttgggcccatggctaccttgctcttggtgccttgggtttaatcccaggtttgtttctccatagctagcacaccttttaaattaactttgcactaatgcccaaaagccatgaaccaagaaataaaataatacaaagacaaccatagaattgtagtgaacagcagcctgtttctctgctgctggtctcatgagtctccttccattccaggcctgacggagatggcggtcttcagttgtgaggcccacaatgacaaagggctgaccgtgtccaagggagtgcagatcaacatcaaaggtaagcagcaaggctaggctccccatgcatgttctgggagctggtgagggtacagcatgagcttgcagctggctgcctgggtgtggatcctggctttctcactgtctcaaggttctttgtgaccttggacaactcacttctcctctttggtgtcagggttcccctctgaaaagtggagataattacagaacctacctattgttgaggcttattgatttaatacaagtaaattactcagaagtgcctggcatataggtctttgataaacattcactcgtttagctctgcttactccaagaagaaaacaagctaaaatgttttctctttcttagttcctattttcacttttccctcttccaccgtgaactactcattaacccttgaagagccctggggatggggctttcttggggcatgatctaggaaatggaccctgtccttcccaggtcagcggggcctgctgactgactccctgccacctactgactcagggagacagaggaaaagcaagaagcagatcactctttggagcccaatgctcctatccctcttcctcctaaactccctcttcctcttgtttcctctgagctaggatttcactaggctgagcttgcttggccgtgagttatgataatagaattaaaggcacacatttgaaggcctccaagctagtggagacatttcaatccaatctaccttattctccttctgtgtgatcaaaggtgttaaacttgaaatttgaaagaaaagaaaaacctacaattaggtagtatctttttatttcattttaaatcatcctccttagtgtgtcatagaaattcaagcaaattttatgttttactatttaatcatagtttaaatattgagaagtaattatttggctcatgttcttttcctcttgtccttagggaaacagtgcaaggaaaaaggagaacttgtttaataatgaattaaaggttgggtacatacagaaggagactcaaaattacaaaagaagttatactcaaaaaagatgctaattttagtttcagcaaatcaactggacaaacgctatgaaagggaatattctaaaagttcactgggataaaaaaataaccaaactaaaagttattactggaggaagtgtataacttccttccttcatcacaattcccattattacaatttccaaaagacatgttgggaatgtcaaaaattcatgagtgtgtgtgagtttgtaaagacattttcatgaagtataaacctcttaaaatttaaaaatgtataaaatgaaaagcacttctccaattttatgcttcagaatctcagctaaggttttattctattagatcattccccaaacttctgtttttggctttcatttattataaaatttatgtcaaagctaccaagcctcccttcttctaatgtgtaattactatggtatatgtggtcaaattttggtctggaaaggcagatgctttagggcagttccacaaataatctgtggaggaaagtgagtcaaaccttattcttccccattcccaaggctttgtgtgtactaatcaaacccaaactcctaaatgtggcccccagggcacgcttgatatggtcttgacacaccttcctccttctctcctgctcattccatcatcaccttcatcctcaccacaccctccctgggcctcatccacagttccccacatttattcctcaccacagctccatggagcagtgctggtactatccccatttatagaggagacaactgtgtgtagttgtagatagggcgtgtgtagctgtgcctggggccatacagcaggtcaggtggtaaaccagactcacagtccctgctggtgttcccactgtctgcttgctgcccttggcaataggcctccagtgtcctgttgagggacacaagctccagggtcaggcagaccagagttcaagtccctgttgtactgcttacaacctctctgtgacttttgccaagcttttaacttctctgatcctgtttccttatctatgaatgtggattgtaagactacttctctaattggattctaggaatgattaaagaaagccctcaaagtgtctggcacatagcaagcacaggaagtgttagccttcatttttaattatgagtgtaattattattatgaattaaattcagcacaaagaaataagattccccaaatttaagatccttcttggattctaattgaaatagctacccttcacccatctgtttccaaggtcatagcccacccattcgaggacacacaccccttcccctcccccagcagatgcagctggctcttttgcttgaactgactcttagtgtttcctcggcctggaaagctccccctacacatgcacacatacacatgcacactcatgcgtgcacacactctcctgtggcacccctctcttctggtgacagggcgctcttattcttggttaacgtgggtctcctataccaggccatgtgctccacgagggcagggctatgactctgtctctgtttagtaagctagtgcccagccaggtgcacacagtagggtccatgaacatgtactcagtaaaggacatgagtatttccacatcttttccagttcaaaggtctcctcatttcattagtgaataggaaagtgggtctgcgttcacttctttggcccttcactggaagacttctttggcccatccataggctaacacaattaccctcaggcatagggaggctcctcttgaaaacatgtttccctttactaatctcaaggaacgaaaacaggtattaatgcatttgtttggtagctgtagcctgtcatctataattgtgtttgtgtgtgtatgtgtgtgtgtgtgttttgttttatgcagcaattccctccccaccaactgaagtcagcatccgtaacagcactgcacacagcattctgatctcctgggttcctggttttgatggatactccccgttcaggaattgcagcattcaggtaaagttccagggtgaagagggaagtagctgtttggtgctctctgtgggtttaaggatttttcttccttccaaggatgggcatggagggcatttctccatctctgtacagagtcccctgacctccctgcttcagtgtccagcatgcatgcactattccatgtccatgctctgcccatgatactgtgtccttcctgtgcaggattcagggctcagtcagaagcaaaacgtgtttccaagggagaacatcatgagaccagggagagttcttcttctttttttttttgagacaaagttttactcttgttgcccaggctggatgcccaggctggagtacaatggtgtgatcccggctcaccgcaaactccacctggttcaagcaattctcctgcctcagccccctgagtagctgagattacaggcgtgcatcaccatgcccggctaagtttgcatttttagtagagatggggtttctccatgttggtcaggctggtctcaaactcccaacctcaagtgatccgcccgcctcggcctcccaaagtactgggattacaggcgtgagccaccacgcccagccaagaccagggagagttcatttttaaggtcccgaaacacatgcttgtgaccaagagttgaggaacccaggcactccccagtgtggctccttctgggctggtggccatgaaggacagaagggccaggacaagataggtcgtctgtgctactgagcgtagcaccttacccagtgtcaccgggggatcctggtcattgcaggccttgtggaatcttcagccatttttcactgctgccttgaatgggtatgaaacggtgctattagccatcctaaaatgataacttgcccatgatgtaagctgtgctcttgagttttcacttcataaaaatgaaaatggtggcagtaacaactgtttactaagggaccacaggggctttgcaaacattatcttacttaacacacgctgcactgcaggctcagagtactcacacagcctgtgagtggtagaaccagaactcaagtccaggaagctccagtgcctaaagcagcggtcagaaccatcagctcttccgtctcaggagggacatcgcatctgggagcaggttaccgaacatgcaggaattatccactaaaagtattaatgcatcctgcctggtacttaatcatacagtagggtcaggaattagtttactaaatatctggtctcattagttaaaaatatgttaacctgacacaggccagtcatgccaacacagctcaaagaattttgtgttgacaactagatgtttttactcgctagtcaaattaatttctctgttcttaacgcctcccacttttatctaacaggtgttccttccctgaagagtaaaagcctgtattatccgtaaaatagcctccgccctcacccaccacctccagcctttcttttttttttttttttttttgagacagagtctcgctctgttgcccaggctggagtgcagtggcgcgatctcagctcactgcaagctccacctcccgggttcacgccattctcctgcctcagcctcctgagtagctgggactacaggcccccgccaccgcgcccagctaattttttgtatttttagtagagacggggtttcaccgtgttagccaggatggtctccatctcctgacctcatgatccgcctgtcccggcctcccaaagtgctgggattacaggcgtgagccaccgcgccctgcccagcctttcttaattcttgctcagttttgttttttgttttttttcctgtaagcctcccaagcactggtaagtgttaggaattcttactgcatctacaattcctcaccaggaatggtcttttttgtgattgattttttttaacacctttttttgagatatagtttactttttttttttttaatttgagacgtagtctcgctctgttacctaggctggagtgcagtggtgtgatctcggctcactgcaacctctgcctcctgggtgcaagcaattctcctgcctcacccacccgagtagctgggactacaggcgggtgccaccacgcccacctaatttttgtatatttactagacatggggtttcaccatgttgaccaggctgttctcaaactcctgacctcaagtgatccaccagcctcagcctcccaaagtgctgggattactggtgtgagccaccacgcccagctgagatatattttatataccattatattcacccattatttaaaatgtacagttcaacggtgtttagtatattcaagaattgtgcagccattaccactatctaattgtgtctatattcataagagatatttgtctgtagttttcttgtggtagctttttctggttttggcatcagtgtaatattgaccttctagaataagtatgaaagtcctcctcctcattatcctcctcctccctcctcctccttccacctccctcctcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctcctccttctcctccttctcctcctccttctcctccttcttctccttcttcttgttcttttcttggaagaatttgtgaaagattgatgttaaatcttctttaaatatttaataaaatttgttctctttgtggaaagttttttcaatattagctcaatctttttacttggtatgagtctattcagattttctattacttcttgagtcagctttggtagtttctatgttataggaacttgaacatttcgtctcagttatctaatttattggtatacaacatagtacatagtattccattataaccttttttattctttgaggttagtaataagatcccctgtttcattccaggttttagtaatttgtcttctctcttatttttcttagtcagtccagctaaaaatctgtcaatcttatttatctttttgaataaccaacctttgattttgtgaatttttttctattgtttttgtattctatattttctttatttctgccttaatttttgtttcttttttttctgtttgctttggtttagtttgctctttttctagttttgtaaggtagaggttaggttattgattgtgttcttttatatataaaaaaaaataggcatttacactctacatttccctgtaagcactgctttagctgcatcccataaggttttcgttgttgttgttgttgttcatctcaagttttctgtcattttccttgtgaattttttttgtcctcttgattatttagaagtgtgtatttaaattgtcacataattatgaatttcccaaattttcttcctttactgatttctaatgttattttactgtgtttggagaatatacttcacatgactgtgatccttttaaatttattaaggcttgttttatgacctaagtcctatcctggagaaagttttgtgtgcacctgagaagaatgtacattcagctgttgttggatgaagtgttttgtgcatgtggtttaggtcttgttggtttagagtcttcagtcttctgttgccttgctgatactctgtctcatggttccatctgttattgaaaatggggaattgagatctcagctcttatttttgaattgtctgtttctcccttccgttctatcagtttttgcttcatgttcttttggggctctgttgttagaaatatccagggcctctttccctagaggtagacatttatttatttgtttgtttgtttgtttgagacagagtttcgcgcttattgcccaggctggaatgcaatggcacagtctcaactcactgccacctctgcctcccgggttcaggcaattctcctgcctcagcctcctgagtagctgggactacaggcacctgccactgcgcctggctcatttttgtgtttttagtagagatgtagtttcaccatgtcacccaggctgaggtagacatttatatacatggacataactgaagcatgggccagccctttttaaaactgttaccaaagtgctgagttgtttgaagagcctgagaggacatgaaacatgaggatggtgagcttcagggagactctcaggaagagtaccaccccaccttgagacggcaggtctcagtgacgtgaggtgggtaggatggttgaaaagtctgaaaacaccaggtcacccctgatgatggaagatgatcacacacaagatttacctgctctctttctgccatggttttgggtgttcatggtacacatgaagaagcatcctgagacagccaaagtccagtgttttcttgcccaccttggattctgtggtgctggatatgatgattctgttcttgtcccccttggctagctcagcctccattcatcctttctcctttccatctctggtaggctttccagatttggcaaataagaatacaggacacccagttaaactgcatgaataatgtcgtgacatacctatactgaaaagttacttgttgtttctttgaaattcaagtttaactaggtgtcctttatattctcttgcagtcccactggggttaatcagcacaagctctaaaagttatcttttctattctgtcattaacagtgtattcccagtttttgaagggaccaagtatggctttgtaaaattataattttaaactctgactcgggaccaaatgaatgttttggatgagattcagatccatgcactagcaggacacaccctctcacttcctttggtcctgatcttagctcttttcttcacccatttttgggccacacactccatttctaattttagctctcccatgtacttcttgccacttcatgcctgttttccctgaggacccactgactgagaaggactgttatagaaactctgttttcctctaggaacgtgctctcagacagtgtccctgagcctggaagtgctccccacatgtctctggaagtggggcggggaggagagccaaaggtttcctccaccttcgctttggtggttggtcaccaggaagtaggtgcacactctaaagtgaaacaaacaaaaagtgatgtctgccaacagccaccaccaagacaagcgtctgggttctcgtttctcctctggtggctcctcaggccaaatgataccttcttgtcacccacggggtctgagtcagaggtgaaactcaacccccacaccgtactcctggtatctgccaggggatttggaattccagaatgtttatttctggttcattgacctaagattcaagcacacatagcctgaaattacagtactgtatatccagagcccagaactgcaagcccattattaacagtaatacattttgtggcctgaggatttttcccaaattgctctcagttgcatgttttacccgatatcattttgtctgttctgattttataagtgccacatattacagaaattttgaaaaagcatgtaatggagaacaaaatcccatactctcccttatccccatacccagacaggaggtatgcgaggaaagagatggaagtttcgcccaggactagacttgtgctgggaatcgccctctcttgcctatgtatacagagatttggagggggatgtggagagactggtggagttatggagggaaagataaggcagtatgtttaaaggagatttggagaaaagttttctgaaggaggggcaaatgaccctttgctatatctcctcatcaaaaaaaaaaaaaaaaaaaagccaagaatctacatttcctgtgtgtgcctctggaattcaatttctgttggggtcgaaggggttaagaataaaggacacactaaaattagcctcaggatgagtgcattggctcacgcctgtaatcctagcactttgggaggccaaggcaggcagaacccttaagatcaggagttcaagaccagcctggccaacatggtgaaaccccacctctactaaaaaaaaaaaaaaaaaaaaaaaaaagttagccaggcgtggtggcaggcacctgtgatcccagctactctgaaggctgaggtgggagaatcacttgaacctgggagacggaggtcaaaccattgcactccagcctgggcaacagagtcagactccatctcaaaaaaagtagtaataataataacaataaaataaaataaagttagcctcaaggcaagagcagtgttccttaggttacataataaaaagaaagattaagaaacgctgggtgtggtggctcacgcctgtaatcccagcgctttggaagtccaaggcaggtggatcacctgaggtcaggagttcgaggccagcatggccgacatagtgaaaccccatctctactaaaaatacaaaattagctgtgcgtggtggcacatgcctgtaatcccagctactcaggagactgaggcaggagaattgcttgaatccgggaggcggaggttgcagtgagttgagataacaccactgcactccagcctgggcaaagagagcgaaggtccatctcaaaaaaaaaaaaaaaaaaaaaaagaaagaaaagaaaagaaaagaaaaagaaagcaagaaacccatcctctaaaagcagaatttgggaaatatttcctttaaaaggcaaaatagtaaatatttcagggtttgccagcacatattatatctgtttcctctgttgcatactccatgaagcagctgaaagaagtcaagaatcgaagaggttctaagagaggagaggctttattttatagtataatatgaattctaatcatcataattatttgctccgttacctgccacagtgagaattgttaattgttattttaggcgttttcctcaggtgttcagttattgtccgagggcatgagtaacacacagtgatgctggcggtaaaatgtgtgtgtgcccagaaaggaagcaggtccttccccttagcgtagaggaagggccacgtgcaccgaatgcacacaggccccgtgcctgacattcccaccaccttactaatgcccggtcctcatgtttactcttcgtttaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggaggtaattcctggggttcagaatgtatattgcccccaatgacatgtgattcaacaaacccttcccagtggcctgactgagagttgaaactttgctttgtttggactttgtctctggaggagaaaattattgaggcgactgatgaaaatgggaaagatatttcctccatactgtaaaagcattcagtgacaaaacttagccgtgttatgtataggtaatcttttcttttacataggagataatagcagcacactttaaaacatgctctctcacaacacaacaatcaatacatgttaccaacacagtggtcaatacagaagccttcggccactccaatatatgtggggatttctctccaccagcaagcagtcggctctgcagcggagaccagctgagtgtcctccattcaagtctgacactacatggagatagcttcagatcccataggttgaggactcaatccccaggcctcccctccctcccaaccccgtccccagcctttagatgccaatcacaagtctgggcctctggaacttctgactaagtgtttcccatgacctcagctttgtgtccaattaatttgctagaacggttcacagacctcagggaaatacttatatttaccagtttatcataaaggatattacaaaggatacaaatgaagagatgcggaggatgagatatagaaggaaagggtgtggagcttccatgccctccctgggcgcaccaccctccaggaacctgcacatgttcagctatctggaagctctctgaaccctgttctcttgtttttttgtggaagcttcatgatgtcagcattccttcctccaggttatgggtcaggaccccctttgtaataagggtcttatgacccacagtcagaaagatggggaagattagagtcctgcattgaggcaggtgaaaggagggcgggaagaggtcagagagattgttttctgaggcctgcccctgaggcgtaaagcacccaacatcatagcaaaagattgtaaccagggctatgggagttgtaagccagaaatcatgacaaaaacctgtgtgtgtgtgtgtgtgtgtgtgtgtgtgtgtgtgtgtgtgtgtgtaggttattatatatatgtacatatacacacatatatacacataaaataacccacaagtccattaaaatgtaatcgaatcattcaaatggataggtttaattgcatcgtattttctatttgttctatctgtaatttgttctccttttcttctttttcttcatttaaaaatattatttttatatttttaatattaatatttttatgattctatgtttaatatttttatgattcttattttttattctttgtttggcttattagccatagctctttttctgttcttttagtggttgctttaggattcacagtgtacatatttaacttatcacagtgtaccttcaagtgatttataccatttcacatatattccattttctccttcagatatttttggctactgttgtcaaatattttactttaatgtatcttaaaataccattgctacactgttgttatttttgttcagtcagtaatcttttacaaagagatttatataaccaggaaaaacacatgtttatgcattatagttaccatttctagtggtcttcattttttggtctttatattttatctgacatcattctccttcttcctgaagaacttttttaaaaatcatttcttctagtgtggatctgctggtatggtattcagctcctgtagtctggggaaaaatatttattttacttttgaagtgttcttatttttatttttagccttcatttttgaaaggtatttttatgaggtatagaactgtaggttcacaattttagcttttgtttgtttgtttttactttcagtacattaaaagaagttgctcccctatcttctcgcttgcattgtttcccacatgaaatctgtgatcatcctaactttgttcctctgtatgtaatgtgtcttttgttcctatttttacccttatcactgattttgagcaattgaattgtgacaggctttggtgtaattttatttatatgccttgtgtttggagtttattgaacttctggggtctctgtatttgttgtttacatcaaatttggaaaaagtttggccattatttcttcacattttttttctgtttccacctatcctcttttttaaggactccagttacatatatattagaccatttgaagttgtcccataactcactgatgatctgttattattttccccttcttttatctctacattttattttggatagtttctgttgctatgtcttcaatttcactcatcttttttggtgtagtatctcatctgacattagtcctatccagtttatatttcatctcatacaccgtaatttttatctcttttttgcatttttatgtctctaagttttggaccatccagaatgcagttataattactttccttttttctttctttcttattttcctttttctgtcacacaggctggagtgcagcgccaatcatagctcactgcagtcttgaactcctggcttaagcaattctcccaccttcaccttcgccttctgtgtagctggtactacaggtgcatgccaccacacccagctaatttttggttttttttttatgttttgttttttggttgttttttgtttttttttttgagatggagtttcactctcgttgcccaggctggagtgcaatggtgtaatctcagctcaccgcaacatctgcctcctgagttcaagcaattctcctgcctcagcctcctgagtagctgggattacaggcatgcaccatcacgcccagctaattttgtatttttagtagagatggggtttctccatgttaggctggtcttgaactcctgacttcaggtgatctgcctgccttggcctcccaaagtgctgggataacaggcatgagccaccacacccagcatgttgtttgtttgtttgtttgtttgtttatagaaacagggtctcactattttgcccaggctgctctcaaactcctgacctcaaatgatcttcccacctcagcctcccaaaatgtttataggcatgagcctataataggggattataggcatgagccaccgtgcccagccttttcataactgtttcaatgtctttgtttgctatcctaacatctatgttatctgtgggtggtttcaactgattcatttatgtttccactctaggtagtatttttcaggttctttgcacgcctgataatgtttgattggattacagacattgagaattttacagtgttggatgctagatattcttctatttctgtaaatagtgagctttgttttgagacacagttaagctagtgggaaaccgtttaatcctgtagggtcttgcttttaagatttattaggcagaacctgataagggctcagtctcaggtcggttattacccactgctgacacaagaccattctgtgtgccctactcagtgcttcttgaatcattagattttccagtctgattgatgggaacaggcactattcttcccccgtgtgaagcctggataccattacctttaactgtttcgtgtggttctttttctattttcctttagaggcatcctaaggattctggtgccttctcctgggtatttgcctttcttagtttatgccctcgtttttatggagcccattctcaattagcttccacaaaatgtatacataaaaagtaaagattgtgggaacttgcatatccttatgtaatactggcttagtaatttttccaaatatagaaatttaggttgaaattattttccctcagaagtttaaaggcgtttttgtatcattttttagcttcatgggttgctgtggaaaattctgatacttaagttttctatgtgaactgtttttcagttttagtttttaaaatatcttttctctttaatcctggttctgtgataagctgtgatgtgcaatttgttttggtcatcaagggcattcagtggcccctttgatctggaaatgcaagtcttttggtccttaaacttttttttttcctttggaaatgttccactctctgttttttccaggaattgtgttagacgattgttaattagacctcttcgattgcttcctcaattttcttttttcaaattggcctattttctttgcctttttattctaccttcttggagatttacttgatttatcttccaattcttctattaaatattttattttacttatcatgttgctaatttcaagtttttttcattgaaaatttttttctggttctcaatcataagagtcttttctggatatctcaattattttttgtttgtttgtctttagtctccctagttccctacactagctttgtctcctctaagccctctgttctgtgtggttttttttggtccctgatattcagtggggaggcttcgccagacctctgctaatttctgctgtctgctcctatggaagagtgaagaatcattgatttgattggaactctgtgggtatgggcagagcttgtaggcttcactataggtgattggacagtgacctaagtgttttgatctagatacgataccccccaactgtcaaaattggtttctttcctctgtagccgctcacttcctctagaaaagaagtgtcctgctccaggaattaaacgtggctgctgatattctagtagccaagtgggggaggaggggaaggtagagtccttgttatttagtatataaactttcacttattttcccagttttcagcctggctccttatcatgcctccattctacaggtgccctaagtttagtggctttctgcttcagagaataaatcaccctgtgtcctatggatatttgagggcatacttgccaggtgtgtaggcatggagaagacagactttgagacgcaactatttcttttttttttttttttttttttttgagacggagtctcgctctttcgcccaggccggactgcagtggcacaatctcggctcactgcaagctctgcctcccgggttcatgccattctcctgcctcagcctcctgagtagctgggactacaggcgcccgccaccacgcccggctaattttttgtatttttagtagagacggggtttcaccgtgttggccaggatggtctcgatctcctgacctcgtgacccacccgcctcggcctcccaaaatgctgggattacaggcgtgacccactgcgcccggcagagacacaactatttgttaatcagacttccaatcattctttccagttttagtccccattttactacctgggcccacagcttctgagctgctctgtgattctttgggagaatattggcttgctgagttaattataccttcttcatctctttttcagctttcaaatatgtgttgaaatctctcttctactgttgactcctctttgccttgtgagtttatatctttttaaattctttattgccatcatagaggggttttgggaggaggcagacatacagacatgttgtgttggccatatttatccacaaattctacaacaggtttgaaagtgtgcgactgatttcataggcagctttagttgtgtgatgttttctaagctgaaattcattttaacttcatgattactgtttctggaatcagcagagaaaaagagggttatagtatcctttcacacatatctgaaatatagaatttaacctcccctcattcaactacaggcaacagtttggtgtatattattctaattgttattattctttctagatatagaaggtttattgttttaatttctaaaatggatctatatactttttacaatctgatttttcccccattggatttttttatatcaatacacatgacctaattctttccagtgacgaggtagtaagtattccattggaaaatgtatcaaaatttgtattattattattatttgagacagagtctcactctgttgcccaggctgaagtgcagtggcatgatcttgactcactgcaacctccatctcccagattatatcataattattgaccaagcattgcatttatttctatttgtcactattatgctgcaatgaatataacatcacctacagattaaattcctggaaataaaatatttggtcagagagcatattattttcaattttaatagatatagttaagttattctctcccaaaaaagactgtagtaatgatcttgacttgtttcccaaattattttatacacgtacactcgtgtacacacacacacacacacacacacacactttttaaatgtgttgacagattagctctgttcagactgtcagtaacttgcctctggactttaaaatggtggctgcattctgagctcagcagtgtttcctaccttgtgcatctcaaatgccaccaagctgatctctagctggccatgttaactttctgccccacaggtttatgctggagaacattgttcaagttgtgtctgcttcacttccccaggagtccagagcaccacccaccctaccttccctgccttcttcttctttgctattttactttaggtgctcatgaaatttcctttttttttttttcttttgagatagggtcttgccctgtcacccaggctagagtgcagtggtgcaattacggctcactgtggccttgactttccagggtcaagtgatctttcctcagccactcaagtagctgggactacacacctgtgccatcacacccagctaattttttatttttagtggtgattggagtctcactatgttgtccaggctggtctcaaactcctgacctcaagcaatcctctccctctggcctcccaaagtgctgggattataggcatgagccaccatacctggccaacattttcttcttttctttctctttctctttctttccttcttttcttccttgcttgctttttctgcccaggctgaagtgcagtggtatgatcatgtctcactgtagcctcaatctcctgggctcaaggaatcctcctgcctgtctcctgagggactggaactacagatgtgcaccaagtagtcagctaattttttagttttttgttttgttttgtagaaagggtctcactatgttctggctgatattttcaacttaagaaatgaatttctaggcttcagtaacctaaaagggctcacttatttaaaactcactgatatctcagtgaaaatcttagttgaaaaggtgaaaatgtgctataagtcttggtctcatttgagtgcttttcatagagcatttgaaaaccaaacacttgaaaacccagatgagaatacatctgtgtgtgctttgtggttcttcattcttctctccttttttcttttgtagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccgtaagtctaaaccctagaagagcacgattagtcatctcctttcaacttgctggtttacttcagttttagaagctttcatttggttttgaaaagacctggtgtgattgagttaggcaaggcacctttcaggggaacataaagaatatagtaaatattagaggtgactgaacagttacaaaattctaaggtatcttttgggactttcctcacttactcattcattcattcattcttttacttattcatgagatagacatagaattcatcctctgttatcacctgacttttgccctcatggaatttaggctcttataggatgacagtgtggaatacccaagttgtagcattaggtcagggagctacagggcttagcagtccagcaattcatggccttttggaaatttcatgggactttgcaaaagaagaagataagggaataacctcatcctcatagagaatggcaagaagtaagcagacaccaaaggaggagaccgagcaagctctctggccagcctggcacagctgcagacaagccgaaattagacatcagaattactggatcaggacatgcagtctgacactacataacacaaccaggtgcatcagccaggtggcacaggttccctgctccaccaagtcccattgggcaatgtgatgtacccacttggtggattgtgcacctgagggtactagggtcaagggctcagcaccctgtgtagtgagcagcaaacaagctgatcctctgtgcagttgcacggtcgtcatgctgtggccaccttgacctacttcactgcccacgtgactagccccagcatggctcggggttggggatggttaggccttgcagtttgtcacactcagcaaggatgaacaaagatgcttggagcctgtggcagactgcctctcccagaaaaggtggtacttgaattgggcttgtgtgttagtcaagattctttagagaaacggctaattgaacatgtatgtatagaaggagatttatgataagaaattgactcatgcaattacagaggctgagaagtctcacgatctgccatctggaagctggagacccaggagccagtggtgtaatttagtcagagtctgaaggcctgagaaacaggggcagtggtgtagatctcagtccaaggataggagagtactgatgtctcagctcaagcattcaggcagaagaaaaggggagaattcctcctttctttaccttttgttcttgtcaggccctccatggattgaatgaggcccagccacactgaagagggcagtctgcattatgagtcccctgtttcaaataataatctcactggaaacaccttcacagacacacccagaaatcatgttgagccacatagctgggcacctctgtcacccagtcaagttgacacataatattaaccatcgcagcttagagtaattttgacagatgaaatttgaggagtctcagatgggaaaagataacatgagagaaggcacaacgtggcagctttaaattctgactcacttgaaggtctggaacataacgcttttgtgagagcgaggtgtgagatgaagctggattgaggagttctgaccctaaaatgcagggccctgaaagtgaagccaaggcaggtagaaatttgttgatagcaggggagccaatgataagcatgagctcaggagcacaacttgagacttacagatcatgatgatgacctagatgattcttctttcatgaataattacattgagtttgctgatataagtaaccttctaacctgccttctttccaccagagcatatttgctgagcacattccactctggtcttccaagactgagcaggcaactcagcagcaggctcctgccagctacagaggttttcttgcttcctgaaaatgtatatcagaatcatccacaatgtttatttggaataccactgtgtgcttggaactgggtaggggtatcgtaggggagcatcaatatgtcaggtaattcctgccttataatcaatctaaagctggcaagatcctttagatttttgctaaagctggcaagttcagtgaagactctctagtgtaagtactggtttcatttcacagtggcaaacaaaaggcaaagggaatctatgtgtgaaatagtggcttcctccccaagtaccagccagtgcccttccaatgactttgctaggcatgactccagtcaaacccagagggacatttgattttgatttctatgaagtctaaagaccactgctatgatgtgaaccctggacccaatacagcagcaggaaaggcagctgggtgatgatgcctgggtgtgattaggtgggcagcttctagacaggttcccttcccacctgggaaaggaagagagtggggtattgctgcctccttttgtgacacagaacatccgtggaagggcagatgcactggtttcattatcaagtctgtctcttctttactgtgatcatggaaagcatgcttcttctgtgttgccatattcctgatcaatctaaccctagtgacagattgtattagtctgttttcacactgctaataaagacatacctgagactaggtaattataaagaaaaataggtttaatggactcacagttccacatggctggggagccctcacaatcatggcaggaggcagagaaggagcaaaggcacgtcttacatggtgacaggcaagagagtgtgcaggggaactcccctttataaaaccataggatctcacgagactcactgtcaagagaacagcacgggaaaaccccgcccccatgactcaattacctcccaccaggaccctcccatggcactacaagtcaaaatgaggtttgggtggggacacagccaaaccatataatagatccaaattttagcttcttcatggtatctatatggagcatcagatatagatgctgcatatagagatgaacagggtgaatgggtgagcagatgcatccactgatgatgctcaagctttgttgtaatcatttttagccacatatcatccagcatttatcaaaactgccattttctgaaaggacacttaaaatttattttaatttccctgcctcagtttacctatcaggaagcagactgttggaagcagtaggtgatggaagtagagaaaaagaaggcttagaagtccgtgttgttctgcctcatagtaaatgatcatggtattaattcattttaagtagcaatcctgcttaaaagtcacagctgcgagagaagcagcctttccttttgtcttttgccccaaggcatttgtgcgaggtgcctctggattaactgcatttctccattggctgagttgcaggaatcaaatgcctctttgagagaagggcttttgttcacaatgctgaatgcttggtatagctatactaagcataaaggttcagtaggaattttatctttctctatttggcagaaaatagtgattaccagcagacacttaggctgtctaaaaacaagccagtttgtttaaagagctgcaggtcatcctttctccttctacttctggcttgggtgaaagctgcttttctgaagggggcctcttgagccgaggcgttctgaagggcagcaatgatgaaaaccttatgaatgactgtggctggagagccttgtgcactaaatgccattagcactcagctaggctgtgcattctcattgccctttgttcagaacggtcccctctgcagggagaacagaactgccacagttaaggctgtgacctttccagtcacttacctccttagggatgccagatcatcccagtgagatcatttattatgctttacactatattttatgcatcatgacagtcttgtgaccacaaagacacagtggctcactttactttggaaaacattctctgatgcagctaagtttcaagcttatgatccaaaactagggacaaataagaacatggaagaaaggcggaccctgggagtcccctgaaacccacacccaaaaggaagtttaagatgatcttggcatctgtcactttgatttccttcaatttccttcatctcagaagggcaaagcttagacaaaaccttgtctcaaaattatccgttcattttcatttttagataactgatactaaagctacttccttatgcaggacagagcagttggatatttttgaaagatatttctcattataactgtaattaagggtggggtttttcatgtgcatgcagtttcagaactttcttggcagtcgtttttccttggcttatcgcagctacacagaagacaggtttgtagctttgcattcccgcaacagtcatgtcactttcagactaagaatcctttgatctttactgaatggatatttattatatctcaaacgatgatacctaccttttttgttctatttttcttgcgattccttgccttccaaatcagagtttaaaatccaaagataaggaacaaatacaatgtgttctctttgaagttggaggcaggtcttgctcgtctttgtactgtctgaacacagggccttgaccttgctttgtaggcatttgtggcactatggatttgatgtgtgggcccagctacaccatctaaaccagctggagaatttctctccatgaatgggacagtcttttattaagtgtggactagtatttcccaacccaccctcattcccgtaaagtgtcagtggatcttctgtgaaaaaagagttcagtgagcaaatagaattacaaaatattgcatattataccaccttgaaggcccaccatgtatactggcaagttcaagcctctttgaagttcaacagaaaataactctgtttaactttgacccagaattgtctaaatgttaggcagagacacatttttatacgtgcggtttttatggagttcgttgctttgggtttattgctctaatgctagtttactcttcgttttcaaaggtatagatcttggaagtctcatagcagagattattatagccttgagacagcatgatatatagaactaacttttttttttttttttttgagacagagtctcactctgtcattcaggctggaatgcagtggcacgatctcggctcactgcaacatctgcctcccagagaaccaagttctttggagactcagggaagctgcagtgtacttggcccaagacctcggcctcctaacaagctcccctaatgagcaaagctatgtgcctggatgttggcatgtgcccaccgcctcttcctgtctccttttctccctctttctcactgtcaaaggagagcagagcatttgaactggtgttgtcttaaagtatgaggaataggcaaggttctcatggccagccagggatctgaacctcttctgaaacccagggattgatcaaatagggtacattttgcctggaggagaaacttaacatggaggtaaactccatgagtaggtcaaataagcttcttggtttggggaactagacagccttgatgattttctctaatgcactaagacttgaaagataccacaagctcaattctgtaagaaggttttgtatttatttacagggaaagaagacccaactgtagcaccaccttgaacatgatataagaataatcatagccaccactgattacttgcagcatgccagatcgtgtactatgtgttttacataaaggaactcatttaacccttaactgtgaggccaggcgtggtggctcacgcctataatctcagcactttgggaggccaaggcaggtggatcacctgaggttaggagttcgacgagaccagcctagccaacatggtgaaaccctgtctttactaaaaatacaaaaattagcccagcctggtggcgggcacctgtagtcccagctacttgggcagctgaggcaggagaatcgcttgaatctaggaggcggaggttgcagtaagccaagatggcgccactgcactccagcctaggggacagagcgagactccatttcaaaaaccactgtgagaaagataatatgctcaattttcagttgaggaaactaaagctcagagatgctgggtaactgccgcagagtcataaaggttgggctaaaaacctcactccgactgactccaaaaccagggcttttcagaacccccctactcgttcccaggcgcccctggctttcttcataatacagtctcattcaaattccacagtgtggcctctccgtagaaagaaggaagaacaggacgtgttttgcagagttagatgtgagagttttgtgttgatgcctgtgaatttgaaacccctttgaacgagtcacctttgttgttgtcatgagacagaaacttttatctcattgaggttatagaacaggccagagtcttaaatacagttacgagttatagggttgtgaattcttttttttttttttcagacagagtctcgctctgtcacccaggctggagtgcagtggtgcggtctccactcactgcaagttccgccttccaggttcacgccattctcctgcctcagcctcccgagtactgggactacaggcgcccgccaccacgcccggctaattttctgtatttttagtagagacagggtttcaccgtgttagccaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgaattcttataaagtagttggggatatttaagtcctttgatcattgaaaacaagtaccaccgcagttgccctgcctaactctaatgccacacataggataaaaaacaaattgactttccaaagatgtgttattacttttctgactgtcaagatacactgtgtcttatcttacatgtaagtaaagttgcaatcaagtgccatattataaatctgattttattaccaggaaatgctttcagatgtttaagtccttgaggctatgaacctggtgttggtgaaaaatgaaaactcactcaatgaaaaatatgcagttggcccgtggcatacaccccatgaccagaccacctcatgtcagagaaatgtccccaacttatgtgatctgtaccctgacagcaccagagataatacacatggagtagcgcctgtgtgcatctgattttagtggatttctctgacaacttgaaaaatcagacttaaatacttggggatatgaattggggcacaccgttctttacatacttggcaccaaaacagtatggataaattacatccattttaaaaaaacatgaatcattttaaaactatatttaagtttaccatttaaggatatccttagagaaaattgttaaacctcttttaaaatatatgtcatatatctttctaatcactatggcaacatttattataattccacccctaaaatgtgataacccttgaccatctccaaaatgtgtgactgataaacactggccagcatctttgtcatattttgatattcagaatgatggcaacggctatgatgctggccatcatcgaacggtgggtgcatttgctctgggccaggcactgttacacatttgttaactcacttaggagaataagaagtggaaatttaaaaagtaacctttctggggtttcctactgagtcataggccctaagtgagtagacacaggttaagtatcccttatccaaagtgtctggggaccagaagtgtttcagattgtggattctttctgattttggaatatttgcattatatttaccagttgggcatcctaaatctcaacttatttacttagcatttcctttgtgtcatgtcagtgctcaaaaagttttggattttggaacatttcagatttcagattttgggatatgggatgctcaaactgtattatagcctacttgaatgtttatttccaaaagaataatttgtttttgttagggtttctattcttctattcatttaattctttcccaatcgtgtaattcctcttgttttgagatgattctctcataagtgaggtatcatatttgagcctgcagccagaagcaggccagtgttccgcatcaggccgtgaggcttgtcctttggaggagctgtctaccgtgaagcagatgtgttagttatgtctcagcaatggcctgagtcaccaaacggctccatgaccgtgggggtttggtccacggagttactctacctgatgattttctgcctcgctcccaaattaaacacagaatgaccaactaactcataatcaaaactagtttgcagtaaatacaatgctctatttatgtttttttgttgcttgttttgaaacggagtctcaggctggagtgtggtggcgtgatcttggctcactgcatcctccgtgtcctgggttaacgcttttctcctgtctcagccacccgagtagctgggattacaggtgcatgccactacacccagctaatttttgtacttttagtagagatggagttttgccatgttggcctggctggcctcgaactcctgacctcaggttatctgcccacctcagcctcccaaagtgctgggattacaggtgtgagccacctcgcccagcccaatgctgtatttctgaaaaaggtatcaccagaatattaaaaaaaaaggttaattattaatttgttcacttaattaacaaaaaaaagtctatggcaaatctcatagactcggagtccagtggggtagaaaaaccaacattcttaacggtcatattttccctttcatcccttgtctgggggtgtgatattacgatatactgtgtgtctggttgtgtgtgtacacacacaatatatatataatgtgtgtggaggggagctttccatcccggggtcctggcttattactcccatagcccttgttgtttcctaagggactaaaacaacaagcatatcttttgttgaagtattggccttttgtccttggtttctgaagtagcttcagagctttaacggtgaaagacggtcttttgctataatgtttgggcactttaggcctcagaaaacagaatctctcttgctgatcttctcctgccctcctttcatgtactcctttgtctccccaaggcagggctctaattttcccctgccctcatccataaagaaattctttgacctacctgatctgattagaagtcataagactcacatttcggaaggagtcctgtttccattccctggaggaaggagccacgcacagagaggccaagaagaatctgaacagataggtcttgttgggtttcctcgctcagtctaatagtactagatcatgccttttttgtccaatcacagttctacatggttgtcaatcacgcctatccaatggagcctccatgaaaggcccatgaggatggggttcagagagcttccaggtagtggaatacgtggaggtttccagagggtggtgcacccagggcgggcatgaaagctctgcaccccttcccatgtgccttgccctgtatagctcttcatctgtatcttctgcaatatccttaataataaaccagtgaccaggcatggtgggtcacgcctgtaatcccagcactttgggaggctgaggcaggtggatcgccaggtcaagagatcgagaccatcatggccaacatggtgaaaccccgtctctactgaaaatacaaaaattagcttggtgtggtggtgtgcacctgtagtcccagctactcaggaggctgaggaaggagaattgcttgaacctgggaggtggaggttgcagtgagctgagatagcgctactgcactccagcctgggtgacagagcaagactccgtctcaaaaaaaaaaaaaaaaagaaagaaaaaagaaaaaaataataaaccagtgaatgtcttttcctaagttctgtgagccactctagcaaattaaacaaactcaaggagggggtcatggggtccctgatttatatagccagccagtcagaagtacaggtcaaacaacctggggcttgtgatttgtgcctgaaacttgggggactcttgggggctgagccctcaccctgtgggatctgacactatctccagatgatagtgttggaattgaactgggttggagaatgcccagctggtgtctgctgtggaattgactgattggtttttggtagggaaaaattctcatacacttcttggtgaccagaggtcacagaagccttctgtgttgactattgtgtgggagcagagaaaactgcttgtttttttctgcagggggcatttctgggccatgatgtccactgcctgtttaaatttagaaacagtctctggatggccaacccaggtgcccccttggtcatgaatgatggactgctctctccttaagggttgagatggttctatccttcaccattgctaggaaagtgactggcttgagagtgagtgaccaggaaataaagttaccaatagcactgcctttgctgttcattgatgacctgtgacatctgtgacctgtgacatctgtgacctgcatgacctgagatctctttctgtctctgcaatcaaatttccaaaattcagagataaagacatgttcctagaacttcatttcagctttcacaacccctataatttccatttgaaaagccagcccaaacacaaaattagtttcctacgccagagaacattatgattacagaggtttggaaaaggggaggaaggtgttgtataaacccttagttctggttattttttcccctttatttgaatgacagtgactttaaaataacatacaaataaaagtaaaaccagagttttgaaaattgagcaagttgtacatttgtcacactgaaagaaaaaaaaaagtgtcagtgccctcttccaggtagattttagtcaaaattctaataatttcaaggaacaggagcccactcgtgctggttcaagggcaggtggcaggtggacaatgtcaagggatagtgtgactggcgtattgtgctgtgggtggttctgaggatcgagggcttgaggagtcaggcttgctctgccgtccgggtgcatctgctacgtgctccctctcttccagaagcttctttaggaccactctaaagtgccatgccctcatggccctagcttgccaatgccccccaaaacttgatgttacatcctgtccctacctgacttttggttccattggccatggcctgagtgacaaaggaatgctgtggaagtgtggcttctggcctcggacgtgggcgggatggcttccctcagaaggaactgtagatgcacctgcagtttgcccagacctcagtgttttcatttcctctcttcctctctgtctccagaaagagctcttggaggaagttggccagaatggcagccgagctcggatctctgttcaagtccacaatgctacgtgcacagtgaggattgcagccgtcaccaaagggggagttgggcccttcagtgatccagtgaaaatatttatccctgcacacggtgagagctatacccagtaagggctgataggatgtgatggtccaggcagtgcacagattgccagaaagtaacctgggggatggatggctgattaaagaatgaaaaataaggctgggcttatctcaacacttcaggaggcaaaagcaggaggagtttgagaccaacctgggcaatgggcaacatagtgagaccctgtctctacaaaaaatatatgtatttttaaaatttgctgggcatggtggatcatgcctgttgtcccagctacttgggaggctgaggtgggagaagtgcttgaacccaggaggcagagattgcagtgagttatgatcacaccactgtactctagctaggtaacagagtgagaccctgtctcaaaaaaagaaaaaaaaaaaaagaagggaaaaataagaatcaaaaataatttttccaatgataaagatatgatatgataacatgctttacagaactgctgatacccataggtccctcctatagttactattaatggtaataacttacttggaagattagtcttttcagatgccaactttggctttacttattgaacttagttgcaatgatgtatactgtacatgactgaattttagacaggcaatatagctaacccttagctgtctacaattgggacagtttatttgctgttgcttgttttgctgtgtttgaaatagtactgctttgccatgtttttacccattcaagccttgggtaacatgctttgtgctttggtctgcacggaacatgaaatatttcctatggaagccatcctcagactgccctgggcccacggagctaaatgcccagccatgcgtgttggcttttgcatgttgctggaatgtcctttggcacggtgccactgtggtaccccaagtgaaccaagtgctgtgctcactccataacccaatggagccacctttgtttgactctcacctgccctaggttgtttaatgttaaacggctgtcataaagtccatgcataggcatctagatcagtgtgcttatacattaagtttttgccaaacatgacctttgtacccaatagcagacagaacttgtgagcaaatgattgagttcccacctgtctgttcccagtgaccctgaaacttgctctcccttttggtgctgaaatggaaccatattacgttcttgcagcacataggcacagtttctgggaaacattagtaactggtgatggggaggcaagatgtgtctacctggtagaaattcaacgaccctgagattctggctggacgcagtgactcacgcctgtaattccaacactttgggaggccaaggcaggcagatcacttgaactcaggagttcaagaccagcctagccaacatggtgaaaccccatctctatctaaaataacgacaacaacaaaaattagcagggtgtggtggcatgcgcctgtggtcccagctacttgggaggatagcttgagcccaggaggtggaggttgcagtgagccaagatcacaccattgtactcctggctgggtgacagagtgagacccccatctccaaaacaaaacaaaacaaaacaagaacaaagacaatgagattctgattctaaagggacagcttaaaaaaattggagtttaggctgggcgcagtggctcatgcctataatcccggcacttcggaggccgaggcagttggatcacttgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaaatggcaactgtaatacattctatataaaggggtaagaatgtgtcagaaaaatttggctgcattaagaaagtcagggaaggcctttgtgcagaagtggctgacaccagagctaagatctgaagaaagagcaggtattcattagatgagagagaagaagagcattacagccagaaggagcagcacatgccacattaccaaaaagtggggctgctgagtacagcaaatatattaacaagattacaatactatttcaaatatttagaaataaaactatttccaggaaccattaaactcagcagaagcttaaaacaaatgaaagacttgtaacaggttattgttatctatgtcgaagtcagttcccatggatccttactacaagatctattcatttgttccttttgtaaaaccactttccagctcatttttaaatgaaaatacttttatttttacttataaaagtaacattatatttttttaaaaatcagattatatcgaatagtcaaaaggagaaagtgaggcccatttcaggcccatagatggtgttggttgctattttggcatacgtctttccaagtgctttgctttgtgtacatcagtatttttttcaaaattgtgttatctctttaaaataatctatgtacctaaggtaacttgagattaaatctgtaatctagactttcaaattcataatactttcccaccaattagtctaaaacagtgactaaatggattattaaaatagacttcattttttatttttaaaattaatttatttttttgagacaggatcttgctctgtcgtccaggctggagtgcagtggtgcattcatggctcactgcagccttgtcctccagaacccaagtgatcctcccatctcagcctcccgattagctgggaccacagtcacataccaccatgtctggctaattttcttactttttatagagatgaggcatctcactttgtttccctcgctggtcttgaactcctgggctcaagtgatcctcctgcctcagcttcccaaagtgctgggattacaggcatgaatcccagccttattttttagaacagttttaattttacagaaacattgagaagatagtacagagatttctcatatgctccatacctagtttcccctattattaacagcttacattattagtgtcacacgtgtccatgtgaagagaccaccaacaggttttgtgtgagcagtaaagctttttaatcacccgggtgcaggtgggctgagtccgaaaaaggagtcagcaaaggatggtggaattatcattagttcttacaggtttgggataggcagtggagttatccaatatccaatatccactggaggaccaattttttgtaagcagggggtggatcttgcaaagtacattctcaagggcccgggagaatattacaaagtaccttctcaagggtagggagggtgtatcatacaaagtacattcgcaagggtgggggaataccacaaagtacattatcccaagggcagggagggtgtattgtcacaaagtcaattgatcagttagggtggggcaggaacaaatcacaatggtggaatgtcatcaggtaaggcaggaactggctattttcacttcttttgtggatcttcggttgcttcaggccatctgggtgtatacgtgcaggtcacaggggatatgatggcttagcttgggctcagggtcctgacaattagtacaatacatttgttacagttaatgagccaatattgatccattgtcattaactaacatctctactttcttgagatttccttaattttcacctaatgtccctttagtgttctgggatcccttccaggatgccacattttacagtcagtcatcacatctccttaggctcctcttggctgtggccatttcttagaccttccttgtctttgatgatcttgccagttttcagaagtgttagtcgggtgttttgtaggatgcccctctattgcaatgtgttcgatgttttgctgataatgagcaggggttatgggtgattgagaggaggagcacagaattaaaatgccattgtcatcacttcttatcaagggtgcatattaacatgatgtatcactgttgatgttgacattgatcacctggctgaagtagtatttgctgggtttctctaccatgaagttattttttctccctttccctactgttctttggaagcaagtcactatgcatagcccatattgacagcatgagggtttaactccctccaccccttactagctacataaaatatttggaattcttcaccacaggagattggtgtcttttcttccattcattcattcaatcatattttcataagtatagacttatggatattcattttatactcatagtctagtattactttagtttcttgctcagactgttacagctttggccactgggagcttatctgttattctctgttcttggcggtacctggctagagtagtttcaatattgccaagtaagtctaaaataaatcaaaggaaagaaacacgtttcttctagggggaaagcttttgttgtagaagagcccattgaaaagcggaagctctgtagcatccttgtggaatcagtgcctgccccagtagccctgtttttatagtgaagtatctttgttttcattcacccaggaatgcattcacagaggaggattctgaattagtggtgaattatatagcaaagaaatccttctgtcggcgagccattgaacttacctgtaagttgactttcatttccctttttggcaaaagttaaaatagttgagaacaaagaaggatcaatagacagatttctaacaaaagccaaagatgtcgaagaagaatggatatttttaatgtacaaaatgtctttaaaagcagcaagtagatagccagacattgccatgcacagctctgtgggctaatttactgcaatcaggagcttgacctggggttaaaaggactcacaatgtcatgaaatgtggcagaaaagaggaaccttctagggtgacagaagatgggtagaggccagggatttaaagaaaacttctaactagtgaacataatctcaagcctcatttcctgttttcctggcaaccaactccgaggatgatttgccaacatgctttatagtaattatggtttgagctttgctgaatcagagagtgggggcttctggtttaaacagcggaaataaacagacactagtgttcctgaataatttcagaaaaagtatagaaaggacatgcaaatattaacaaattcatgcttctggatgtttgcccccaataaagaaaatagataagaatgacagaatacaggttgctatgaaatagaaacttgcttggtgtagaatattattaatttctttacctttctagtctgtaagttttgacttttagatatcctcaattttttttttaatttaaaattttaaaatttgtcatttagaccactttctttcctttattggagaaccactggataaagctttttctctgagaactaatgtgtcctaattatccacatttttttgatctttcaagagcttgttcatgccttaactgtggtccagactgaatcatttgccaagagttgttgaactggtccccttctggttaatttctcttgttgccaacatgactcatctattatataccttactatattatatattttattatagaaaaatctttttctccaattcctcaaagtgctcaatttagcccttgctatgctgttataataggtttcatatacagtatgtaaaataagagcttattctctagatgtttcctgtggtttgtgagactccgtccatggcatgggagggtaggggacgtgtggttcttttgtatactgtagtcaagggtataatattaatagtaaagaattcaccagaaattacctattgacttatcttccttacccctttaagtcaaaggcaaaccacccctacatgaatctgattaccggctgctgctaccacacaacagaatgagaaatgtggttctgatttttgtaattcttcagaattaaccttgccctgaaggattcattatacttagtttaatcattctaaagtatgaaattttattactggcatttttgggagagaaataatagatacaaaatgaaaaaaggggccggctatggtggttcacacctgtaatcccagcactttgggaggccgaggtgggtagatcacttgaggtcaggagttcgagaccagcctggcccagatgataaaacccgtctctactgaaaatacataaattagctgggtgtggtggtgcatgcctgcagtcccagctacttgggaggctgaggcacaagaatcgcttgaacccaggaggcagaggttgcagtgagccaaggttgcaccattgcactccagcctgggcaacagagctagactctggctcaataaataaataaataaataaggaatgttttattatacaggactttatttcattttaattatcaagtgaaagaaaacacgctgacaatttttgtacatactatgttactcctttttcagtacatagcttgggagtcagtgaggaactacaaaataaactagaagatgttgtgattgacaggaatcttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcacatgaaaagattctcttcaatgcctagcacatacaggtccttgaaaaatattaattttctttcttcattgaaaagcatgtaattcattgattagtttcctatgtactttaagtttattcctctagttcttaagttcattgttcttggcacctttctaattaggaacaaaaatgaaaatacgtatttaacttgttaagttgttcttaggatgaatgataatggtattaaaagtttgtgctttaaaaacttcaataatatttttcatgttctcttctaagtgtcttggattggttataatgcttaataaagtgatgagcaaaggtaggcccaagccacccaagctcgtgacaagcaggagactagagcgtggcgcatcaccctggtttgcgatgtgggtggcctgggcaggctctgcctggctgcccgtgggtgagttgctctcataccacatgaaaccagcagctctggcactgtagcatttctgtggtcagggaagagtttgcacagtgtccatacaggtgttctttcacttcacaggagagtttgggtctgtaatggaaggaaatcttaagcaggaagatgggacctctctgaaagtggcagtgaagaccatgaagtgtgagttatcagtgatgaatcccattcttctagggtgggcagttgcttcagtattgggtgctccatgaggccatatgtcacaatctcagttgccagtgggccagaaggcaatgtggaacactggtcaccaagggggacttactttaatgagctcttcatgcatgcattacatattctttatactcaaggcaataacattttttatttttactaactcctgcatgcctatgcatacatactgtctgtcttgctctctctccttctctcactgtctctctttctctcactctcatctagtagagctaacaactccaaagtagagcatcaattgctgaggcaggggtgatctaatagcaacatctgaccccaggggttgttctggccggcctgtctagtgtggtggggccacttcctcatttgaggatgattgcatggccctgaggaagctgcgggctgcctggcaagtaagttccccagaaagaggagaaatatttggtcaaggcatatgaagagttgctatcataagctagaacttccaagcaagctgggaagagagccagcagtgagacagggagagtcttgtaagtcacagccaagaacctgctttatcctgcaaggagtagagcgctattaagaggcttaaccagccgggcaccggtggctcacgcctggaatcccagcactttgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaaagtcacatgaaccggtactttttaagtagaccataatgactaatatttatgtaatactcactgttagccaaaggacattgcagttattcctgtatttcatcaggacaacaggaagagaaaatgaacataactaaaaaggaggttcaggaactagcccccagaaactaaaacaccctgaagttagaatactcactggagctgaaccaagcactgagccatattctgcactgttcctgcctcttgtatgattttatctgagcctcacagtgcatctgtggggagtccttccataattcctattagggatataaggcaggtatattaggaggcctggtgggaggagctgggcctggaacccactttttctctggcttgactctgcagttatttaatttcattagggtaaattgcatagggattacacccctgctaattgtcaaagattgagagtataatctctagcttcaaaatccccaggctcagctacatttacctgcaggttggacccctggggaatagtctgcaggcagagccctacccctgtattcccccacctggttgtttgcagcaaaaggaataggtgagggcaaatttttgcagatgtatagattttcttttaattagaaaaatttttaaatttttctaaatttccttcagtagaaagaagattaatatatattaagccaataggatggtatagacactgcattagatgccctcatgcatgattttaatcagtagttttaccctgttaacgcaaattccctaaggcaagccagactttttatttgtttgtttttaattgtggcaacatatacataatataaaatttaccattttaaccattttaagtgtacaattcagtggtattaagaaccatattcataatgttatacaaccatcactaccatccatctccaaaacttttcttttctttttttctttgagacggagtctcgctctgttgcccaggctggagtgcggtagcacgatctcagctcactgcaaactccgcctcccggattcaggccattctcttgcctcagcctcacaagtagctggaactacaggcgcccgccaccacgcccgcctaattttttgtatttttagtagagacaggatttcaccttgttagccaggatggtctcgatctcctgacctcgtgatccacccacctcagcctcccaaagtgctggggattacaggcgtgagccaatgcgcccagccccaagacttttcatcttgcaaaactgaaccctctacacctaccgaacaatgactccccactaccctttctccccagccctggcaagcactattctattttctgtctctgattttgactctctaggtacttcatgtaagtggaatcatagagtattcatccttttgtgacaggcttgtttcacttagcataatacagaattttaaatgtctctctcttaagccagtttaattcaaaaaatttggtatgaaaatgcatccaactcacaaggcgtggttgagcaaccagacttgcaggacatacaacaatagaaacagagaggtgtggggttctttctttttttaaaaaaagcaaatataattgcaacagatcagttagaattgttctttgttttggtgttggggttttttttttggaattttttttctttaccattagactttaactttgtagagcagtttcaggtttgcagaaaaattgggcagaaagtacagagaatgcccataggtcccctcctgacacacataatttctcctattattaatgtcttttattagtgagctgcattttttgcaattgatgaacccatactgatacattattattaaccagagtccatattttacattagggttcactcttggtgttatacagctctgtgggttttgacaaatgtgtagtgtcatgcatccatcattatagtatcatacagaattatttcttggccccaaaagtcccctgtgctttgcctgtttgcccctctcttatctcccctagccctactagcccctgacaaccactcatctgtttcctgtctctatactttcatctcttcctgacctgggttttagagaacagaactgctgttgcccacccactccccttaattgagtaaattatccatacttaaccttttctattttctcctctagtggacaactcttcacagcgggagatcgaggagtttctcagtgaggcagcgtgcatgaaagacttcagccacccaaatgtcattcgacttctaggtacttccgagaaatgcaggagtgggtggccaagagggctctgctgatctgctctgtgccaaaggaaaaaatctctggtgtagataagtttacacttcgtataaccccaacataacttataacattgaggttttcacccagacttttcttcataatgatgttttctgaggctaatagtaataatgagtttgcattttctggacgctgatgggctcaggaatgatttgagttttccacagaattctaggagagtgtgaattaaattgtcctcagttactcaaaggcaagacacagaggtggttgtgttataatttttattaatttaaggttatgcatgagttagatagcagtgggataaaggtgaaaaagtaggcaaattccgtaggtttatctttgagaaataatttattaacctgtttgaaagtactgatttcttaagatcatgatacattgatgatttcatggaatatgatttaacagttccatagaacatgatttaacgtaatttggctttgcagctccattagccaaaaattacaaaagaggagattaagtatggagtggatgctgtgtaagtggctctgtcccaagagagaagagtaacctggaaataattgaattttctgctgaccttggtgttttgtttttgctttgccatcctgtgactgcatacatgctaagttcttttgggatctttcaaagtttcatatgattggcactgcagagagatgtgaaaatcaatgtttgtatacagtattatgtcaaataagctactgttattcattcactgctattggcttcagccgactatgagaacaattgcactttgtgatcacaccacagagtgcaggagctttgcaagcatgggatcaggtgatagcctctggctctcagattccatgataaatgatattatagcttctcttttgcaaaactgttaaaatttagggatgtgaattttacctatagcccttcaaagttattgtaatagtttaagcatttgcagtggacttcttcacgtgattaaatatctatcacatgaaactagttcgccctagttcaatactagttcagtattgactttgagggttgtagcgttaaggaatcatagccactggggacattgtgtctttcatttcctaggcctccttatctgaaacaaaaatcttatggggtcactacccctcagactcagtggaacagaaattcctaggtttctagatggctatacttgttacagtttaatttgtgacagccctcatgccctcattaatctgaaagggggaaaaataccagtagtggaccctgtgtgtgttccattttctagaacagagtgtgagttaggcgctcttgattttttcaaactgttaacttggtaacacacggcttcagtttttccagtggtccacgagggcttttctggtcacagtaacaaggactctttgtaattgatgctgtgtttgtaatttcaggtgtgtgtatagaaatgagctctcaaggcatcccaaagcccatggtaattttacccttcatgaaatacggggacctgcatacttacttactttattcccgattggagacaggaccaaaggtaatgatctccttgtgttacccctgaacacttctcagggcttatgtgacttagccaggacaaccaaatcatctaatcttgaaagtgaagccaggaaggagaggacgttgacttttgttcagtgctccctgtgtgtccagggttgaaatgtggggtctatcctcacagcaggcctgctccaggtattattatcctgctttatggtgggtaagtggctgcgtgcacagtcttatggacaaagccttaccaacttgagttgggtggcccaggctcctggttctgcacttcacaaccctcatggccgcatactccccagagcttgcagactatgggaaggccattgaaggtggctctcctaaaagaaattttacagagctcattctggatttcaacctttgaagaagtgttggtgaccaagaagactgcacaactgacattctgaaaactgtttgtaacattttactccctatgttgacttacccaccatgagcactgtgaagccctgggaatgttggatgtagctgtagaggcagttacggatcatctaggaaatttaggaccatggagacgcttgcctttcttcagggtcaattttcagtattgactttgagggctgtagcgttaaggaatcatagccactggggacattgtatctttcatttcctaggcctccttatctgaaacaaaaacagtatcctcctgttatgttttgtggacaaacggtagactgcgagcaggcggtgtgtgtcctgactacatgcccagctaagcaggacgccccttcctgccttgcacgcatcttctctgttgcaaaaggcagcgatcctgcggggttctggttgggacacatgtgggaacagggtgtggctggcctctgtcaacagtcattctctgactgggcaaaaggcaaaagtcactccagatcatcactgcccttaatcacagctgtaagaaaccacaggtcctgggaaggaaccgaaccacccagtctacaccttggcattctcggacacaccccacctttgtccctttagctgccatcagtatgaggaccgctgagtgcagtggtgcaattaggaacaactgcttccttcactgcatcagcgatggctccaggaaagaattcttgctgctcttgcttgatggtctgatgagtccacaggatgaaagtgcaaggaaattagttcttagggaccatgaaaactcactcccactggctctgcagacaaaacacaggggaaaatgtcccatgcagcaccagtgtggtggagttctgcacactcccctgtatctacaaacctggggtgacagtggcctagggtcagccaggtcgcttttccaagtgaagcagtgccatgggactcactcacaaactattaaccaaaggaagtttattaagttctgcccaggtgcggtggctcatgcctgtaatcccagcacattgggaggctgaggcgggggaatcacttgaggtcagttcgagaccagcctgaccaacatggtgaaaccccatctctcatgaaaaaatacaaaaattagccaggtgtggtggcaggcaccagtaatcccagctacttgggaggctgaagcaggagaatcatttgaactaggaaggctgaggttgcagtgagccaagatcacgccactgcaatccagcctgggcgacagagtgagactccatctgaaaaaaataaaaaaaacaaggtttattaagttcattagttcactctgtgaacaagtgctgactctaaggtgggcactgagctctggggacactggagggaacatgacagatgtggttcctgccccatggagctgagctgctggtggtgagtgagaggagaacaggagacagacaattggttattcacagtgagggagctatgggcaccaggagcacaggggctcaaatgcccagtgggccaggcagagcccagtgggggcataggggcaggaagtgtgcaaggtaactagactggggggtgtggtgtctgcgcacagatgcagaacctcatggtggcagggccaggacttcttcgtttcagtaacctggagaatgttggcagatagatcagaggtggtgattggaatatgaagccccatatgctgtggggtctgctgtttagaaggagggattgtgcagagaaatgtgcattcccttccccccgccccccacatcagtcactgagcatcctcatgtcagggaagccacacacagaaatgtgcattcacttcccccccacccccacacccagtcattgagcatcttcatgtcagggaagccacattccttctaaaagatgtttgggccccatgtgctgtcagagaagcttcttgtttttggagtcccctcttcttggcttgttcattataacatctctggatgcagggtgcctttcagttccccggtggaggctgcatggagttgctttctagttgttcactgagggtgaacatgctccctccattcatcttctctttgtcatgagcctatccatcctcaggatcagaagatgtgttgggaattggtaggccagcttgcttgcctcagcagtgcccctaagaggggcagcaacccctgccctgaatccttccagcatggagaaactagagagaagcggaacctcagactgaagtgccccgacctccggtaacttatgaacttaataaccacaagtcacaggtgactgatagagttacagtgaaccatgatgacaagaatgacaactgagggccttcatgggggaagtcggcttagaaaaacactagtcctcatcccaagagacaggtccatctgtagaaacagccctttatttaaaatttgggaaagctgaaacaaataggcaaaaatgtgagacccaatttagggtcagcacatgctggagcctccttttccacttccagctgacgttgttggtatcttacgcctgtgtgtgatggaggggagggtacttttgctttgctttttttcccccttttactctttctcttcttcctagggacagcttaagtgatcaggacaggagagtggccccctttcttttttccagttcccccctggccccatgcccacatgtactcctgttctcttccatgagaatgcacttgtctttcaccaacatgagtgctaaccgtagagacaggaggctgcagccgcatcacacagctgttataaaatcaccgagactcttccaaagaggtgaggggcctagtcctacacagaaaatataatagacagggctgagtattttccttctctttttcccccaaaaagaaagatgattgcattataggaagtctgtaaaaggataaaaaattacccacaattcccaacaccttagtacaattgttggcgatttcagacattcatctctcattgttcactcaatgcctacatttctcatggccttcacgtcactacatacacacttgcccctgggatgacagtggctaacctttctcaagcatgtagcataggccagcctgtattttgtatgtattaatgcaccagtggcacaacagccctaaaaagtagttactagtggaatctaagctgaggaaactgaggcacagggggccatggtgaaagcaggattggcccccaggctgcagactgtgagccttcaatgctcttctgactgccccattctgtgtgcacccctctccagcagggcagcccccacacagatccctgtgagtggcggcaccacatcatttcagtgggttttgtttcatgttgatgggtgattttactcacatttaatttatggtacgttgtataatttgggaggggggtggtggcggggggatggaaatttcacctcttgttgtccaggctggagtgccatggctcaatctcggctcaccacagcctccgcctcccgggttcaagtgattctcctgcctcagcttcctgagtagctgggattacaggcatgcgctatcatgcctggcttattttttttttttttttttgagacagagtctcgctctgtcgcccaggctggagtgcagtggcgtgatctcagctcactgcaagctccacctcctgggttcacgccattctcctgcctcagcctcccgagtacctgggattaaaggtgcccgccaccacacccagctaattttttgtatttttagtagagacggggtttcactgttttagccaggatggtctcgatctcctgagcttgtgatctgcccacttcggcctcccaaagtgctgggattacaggcatgagccaccgtgcccggccatgcctggctaattttgtatttttagtagagacagggtttctccatgttggtcaggctggtctcaaactcccgacctcaagtgatcagccgcctcggcctcccgaagtgctgggatgacaggcgtgagccaccgtgcctagctgttacgttgtataatttttctaataatttcttgggggtgtggaaatttcatgttattgtacaagagtgcattttgtagcaaaaagattaaaaatacacagggctatttggtggcccaaatagttttgtctattcaagaatgttacataaatggagtcatacgtttataaccttttttttttttctttttgagacagagtctcactctgtcacccaggctggagtgcaggggcacaatcttggctcactgccacctatgcctcccgggttctagcaattctcctgccttagcctcctgagtagctgggactacaggcgcctgccaccacgcctggctaattttttttgtatttgtactagagacggggtttcaccatgttggtcaggctggtctcaaacttctgaccttaaatgatccacccgctttggcctcccaaaatgctgggattacaggtgtgagccactgcacccggccattttataaccttttgagactggcttccttcactcagcattatgtctttgagatccaaccaagctgtgtatatcaatagttcattccttctttattgctgtgtagtattccattgtatgcttctaccacagtttatcttttcacctgtttagggacatatgggttgtttctaggttttagcaatcatgaatgagactgctataaaattcatgtacagatttgtggatgaagtcttcatttttctaaagtaaatgcccaagagtaggatgctgggtcatgtggtaagtgcatatttaaccttataagaactgttttccagagaggccattccattttacattctcaccagcagtgtgtgagaaatgcagtgctccccattcttattaggacttaatattgttgctggcttttctggtttttccttatagctgtcctgattgatgtagagtgatatctcatcatggtttttatttgcatttcccgaatgactaatgatgttgagcatcttgccatgtgcttatttgccatccttacatccgctttgatgagtgtctgttgttcaagtattttgtttattttttaattgagttgttgattttctcgtcatattttgagagttctttatatgttctaaatacagttcttttgttggatatgtggtttccagagactgttttccaagtttgtagcttgtcattgcattctcttaacacgggcaaaaatattttaattttgataaagcccaatttatcagtttttttttaatgagtcatgcttttgctctcatgtctaagaactctttgcctaacccctagtaaaaagattttctcctatttcttttctaaagattgtgttcttttacattttacatttaagtatatgaccaattctgagttattttttgtatagggtttgagatttagtttaaggtttgctttttttgcgtatagatgaccaatagcaaaagactatcttaatccatgaaaagactgtccttaatccattgagttgctctttgtctaaaagcagttggttgtacatttctgagtcctctgttctgtttcattaaactctgtgcccatcctttgcccctatcacattgtcttgattactgaagcttgttataaatcttaaaatcacccagtgtgattcttcctactttgttctactttttcagaattgttttaactattctggtttcattgcccttccactgaaactttagaatcagcttatctgtgtctggcaaaagttctgctgtaatcttatatccttttgaacaaaataacaagtaagggaaacaagtacacaacattttactgactgatgaatagtttccatttgcaaaaaaatacaagtgtattttcaatgatggaaaataactttcaagtattaaaaagataaaaaggaatgtagtttcctattttgttgcttagtagccacagataaggtggaagacacaaagtgcatagacaaacagaaaaatcaagcttttattcagatcttttctttgctgcctggaataaatagctcctgctcctgctagagcagcccaagactattatcagtgcatttgatactgcgatggcccaatatcaatgtatttaaacatgcttctccaggagggctagggtgctggacccatagtgccactctgcccagggcagacatcgtctctggagctgtgcagggcagacaggtagatgatgagacatgacccccagttctcatggagatcgatagtacaaagggagataggctgtaataacatatgcatcacacagtgatgtgagcagcctgctagagcttcagggaagaaatgagttctgactggagaaatgtttaaaatattctacactgctgactgggtgtggtggctcacgcctgtaatcccagcagtttgggaggccaaggcgggtggatcacctgaggtcaggatgtgtccggagttggttccttctggtgggttcttggtctcgctgacttcaagaatgaagccgcggacctttgcagtgagtgttacagctcttaaagatggcatggacccaaagagtgagcagcagcaagatttattgtgaagagtgaaagaacaaagcttctacagtgtggaaggggactcaagcgggttgccactgctggctgggggtggccagcttttattcccttatttgtccccacccacatcctgctgattagtccattttacagagtgctgattggtccattttacagagtgctgattggtgcatttacaaccctctagctagacacagagtgctgattggtgcatttacagtcctttagctagacacagagcaccaattgatgcgtttttacagagtgctgaatggtgcatttacaatcctttagctagacacggagcactgattggtgcatttacaatcctctagctagacagaaaagttctctaagtccccactcaacccagaaagtccagctggcttcacctttcaaggagtttgagactggcctggccaacatggagaaaccccatctctactaaaaacataaaaattacccaggtgtggtggtgcatgcctgtaataccagctacttgggaggctgaggcaggagaatcgcttgaacctgggagggagagtttgcagtgagctcagatcgcgccactgcaccactccagtctgggtgacagagcacgacttcgtctcaaaaaaaaaaaattccacactgccatcatggatatcctcaaaagagtggtaggaggagtacagtggaaaattaagagcagcacacaagatcagaatgagcaaagaccaaatgatctgggagcatacctatgttttaagaaaagcagattgtctcacatggcaacagcaaagcaatggaaggataggaggaggggtgataaaacaggaaagagaagttggggtcaatgtttaggttctacaacaagtagaatgacttcaccagcatgtaatacaaaacccaactcaaaatgactttcaacggagatacaggatctcatgcaataaagcccagaagtagcacagttccagagttggctaggtgggtgcttgaggaattaattgagaaattaaagggctacaaatgcatttgtagcccaagctattaaaacagctcctacacaataagaaggaggaggagaagaaagaattttcttaatttcattttcagattattcatcactagtatataaaaatacagttgatttttgtatgtccatcttatatcctacaaccttgctgaactcatttattaattctgctatacaattattttttaagtgacttttggtcacagtctccaggaataacagaagtgttctaggaaaaaacagcacaaatgaatagtacctgatactcattacatcttcatgaatgacagcaagatgcaatatttcttatgacccaaatcctttcctggaaatcagtatctagaaaaccaaatacccaaataatacagaatagaggcataaaacttccatacttaaagattaagacatttcatttatttatacagtatgtaattgacatgtgtcttggagtataaaatcattgaaaatgcaatgtctttccaaaatgagtaccattttggaaaactcatgtttggaaaggaagccatggcaaattcagtgccttggggagggtacataatggatggacccattcatgactgccagggacttgtgcaaatccttttctgcagggccatgattgcactaaaacacttaattactacatggaagttttatcagcagtcatcctcataactgattccaacagtggctggttttctaacacagcaatctagtttgatttttataagctagagaaaacactagactgttgaaacttataggcagggcctacgggagcaaaatgaaaattcctgaatatgtacttgtggtgctttggtcctgtgataattggtgaagactctcctaatttctgtttagaagaaacgagtatctttcaaaacatttcgtagtaaaatggtagcagataggggtgcctaattggaaacagctcatcctaagtggacttttcccctccgaaacattagacccctgacacacacacacacacctcgccgctgctgaagccagaccacctgtccctttccctcctctgtgcaatgcgtgtgctctgtcccactctgaaggatacacggaaggatcacgtttgacctcataccttctgaaaagaaacaatgtcattcactgtaaatacttttaaagatggggaaaagagaatatgatgtttgccaagaagtttaaggtttttctcattcctttttaaaaaccttatttgtgatattagtgatatggaaataaaagatttgtttccttatttcatcactacactgtaataaattaaagcatcctttccccccccggcagaaactgcttgcaagttttcctttttaaaagatagtctttcttcttgtttcctctatcatctagcatattcctctgcagacactattgaagttcatggtggatattgccctgggaatggagtatctgagcaacaggaattttcttcatcgagatttagctgctcgaaactgcatgtaagagtcctcggctatcctggaagggtttggacctcatggtgtttggtctttgcagggttagtgagaggacctgttcctgtttagataggcaaggaagctgcagtcagcgggggatggtgtggcttgctccgaagatggaaatatggctgggtgtttgggagttttcactgcctctgtatctgagagtctggttggcttccaaagctttcccttatgactccagttttaccttcactctctcactcggtaggaatgcaaggtgtgacccttgtgatccttccccagccatcagctagctttggacctagagttatgtgtacgtcagctcctcttaaagacagcagtgaaaatcataaaggcttttccctaagttttcacaacacttccttaggaagaagttttgtactttgaatacatggaagctgtcctttcacagcagacaatggcttcattatacaagaaatgtggacttaggttctccctatttcttcaacctgcttcagcagagccattgtctgctgtaaatcttcaaaaacaataactatgtcttgattttaagttttttattgcaagaagagggagtggtccttcaatgtattttgtcatttgtttttcttggtcagagatgtgacaatggggcctgccccctcccgcctcccagccgaccctgcccctagggctcctacctctttcacctcatttttgaaaacactaaaggggttttggttttgttattgttattatttaaatgatttttcgaccatggagggagaatcatgaaaactctttttcccttactgtttccttcatgttttcccagcaggtagggtgaccagctttgcagtttaccctggcctgaggggtttctcaggacaagggattttgagtgtaaaaaggcagtgtcaagcaaacagggacaagttagtcaccttccccagactactttatatctatttcttctccttctcttccttttattctttcttctcctcttccttcttcttgtgtaggagctgttttagtagcttgggctacaaatgcagttgtagccctttaatttctcatttaattcctcaagcacccacctggccatcttagcaagaagcccagcatcttgctcttactgcaggtaattccccatcttccccaaactctcagggggcttacttagtcctcagggccagtgctgcttccagacctctgggaggaaggctgctggggtcctggatcagtccaccagagggctctggttttgagctgctgctctttctgctcctgctatgctgcgtctccatgttctccagctgtttctatccactgtgcacaggtgcccttgctggtccacatcccacacagatcagagcgatgcaagactgcatcacttgaggctaggcgtggtagctcatacctgtaatcccagcactttggaatgccaaggcgggcagatcacttgagatcaggagtccgagaccagcctggccaacatggtgacactccatgtctactaaaaaaaaaaaaaaaaaaattagccggctgtggtagtgtgtacctgtaatcccagctactcgggagactgaggcaggaaaattgcttgaacccgggaagcagaggttgctgtgagccgagatcatgccactgcacaccagcctgggtgacagggtgagactctatctcaaaagtctcaaaaaaaaaattgcatcacttgctcttgctcttgctctgctgttggtcctcacttgctctgccattggtcccaatgcagcatgctcacaggctggtggtgtctctgtgttcttttggtcaattatcataagtgttttcacctgtgtctgatacagaccagtaatttaaggcattgcctctgacgctgctgaagacgtaacctgctctctgtaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtggtatgtacacagctttgattcaggggtcccacagcacaaagaggagggcatattgaaagaaatgacctcagctggtatggcaagacattttactctttgataaactgagggttggcagcttgctcagatctcttttatatcttaccatcagatactttaattcaagtggaacagtagattctgatgaagtgtcctgacattcagaagatgtgtgctttgcaaaagcccttaatttcttcccatttttccttgccgtcaaaggatgactcattgcccacaactaggatatttcatagtcacattaaattgaatgagttcatccactggctcttggaacctagatgctatatgaaaggtgctgtgtaattacgcccttgacccgagataaggaaaaaaaagcacctcacagcaacagtggaggagagcactaagcagatgtgtgacgaggctgtttctgcctttgccagatttcccagaacagcttttgtagaagtggggaactgtgacactccaaccccacgttattgccgcgttgggagagcagtgcgtctcacacataattgccagctttgtgcgtgatcatcagtgtttaaggaaatgacctttcccagtgaaaaagtccattcaggctttgtggaaaggcttgcatcctaacttgttgttgctttgttcccagtgggcatttggcgtgaccatgtgggaaatagctacgcggggaatgactccctatcctggggtccagaaccatgagatgtatgactatcttctccatggccacaggttgaagcagcccgaagactgcctggatgaactgtgagtgggcttctctgtctcccttccatactctgcatggggcagccacctggctctgcactgacctcggaaacacagccatgggaggggaaagggactgctgttagccaggtgggcatgtgcagaggggtggaacccacagacaccccagcccaggagccattcctgatgtgggagatagtgtgtggtatctccagtgagcccactgaggctcactcatccaaagggcctcagtctcgaacgacaggcacggtcaagacaaggcaatggcacctgtcctaaaattccttacacacctctaggaaatatatccacagataatagcttcgccttgtagtgcatgaggtccttgaatgattcctcaccctcttttggtccagttatctttctccttctatgtagcatttcaaacactccactcacagtagtagccttcatcaggaaactcagaaatctaaaccaatgactttggggtcaggctgctcatcagaatcgcttgggagatagtgtaacaatacgattcctcggccctgttcccggaaattatgatgctttcggtacaaagtgggcccagaaatgtgtgttttagaatgctccctggggctgggcgcagtggctcatgcacgttatcccaacactttgggaggccaaagagggcagatcgtttgagcccaggagtttaagaccagcctgggcaacatagagagaccctgtctttattaaaaaataataaaataaggccgagtgcggtggctcacgcttgtaatcccagcactttgggaggccgacgcgggtggatcacgaggtcaggagttcgagaccatcctcgctaacacagtgaaaccccgtctccgctaaaaatacaaaaaattagccgggtgtggtggcgggcgcctgtagtcccagctactcgggaggctgaggcaggagaatggcgtgaacccgggaggcggagcttgcggtgagctgagatcgtgccactgcactccagcctgggcggcagagtaaaactccatctcaaaaaaaataaaaaataataaaataataaaataaagtgctccctgagagatcatgtgtttagacaggagaaagaactaccagctgtgacacacacacagcacacatcccatcctgacagggcccccgtcttcaaggccaggcagtatggggaagagacccaggcctcggagtcaataggccacgctctgcttcctaactggccctgtgagtggctatggcaattaatctcccccaagcactttgctgaccttattaaaataatttcttgtggcattgctggtagcttggtgatggtgatttgaaccttcctaatggggagtctcctccctgtataataagggccatgggcttggagaggggcattctcaccatatttagcaagaacatttcaggactgtgggcctgcgctggctctgtcatggagtgccatgcctgggctgggacaggtgagtgtggacagcaccctccctacacacacacacacagacacacacacacacgccctgctgcctcacatgggagagagagcctgggtccctttgcccacaggctttccgggtcccttctaagccaaaaagaaggacactgttttaatcagagcttcgtcccgttggtagtggttggtttttattgtggtggtagatgtataacattaagaagagaaacaagcactgtaaaacctttaaaacatcctgaaatgctaataaaattagttctagggtttcatggtagtttttaaaagtgccatgtttatgaagtgcctgcttctgaaaataaggaagcatttcagtcaaacaatgttgactatggaaagagttttgttgcagtttctttctgagctttccttgcccaccaaaataagttgatatttgcggtgattatgttgggtcttagcagggtctaagctgtgtcacgttgtggtttttagagccaaaacaagtgaatgctgagtcggttttctgtgagacattttaggggacaaagcagcagagtcagcacacgccgtgtggctggggaagtcaggcagagaggggcgaacctgccacccccgcctcctgtgggctctgtgccctgggtgtgccaagggggctatggctgtgctgtggcctcggggcccctgtgagccaggcttccttccatctcctctcgaatctagatgctgggtaacaacagcatcccccaaagaggcctctgttccatttctgagacatttcctttgtaaaatgaactcaggctgagtgcagtggctcatgcctgtaatcctagcactttgggaggccaagacaggaggattgcttgaggccaggagtttgaaatcagcctgggcaacacagtgagaccccatctctacaaaaaataaacaaaattagctgggtgttgtagggcatgcctgtagtcccagctgctcaagaggctgaggtgggaggatcacttgagtttaggaggtcgaggttgcagtgagctatgattgtgccaccagactccagcctgggaaacagagcaagatcctgtctcaaaaaaagaaacaacaacaacaaaaacccaaaaaacaaatctaaagtgtttcacatgatggctgaaatagtaaacgtgagggaaaggtcagtgactcttcttcatagtgaaggaggtcgaggtcacggatgagagcaggtgccctgtgttagatggactggcactgccgccgactgttggcgtgacttcagtcagttcctctcctctccaggcctcagctgccctgtctgtgagtgtgactgcatctcttccttcgtggggctgcagtgaggagtgatcggttagggcccatcaacccacacacagctggcacttgctggtcatgttctacctgcatcagccaccttgaagctgcagttgcgtggactcaggggctcctctccgggactcacctgatgcccatcccagcaccaccctcgcgcttcacacacctgaccagcctagcattgccctcacactattatttaccctggcacccaggacctggtgtgttggctggcacagagctggccctgcctcttgcctgcttcttgtctgccccaagaaccccagcttatatccaccttccccatctcagaaaccctcctctacccattgatgtatccctccctccactgccacctgaagcatctgagatctggagaagggacaaggtgggagtcacagtgggctgagtggcagagctgggtagatactggctagcacagtggaagcacagctgataggagatgggcatcatttccctgtgcagacttgcagcctgcactcagccatcctcagagccaggagcaaagcaggtgcttgaaaaatatgagtaaagtcatacatttacaaattttgtaaattcatatgattgcatttaattgtgataaaatatacataacataaaatgtactcttaaccagtgcgtacagctcagtggcgtgaagtacattcacactgttgtataaccatcaccaccatctatctccaaaactcttcttatcttgtaaatctgaaagtctctacccattaaactaatcccattctctcctcaatacagcccatggcaacctatatgatcacatcttttataaaatctcagcagaaaaataaaaatgaccatttacaaaagcaattaccaaacttatttttctttccatccataaaattttataaagtctaaatcactaaatatcacagccctcctattacttaccagatgggggcttcttgttaatcttcttgttctactacgatgaaattgcccatttgtgggagtaggttagacagtatacatgttcaccatgtctttaaaagtcatatttatatttttatacatttgataaggtattgaatattaaaggaaaagaagtttcaaagtgatattgatactattctacttggaaataaagataaattatttaaatactttctcctaagacatgaaataaatgaaagtaagttaaataccacagcctcttgatgaaataatgaaaaggagattatgtccctaagaacagaatgtctcaaagctcatcttagatggcaaacaatcaaggctgtttggaaaacagagtcatgcaaattgacttacgcctgaaaacctcaaaaataaaaacagaaaccgtctgtcaagtctaagtgaccatctaaagaaggtaagacagggaaacaaaacagaacccctaagcctgagatgagaacaaggattgtgagacagggaaatgcgccgtgccgttgtctaggcctacattcaggatcaagctctttacatgcatggcactttgccagcctccagcttccggatgcgtgtgcaagtgttgataaaggctggaaagtggacagatgaaaagatattattatacatctacgtgaatgagatctgcatgttgtgtgtgaagtaacatgttagtagaattagccaaaagttctataggctgtaactaaatgtcaatatggaaattgcatatttctgttcgtaagatgctagtaatttattgcatgggtcagatgatttaaatttgggtcatttttttgtccaatgacgtatgaattatcagtttctcaaaacagaaaagcatcaaaatgaaatgatgcctaggcatgctggtgtgtacctgtaattccagctactctggaggctgaggcagaagatcacttgagcccaggagttcaggggttctccaccagcctgggcaaaatagcaagacttcgtcttattaaaaaaataaatacatctatttttaaaattttatatatatatatacacacacacacacacacatttttatatatatacacattttcaggccaggcatattaannnnnnnnnnnnnnnnnnnncaggtctatcaattataagaaaaaaaaacatttttaatgaaatgatggtataactcactcttcatctcagcctattgattcctaattgtcatctgtcttactgtgctccattaaatgtccctccattggaattcttaactatattagacactgggatgaaaaaaccacccagaagagagttgccctctataaaacaaagtggaaggagttgtgaggagcacttggacgcaggagttgtccaatctgaatctgaatccctggctacccacatggccatggcacgttctgtaatgtccctgagcccactgtcatcttcattacaaagtgacaatgacagggctgttgagaagactagatggagtgatacgcagcacacaactaccccctgccctcacccctgctcctgatcttcttagccctagccccagggccccaactaactcagctgtcctggtaacaactcagtttgatggcataggacagaggtcagcaaacttttcctataaagtgccaaatagcaaatatttttggctttgcaggccttttagcacctgctcaactctgccattgtgacataagaagtcatagataacgtgtaaacaaataaggatagctgtgttccaataaaactttatttacaaagtagacagtgggctggatttggctcatgggccatagtttgcccgccgccatataaagaaagagacctaaatactccttatctgcaaagttagatataactgccacatatgtgctcttcctagaaacagaatcacttttttgtcaaataccatggaacatttacaaaagttgtataaatattaggccaccaaaaaagtctcaataatttttataaaaagtagaatgaatgctgattaaaatgtgataaagattctgtaaaaacaaaggcatggattgcacaaagagatgggtgccatgctgggagacaatccacttctttttaactttcaggtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattactt

SEQ ID NO: 12590 - DNA, 101982 bp, Human
  misc_feature (1)...(101982): n = A,T,C or G
aggcaacgctgaatgtgtctcaaatggagcataaaaacaaagtctcttggtaaggatgggatttagggtcaaaggaaattcccctaaggaactctaaaactgacattatcttaagttttagcacttggggaagtttcaaagactttccaaaaggataagtatatcatgatatgtaggtataaataccaagacaactgcagagttattttaatccaagtctgttgaggctttattatgtgatacagcattgtgagagttaaggtaacagaaaatgatacactttgttcttcaaacttatttggcaaatcaagggtactggaggtttataacaattagtagtgtctaagtcaagttacaccccaactataccaggaaaaagaaggacaggaaagcacacactgtgaaattttactgtgcaccaacatattttacacatcaggtgggctgttatggaaattaagaactctgcacaaaatgtattttttttaaaagttttatcaagaaaggaacattttcttctaaaaatgattagtacagctaaacaaaataaaaataataatcctatcgcacaaattaaaaataaaacctgagaagttttgatcaggcttgcctaaaacgagttgaaaccaaagccattttaagaatccaaaatatgagattagttttgttcaaaaagaattatccataaaagttaatagatgtttgcatagttaccataaaataagaggtaagcctttatgtatttttacttcataaagttgaatttctattaaaatctattacaagaaagggaaagtaactttccagtaatattcagattttttagtaatattgagcctacatttatgggacatcattttttaatgtttgtccactgaatattttaagttatgtttgtcataggaaattaaatttgcttaccattcttaacgataatctctttcctcatttggttatacttatctcaattagtataagagacttgttgatttttttaaaaattaaggacatactaaatttccccgagatagttattttgcagtaatatagataagcgactcagattaactttaaaacaaaccaccatacattccattcaatttatttttgccaggcattgttttagcggctttatacagccatgtacaaaatagacaagattccagcatcatgatgcttattttctattctaggacacaaaatagaaaaaaaaaatctcaaatagtgataagcgttttgaagaaaagtatataggacagccgggtagagaatgaccaggactaccatagctagggtggtcaaggaaggcctctcttgagtttgagttaagagctgaatgagcatggcagagagaaacagttaacgtggatactgttcaggtttctttctccctgggaccaaaatgtttcgaagtctgcatacctccgtttaccctaacttgtcatgaacataaaacctcttatattgcaggcaaaaatctgaggttcacagattagtagggcaagtagctgattccgaagtgtgtacttgcctttatgatactggatacacactggtgttaacaaggagaacgatgtacgtggcagacgttcggagagtactggacatgttggttctaatttgggtttatcctggcaggctctaggtagagaggctcagaaaacctgcgtccatccttcccatctttcctcccatttccgaaaccacggccccggtttcgagtccagaaaaaaaggaataagtagaactcccaaaggacagctttcctggctgaacaagatgtaaacagtttacgtgatgatttccaaccaagcgcaaaagtacaggtgcaaaagaagacggcagacaccaaacttcccctgcagccacgccctccccactttgggagtctgggtccccgggaaggaaggcctccctattggtgctcaacgtgttacgtcacttccgctacctccacggcaggcgtcgctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttacccggcttggccgccgccgcggcccacagatgtagctggtcctccctgtgccggctccgtctgcgatgcagggcggcggcctgtaatcccagcgaccgccagggtgagtgtcccgcgctggccgctggctccgtagaagccgaactggagggccaggctgggctcggcgcctcgcctggggcaattcgcccacttgcctttcgccaacctcagaaccttcctttctggcctccgcctttccagttcagcctgcgcagcccgcgggggtcctgacaggtctctgactctgatgccttctgcagccctagcatggcccccgcgggaacttgtgggcacctcgcgggccggattgcacctctgaagcctaccgctttgtaccaaacaaaatgttacgtgcgcatcgcggtgtcccgcggttactcacctccgcggttggaaattgcggactccgcaaagttccagggtctttggagctttccagcgcaccttcatttagcacttggttgagattttcttggccttctttttcttactctcccaacttattttcttaaattttctaaaaggaaggaggggtgctactcactacggatcttttggaagaagtacgaaagtatccgacaatcattgaatgaacccagtttgggtccgaaaaacaaagaaactcttcagttcggctgagcagtctttttggtgaaaaggtggcagttgtagtggtaacccagaaaaaaaggtggttgaagagaattttcgtctctctcaacattcttttctgactcaaatttaaatggtttgagagtttccaaaataacattgaactaatcaggcttaccttcgtttttgccgtagcttgacacacattgcttgacactgagaactgataggatctctgagggagaagacagaactaagtccacccttaacctaatccctccattcttgggatgcagagagtatttaccgaaacattcatgttcgaagccaggtgtggtggtgcgctcctgtagtccagctactcgggagactgaggcaggcagatcttttgagcccaatagttctaggctagcctgggcaacatagtgagctgtctgtaaaaacataggtttgaaaaaacctgtaacatgttcgtgacctcctgaaagaagtcggaagttgcagtcattcgagattttatgtaatataagctatagtaactatgctgtggatataaattagaatatattcgtatcttttatttgcaataaatgtaaagctgaatcttagaatttcaaacggataaattttaacagcactattcccagggcttttttggtagtgatagaaaagtgtaactgttgagtttttccatattggcaatatactgccaggttcccttatggacagaatgaatcatcggctgggtgcagtggctcatgctgctaatcctcaggaagattgtaaaccttaggacgctgaggtgggtggatcgcttcagcccaggagttccaagaccagcccgggcaacatggcaaaactgcctctctacaaaaaattagcctggtttggtgacgcgcgcctgtaatcctagcctgtactcaggaggctgaggtgggaggatcgcttgagcccaggaaattgaggctgcagtgagccttgagcatgccagtgcactccagcctgggtgacagagtgagacctgtctcaaaaaaaaaaaaagaaaagaaaaagaaaaatgaatcatacgtttatactgtactccagaatccccaagtaagtttctaacacaattgtttctattgaccaagcaattttggcattttacactgaaattacagtggctgttaaatttagtctaaactgccctttaagtgttggcaaaaaggagaagaaacagtgtaatttgtaatccctcttctgtgtagctgtcattatgttgaaaattatgtattctttgtctcatctgtctgtgaaacacagataattattacctaccttagtggtcaaaatgactttgcaaagttgtttggaatgtttattactacaaaaaattaaaattttttttacacttaaaaatgcttagtaggtttttaaaaataactttgtgaaaatttagtttcagtaatgaagcatttcttaaaagggcaaccattattatggcaaaatttaaaaatcatttagaaaaagagtactatttaaattggatgcatgtgagaagactatttgaagaacttttggagaaagaaaatctaaaaacagttgtttttatttgtctagaagtaaggtttagtttatgcttctaaaatgcctgtggctgggaaaagcttataaagcataaggagaggaggaaaccttgagggattgcttgaatacttaaaaatgaggaatgcctttaaaggcaaaatagaaactgtctaaaagaaatatgagagccctgtttgtaattttgagttgtctgatagccacattaaaaaaagtaaaattaaagatgaattaattttaatatattctagaattaattttaataacgaaatttatatattttaataataaaatatataaaatttaatactattttattaagtatattcaaaatatttcaacatgtaatcaatatcaaaattattgaagtattttacatcatctttttgtactgtctttaaaacccagtgagtattttacactttcagcacatcacagttcagactaaccacgttttaagtgctcagtaaacagtgactactcaattagatagtgtagttagagttagtatctaagttataaagaatttttacaaaccagtatacattccagtaggaaaatggacaaaggaattgaatacaaagttcataaagttgttcaagtggccaataaaaatgcaaaaatgttccatactgaaaaacagagactttaaagggttttacttctcactgcctatttcattttggccgaatttttcataatgataataccccatattgagggtgtgggaaaacaggaactctcttaactactgattgaaaacataaacggtttatgccctctgacctaacagtttttactcaaaaggatttactttaaagaaataatcaaaatacatattaaaatgtttgcagaagtttattatagtaataaattggtagttcatagttatggagagttggaaactgaaatatattatgatacctttattatgggctggtgatgtatacaaccatttttttaaaaaattataattcagggctgggtgtgttggctcatgtctgtaatcccaacactttgggaggccgaggtagggggatcacctgaggtcaggagttcgagaccagcctggccaacatggtgaaaccccatctctaccaaaaatacaaaaactagctgggcatggtggcgggcgcctgtaatcccagctacttgggagactgaggcaggagaatcacttgaacccaggaggtggaggttgcagtgagctgagattgcgccactgcactccagcctgggcgacgagcgaaactccatctcaaaagaaaaaaaaaagaagttataatttagaagaatagtgacatggaaaatactcttgtgttattaggtaaaaactgtagaaaaatacagtgaaaatatatactgtgatattaacagtgagtttgtctaaaaatttttttatttgtgttttacaaatgatctacagtacacatatacttctaaagaataaaaatgttacttagtttctgtagtaagtatatccttttttataaaaagttctttgggttaggatagagcacatatttctttttttcatgtatttataccttgcctcatttggcaaaaatttgagaggggaagacacttaagtatactagatgaacactgaaattaataaaagtgtaatttttaaatagaaaatagaaatcaaacatactatgttattattgtctccaatctgctagtatttattgtcataagaaaagtaggctgagaatttaacttttatccccagcagaggtccctcctcctcctcaacctctttaaataactaagagtattgacagttacaaaagaccagtctggccaacatcgtgaaacctcatctctactaaaaatacaaaaattagctaggcatggtggtgggcgcctgtaatgacagctactcaggaggctgaggcaggagaattgcttgaacccgtcagatgtggtctcaaaaaaaaaaaaaaaaaagaccatttagactgtcaatgctcttagttgtttaaagaggttggggaggaggagggacctctgctggggataaaagttaaattcttagtctgattaagagagcattgacagttataaaagaccatttagggctgggtgtggtggctcacacctgtaatcccagcactttgggaggccaaggtgggcggatcacctgaggtcaggagttctagaccagcctggccaacatggcaaaaacctgtctctactaaaaacacaaaaaaattagctgggcatggtggcaggcgcctgtaatcccagctacttgggaggctgaggtgggagaattgcttgaacccaggaggcagaggctgcagtgagccgagatcgtgccattgcactccagcctgggcaacaagagcaaaactccgtccccccaccaaaaaaaagaccatttaggcaggcagacaggaagattctatgcagatcaagttcatgatagaatttattgtacttaagtataaaatgaagctaactgtagtatgtgcctcctagagtttttgtgaatgagaatcattcagcattggatgccaggcattatagttgctgatagtgtagtgctgaacgaggtggatggtttccacctttcttccaccagaaataaatatatttaaagtgccatagaagagataggcaggatgatgggctagaaagtagccaggatgggctatttcattcgataagatggcctaggactccagcttttctgaggtaatgactgagcctaggcatgaaagatgaaaatgagcaagccacgtgaaggtctgggagaaagagcaatttgggaagagtaaagaggaactgtaaagatcagactagtatgtatatatgtatgtatttttgagaaagggtcttgctctgtcacccaggctagagtgcactgacaggatcacagctcaccgcagccttgacttcctgggctccagtgatcctcccacttcagccttctgagtagctgggaccacaggctagcgccaccatgcccagctaatttttatatttttgttagagactgggtttcaccatgttatccaggctggtctcaaactcctgagctcaagcattccacccatctcggcctcccaaagtgctgggattttaggtgtgagccactgcgcctggcccagacaaatagttttaaggagcagaaagaaacctgttgtgtctagggtatggtggggtggtatgaaaataaatttgagtttttttattttttgtggttttttttgagatggagttttgctcttgtttcccaggctgaaatgcaatggtggatctcggcagactgcaccctccacctcctgggttcaagcaattctcctgcctcagcctcccaagtagctgggattacaggtgttagccaccacgcctggctgatttttgtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctggcccagtcgtagtggctcatgcctgtaatcccagcaaaatttgggaggccaaggtaggtagataacttgagtccaggagtttgagaccagcctgggcaacatggcaaaatcccatctctacaaaaaaaaattaaaaaatgtagccaggtagggtggcacacgcctgcggtcccagctactcaggagtctgagatgggaaaaccacctgaggctggggaggttgaggctgcagtgaaccatgattgcaccactgccccagcctgggtgacagagcaacaccctgtctcagaaaaacacaggtgggtgcggtggctcacgcctgtagtcccagcactttgggaggccaaggagggtggattacctcaggttaggagttcaagaccagtctggcccacatggtgaaaccacatctctgctaaaaatacaaaaattagtcaggcgtggtggcacatgcctgtaatcccagctacttgggaggctgaggcaggagaatcacttgaacccgggaggtagaggttgcagtgagctgagatcacgccactgcactccagcctggatgacggagtgggactccatctcaaataaataaataaataaataaataaataaataaataaaaatgaaaaagaaaaatagaattaagcaaggcagtagagaggtatgtcaagatgcagtctaggaagttgtcatcatctcctattgtttcctaactcaaaaaaaaaaaaagattctctgttttttactctgctctggcgaaaagttacatcagcagtggtcttctagactgagctactccatccaggtcacacttttgcttgctacatgattaaggataaaaaggattttcctgtagttttggctagctgaaaggattaaagtaaaccagagatagtcaatctgttaatggtagactatattacaaattgtgatgatgatgttaataagaccttgatgaagttccagataatttagctatggacacattcttaggttttttttttattattatgggcattttttttaatacagggaaagtataaggtataaagtaaaaactatgcataattcagatatttcaccacatttttagtagttgaaatcatactgtataagtcttccgctttttttatgcaacattataacatgagtgtttttccttgttattaaaagtttttaatgaatacataataaaagtatagttacctgccgtaatttaatcattcttctattagggaacatttgagttgtttgttttttcctgtgataaataataccatgaggaatcatctttgcattctatattatgtattttaaattcacacttaataacctctttaaaaggttatataacctcttagtaacctctttaacagttatttagctttcatatattactgccttagaaattttggaaaagaattattgaaatagtctcttaagtaaggagactgaaatctagaagacaggctgcaagcttgactctggctctgaaattagccggaaataaactcacgttgcaagaaatctttttgtttatttttagttgttgttgcggaagcaacgtatacagtagactgagttgtcagtttgtgtgagagaaaaagagtgtctttttgttgttattcgtagcctaaaaatgatggccagattttctctggaagccagagtagtggtaggtgacaaaccagattggagagagagaggacaagtagtgatcactggcagtggccattaggtcactagctacagaggccatgagagtaaaataaagacggagaagtgtggctgttctgagtagactgctgataggataccagtaactctgcagtcttgaagacacagcccttatatacacagccataaggaagttcttgtccaggccagtagaatagtaagtgccagagtaaagacttcgatatgtagcttgtttagaagtcaccttgaaaaaagaatattaatggtgggtaatatttttcactatctctttgcttactggaattaatgaattcagtaattctttttttttgtttgtttttgagatggagttttacaccgtcaccctggctggaatgcaatggcgcgatcttggttcactgcaacctccgcctcccgggttcaagcgattctcctgcctcagcctcccgcatagctaggattataggcgcccaccgccacgtctggctgatttttttgtatttttagtagagatggggtttcactatgttggccaggctgatctcgaactcctgacctcgtgacctgcccagcttggcctcctaaagtgttgggattacaggcatgagccatgcaccctgcggaattcagtaattctttaaccagtggttgtgtttctattgctatgtgttaggtattatatttgttttattgagttaaatgtgcttcagtatagtttttataatatacaatattaggtggtaaatgtatgtgccattttctgtctcgtatgaatgccaaatgtgtacttttaaagttgctgttacctgaatttctactggtgttaaaaattaaggacttttcaaaacagccagcaagaaaaagctatcaaagattatgaagatagtgtcaaaagcacttaggagtcaattttaagaggcctctactggcccaaaatagaacagtttgagcattagtcaggataatgactaaactagattgaaaaatgccaagtaatgtttaaatttatgaagttgtaatgatatacacacaaattaaaaatgtgtcactattacaggaccttgggtaattaacgtattattttgagaactggtaaataaagggaaagaagcatttagtctgactttcctatatgaactacttttctgaataaccaataaatgatggatattttctctttgtagaaatattctgagtagtaaatgaaggagtaataaaattggtatcatcactttgtaaccacctaatgaataaatgattctaagcattgaagaacagtagacactatgatcacaaataaatcaaccagttactgtgtggttcctgatgaaagaactcatcaccacttaacaaagtagtgttgacctaataaaaatagcctgaagttagataaagcctttacagccattgatttatagaacatacagaagaatgggctaaacaataccataggaattcagtcagcaaaattcagcctgggaaactaccaggacaaaaattcaggacaaacaacctggctttttcaacataaaaattgcagttaaaaaaaaaaaagacattctgtagcttaaaagagacttaaaagacatctcaattagtcccaatatgtggactttatctggatctattcccatagaaactggaaaaaaattgtaacatttgtaacaactggaaatttgaaattgagaatatttgatattaaggtttttttttaatttctggtaatggtgttatggttgtgttaaagtttttgtctcttataaatacatactgaaatatttatggatgaaattatatctgagatttgcttcaaattaatattggtgcaggtagagatgagatgaaattgtccatgagttgatcattgttgaaagtaggcaatgggtacgtggcagtttattgtgctggtttttctacctttgcatacgtttgagattttctgtagcattttaaaaacaaaagagaacactgaaaaaaatctagcatcaagtcatggaaatgggtcgtcttccaaggaaggacttttaaactgtggagtaatccctctttaaacatcttagcacaaattctatgaaaatatttcatcagtgtatgaaaaaaaagttagtggcatattgtctttgtcaggtaataattacagaagatattttgaatagggctgaacagtcagaacaccagtggccaggatgaagaagatgcttttctggagtgtgtttcctatgaaaatctgctttagcccatatttactaattatttttgctagtaggcagcatattttaatgtgtaggaatcttctgctgttatatttgctttactgaccctttaaaaaatagacacaaatgaccaaaaacattataggccttcaacagtttctcaaataagtaaaagaatcagttcacatcagaaagtttttcaagaaaataagttctaggccggaaacttgagtgaatacttatgttcccttatgtcctttgtgctcttcatattattttcaacattcataataatttatgttcctgatgaattctctgagccattaagaaatggcttttctttcagaatgcatatatctgcacacacaatccatgaattaacatttttggaagatcattattaagcacttacaaaagtttcaactcttaaatgcttaaccctccatccttggaaaaacttgactatctgtaatgatgtaatttgatttcacctaaaactttacaaaatatatgaatgatatctatatagggtttttgggttctttcaaaaagaggaattatcagtactcatggtaaaaaaagagaaggagggtcacaggaaaataggaacaaatttggttttctagtacttgggtaaattgtggaatatactttccttctgtatttgagcccttcaaagctcacagtcaacccagatgaagcagctgaagtgctttgtaattagtcttctattcttcactcaattaaaattccccatttactaaggcatctcaccaaatgttgatctaattatctgattaaaaaatcggtgacagtatgaatgaatgattaatataattcacttgattgtgaaatgaaagaggaataaatctttagctagtggaagaaggacacaggataattttgtgtaggaagtcttcctgaccttccctcccagagtcctttattctgaaaagtaattatgccaacatttttttagcttgcaaccagcatgcaaaataaagagtatctactatgtactatatacctttcaaaatagctgaatagcataaatattttatttgattttttatatttttaaaaatttccaaataagtttacaagttagagaaaattagaatgttgtcactaatttttctttacaaaatggtatttcatgtgtacctagaagcagtgaaacacctctggagagggtggcttggcaattaattatgcagctaggacttggtttgaaattaaagtatatatattttttcttttagagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacaggtatgtgtaatttttttaatgtacttttttctgtatactggaatagtttgtgtaaaattatttgttccctggatgtttgatagaacttacttataatactgtctggactgatgttttctttgtgggaactattaaagcacttatttaatttctttattttttctatttctttttgactcagttttctacgaaaaactatctacttatctacttaaactaaaattttaatttattggtataaagtgtataataatgttccctgtttactcccaatagcatatgtagttatgtccttttttcattcctaatatttgtcttattttcttggctagtcttcccagaggtttgtgttttattatttttccaagtaattttttttttactttgaaccattatatgtttgtatcctatttcgtcaatttttactttttaattatagcctcctttctgcctttttttgggtttgttcagtcattattttttgttttgttttataacttcaacttttgtttagattcaggagggtacatgtgagggtttgttacatggtattttgtgtgatgatgaggtatgaggtacacgtgatctcatcacccagatagtcagcatagtaccaaatagtttttcaaccattgctgccctctctctctctccctcatctagtagtccccattgcctatttttgctatctttatgttcatgtgtacctagtgtttagctcctagttataagtgagaatatgtggtacttggttttttgttttctgtgttaatttgcttaggataatggcctctagctacatccatgttgttgcaaaggacataattcattcctttttgtggctgcatggtattccatggtgtatatgtaccatatttactttatccagtaccccattgatggacacctaggttgattctaagtctttgctattgtgaatagtgctgcaatgaacatatgagtgcatgtgtctttttggtagaataatttatttctttttgatatacactccctgatgggattggctggagttctttgagaaatctccaaactgctttccacagtggctgaactaacttacattcccaccagcagtgtattaagtattgacttttctctgcagtctcactagcatctcttgttttctggttctgtcattctgttattaattgtcagttagacacttagtttattaacccttccttcctttctgaagtagacatttaagccatgataacacatcccacagttttgatatataatatttttattatttgtaaatctaaatgtattcttatttctattgtgattcttctatgactttttagttgttaaagcatcattgtaaatttacagatagatggaatttttgtttatctttttgtatttaatgtatttcacaaaatgtggtctgtattgattcagtcttgaaatttgttgagtgtaacattttagtttagcaattggtcagtttttctaaatggttttcctgtgcttgaaaataatgtgtatttttaattgctggtgtggtgtttatacacatcaattcttatttttagttgttcagtacagatctttgtcctgttttaaaaattcattattaccaagggagatgttggagtatcacactctgatggtagatttgatggtctttttttatggttctgtaaatttttgctttttataatttgaggctgtcattagatacatacatatttagaattattacctaacactgatgaattattccctctatcattgtgcagctactgtttttctttagtgagctctccactacatttcttttggttactattttcccatcctttgattttaacttaattttgtcttaatatgatcatctctgtcttttaactggaagtttaggcagtgtgcatttactgtaatcactgatatagttaaacatatttctaccattttatcatgtttccttgtcctgttttcttaaattccttttttgcctttaattttttttcctcattccgtcatcctttctcctctattctctttctctcatttgaaagttttagactctgtgtctgtacttcaaagcctaaagttaattgataaatttactttccttctgaaaaacacaaaagctttagagtgctttaattctgatcaccgcctccaacttatgtgctatttgttggctaatattttctgtctactctgctctttctctgctataaagtatgcattgttgcttgcttagatttattcagaatctttgttagccatcttttcttatgtctgatctttctgtctgatgtacatcctatacaagttcgtttaggtgaggatcttttgtgggaaaggcacatttaagatgttactcgattgttttttggcttccactaattgttgagaagtcagatattatgcctttgtttgtatattttttctatttgacagcattttaaatttgattagctttaatttgaaagtctttttctttggtataaatggcagttttattatgaagtaactaggtatgtatttctttgtatttattctacttgagatttgttgggcttcctggatctgaggattgatatttttctacagttctggaattctacaattctcttattatcccttcatatattacatcttcccatttctgtattatctccttctggaacttcaattagaaatatgttacatcatcttatgtttttcatgtctttaaacctctctatcgtattttctatttctttacctttctggcctgcattctgtattatttcctcaggtctaccaggatcactaatttcctctttagttgcctctaatatgctggttgattatgtatgttgggtttttaacttaaatgattatattttccttttttttttctttttcttttttttttttttttgagaccaagtctcattctgttgcccaggctagaatgcagtggtgtgatcatggttcactgcagccttgacctccggggctcgacctaccttagccccctaagtagctgagaaaacaggtgtgtgctgccacgcccggctaatttatttttatattttgtagagacaaggtctccctgtgttgcccaggctggtcttgaactcctgggctcaagcaatcctcctgcctcagccttccaaagtgctgggattacaggggtgagccactataccggccatatttttcatttctagaaattgttttttaccttgcttggttggtctttaattccttggttgtattttcagacttaccttttattacattagatacgttaagcatagctattttatatttttaacagaaaattctgctatatgaaatctttttgtttctcactatatgagacttttcttcccttttttgctcttattcatgatgtcgtacctgtgttttataactgtgagttcgtcattttccatgatgtttttatatcttgaaagtatttgatgtttatctggactgaaaatgactttctgcctggaagggtttgtttttgcttttgtgtgctactctccagtagcattattgggaccacattaaattcagttctctgctttagatttacattgtgaattcagactgtgacttgtgttagggtccacttgtctgtaggattttcagaggagtatttttttcttccccactatttaacaccaaaatacagataggccagcttacttgctgttcccttctatgtgtattatttatttctagttcatagtgatcccatggctgtggctttttacctcagtgtcccctgttagactccttatcttggcagaacctagtcttattctctggtcttccatgcccgttgtagctctggaggtagaaataagctcaaagaatccaagcttcaatagaaatcgggggaaagctggctttgatatgttcatttgttctgtagagattctgctttcacttcatttttggccttttcgtatcattttttgctagactaacaatgcatttaaaaagattttgcttggggtacaataaaaggaagcattaaaggaagtcctttattcatttattcattaatttactcaagaaatatttattgagcactttttatatggcagcaaatgagaatgactcagagttgattactaaagcagaaaattaagcaaacaaatattgtattgtaacatttagccctgtattcatgtgttcagcatctgtggattcaaccaaacaaggattaaaagatttggggagaaaatggatggctgcatctgtactgaacatatacagacatttttttcttgtcattatttcctaaacaatacagtgtaacaacgatttacttagcatttgcattgaattcggtattataagtaatctagagatgatttaaagtacatgggaggatgtgcataggttatatgcaaatactgcaccattttataagatggacttgagcatccatggattttggtatctacagtgaggtcctggaaccaatccccaacaaatactgagggataaccatactgtgataggggaaattcattaatggtgctgcaggggcacataggagaggcacttaaccgagtcttgagtggttaggaaagatttccataaggaaatgatacctccttggagacatgaaagaaaagtaggtattggccaggtgtggtggctcacacctgaaattctagcactttgggagaccaagtgtgtggatcacttgagcccaggagttcgagaccagcctgagcaacgtggtgaaactctgtctctacaaaagatacaaaaattagctgggcatagtggtgtgcacctatagtcccagctactcaagaggttgaggtaggagggtcaccttagcctgagaagtcaaggttgcagtgagccatgatagtgccactgcactctagcctgggcaacagagtgagaccctgtctcaaaaaaaaaaaaaagtaggtatggatgtgtggtgaatggtggaaaaaggaggtaaaattcctggaatagtgagtagaggatttggcggtggggttggtagtgttgaaagtacaagagacgatgatccagcttccatattccttttaatttttttctactgctctcttgcttgctcactatgtttcagccaaagcagtctccctttttctcagccatgttctgagaaaatggcaagagttaagcactagtcagatcggggtcttgttcgggagtttggactttgttttgtaggtagtgggaataacagagtattattaatacaagtaggggaggtacttgatcagatttaaggttttagaaagataactagttgcaaaatgtcaaacaggttgcaaaggagggagattgaaagtagtagtacaaatgaaggtctagagtagggtaataataatgcttttttttaaaggagtagatgaccttaagagatctaggagctgaataattaggacttagtaattgaatctgggggatgaagaagagggtcaagccaagggcaatgcttggttactgtttggccagctgtctagatgatttcattgatttctaaaattaggagtaccagagctggagtatattttaatgagatgatggcttggtttgcacatctgaattataggtgcctatggaaggtcttaacagatgatgcagtgaccaataggcagttggttatccagtgaatctactagtcactgcatcgtctgttaaaatgtcacacatcaggtcgggtgcagtggctcatgcctgtaatctcagcactttgggaggccgaggcaggctgatcacgaggtcatgagatcaagaccatcctggctaagccggtgaaaccccatctctactaaaaatacaaaaaattagccgggcatggtggcacgcacctgtagtcccagctactcgggaggctgaggcaggagaatcgctcgaacccaggagggagaggttgcagtgagctgagatcgcgccactgcactccagcctgggcgacagagcaagactccatctcaaaaaacaaaagatgtcacacatcttaacacaactactatcctacttcaagatatcattatctcgtctgatttactgtggtagtattctccctgggatctctgcttccattcttgtccttctgtagttcatttttcacgtaacaagtgtggtctttttaaaaacagatcatgtcacttttttaattaaaactctccattggcttctagttacccatagaacaaagccaagactgctagaataaaattaaaatttactattctgactctcaaagttctttctagctgatctggcttccgtattcctctttattttcttctgctactctcttgcttgttcattatgtttcagccaaagcactctccttttggttcggagaaaatggcaagcttgttgttatagggcctttgctctagttgcgttctctttccaaggtgcccttctccacatggctcagcctcttctggtcattcatatctcagtttaaatgtcagctctgcatagagacattttaaaatcactcaacctaaagtagccacccagtaagtctttaatactaccctaatttaatttttggcataggtagcacttactcctgattgatgttttccatattttatttcctcatcacctacatgtttgcaagctccatgacagcatgaacctcagtgtcttgctgatagtagggacataataaatatttataagtgagtgaatgcttagagttctaacctggaactaaagatttaggagtttttacctatacatagatggaactgaagccatgggtctgtttgggacagtgcagggacagtgtttagagtgaggagagatcttctagtacaaaatcccccacatgggtgagggacaggtagaagaggagcctgcaaagcagacttgagaaggagtggctggagaaaatccagactatctggtgtcaggagaagacagtgtttgaagaataataaacatttcaagaccatttttcctttagttagatgtctttcacaggggaagattttacagattccttgagaaacctgtatacatttaatggctccttgttttcattctttttcctaagcctcatcctccctttgggtttacctatgcaatttcttctctttcttttgtggtgatggagaactgctggggtaaatattgattgagagtttgattttatgcaatgaaagaatgcagagtgtaatgagtccctaagttccagaaataagcatgtttattagaacacagttaagggaaaagaaatagtgatgaaataatataattaagggtaaaatatgttacaatgctctgcagaggtgaacacagactcaggggaaaatatttaatatggttccaccattcagaatctttcaaattgaaatccatgattaagtttcttttttctctgctgactggaataaaaatgttagtttattttcttatattagaaatacattgtttattgacagttttattttgggctcaatttttcagtacttgcttaggccacattagaccttgttagccatcagacagagtgcaagtaattgcttgattgaaagataatttgtatatttaaagatttgagattgagttttgaataattcaaatcacatgataaagtcaggaacagctcattaagaagcagagacttgctaaggaatccttaagtttttaaggagcattcagatttgttaaattttagtaaaattagttttaattttgctaatgacagcagatgtgtggcaaacagccagggtttgagcttaaaacaaatgtctagcgatattcatggatagaatgtttggttactgattgaaatcataaagattctactgcagtgatgcagtgtgagtttattaagttggtgctatgtaaaataagtattcatacatgtgtttaagccatttactagcattcttgtttgtgctgtataacactatatatttagtaacatctagacagtttgtagtgagaagaatatccagaaatatacagcttaaagcaactcattttatgtgattaagttcaataacgttgagcattgtagaaactagggttgtttctgaaacttttgacagtagatatcagttgtttggacattaggtaagttttgaaaatgtattattccacctttttcccttcactcctctctgccctgctctctgtttcccaaagctaaattgtaagaagtggatgtgtaggttctatagataaagatactttagaatttgcttgctgtgtagcgagacaaaaataaaatcataataatttaattttttaaggtcaaatgtagttactaaatagaagtgtttttaagcttatcttcaatttactagtatgacatcataacctacttaggatttggcaaacacttaaagcctttttagattttctgtacatgctttaggtaccaaaacgtactgtattttggtcaagtgaagtggctcacacctgtaatctagcactttgggaggccaaggtgaaggatcccttgaggtcaggagtttgagaccagcctgggtaacatggggagggagaccctgtctctacaaaaaataaaagaattatccaggtgtggtggcatgtgcttgtagtcccagctacttgggaggccgagacgggaggatcacttgagcccaacaggttgaggctgcagtgagccctgattgtgccactacactccagcctgggcgacacagcaagatcctgtctcaaaataaaataaaataaaataaaataaacacacacacagtatttggtcattttcctagtggttttcactgaaaaacaattgccaagaaatatactaaaacttacctgtaaaatattttgcttttatttcaaatagggctttgcttttgttagtgcttaatatattggcatttaattgcttcatataagctttgaaagaggtaactcaatggataggcagaacttctgatcacagtggtattgtgaatacatactttgaggcatgtgttctactaaccactcattggaataatagataaagtataaaaagagaaaattgaagacatagttggactaaaaaaagacatgttatatcaaagaaatggaacagaagcatctggactctgggtctgtaatctgggagtggcagctaggagtttggcttgtttggagtaatatgctacatgtgctatttgaatagcaaggtactggagtcagactcactatttgaacttatccacccacccccacagaaggagactgaaaatagctaattccagttgctacctgaggctgtgtcttacaggaagctgtaggcctagggaggcaaggagaagaccagtgtactagtccattttcatgctgctatgaggaaatacctgagcctgggtaatttatgaagaaaagaggtttaattgactcacagttccatatgactggagaggcctcatgtggcagaaggcacctcttcacagggtggcaggagagagaataagtgcaaacaggggaaatgcaagacacttataaaaccatcagatctggtgagattcactcactatcatgagaacagcatgggggaaactgctgcgtgatctgattacctcctcctggtcctgcccttgacacatggggattatggggattataattcaaggtgagatttggatggggacacagagccaaaccatatcaaccaggaactgaaacttgctgtttcctggcttagagactggattgaggggaaggaatttcaaactggcaatatgagatcaaactggcaatatgagttttgcatagaggtattagaatgaactctgagcacaagaatgtgaagaggagaatgaaaggatataccctattcagggtaagatggtgaactctaaaatttcaaaatacatgaagaatcctaatgctacgaaagccaatagaatcaataaatgtgaattaattccagttgaagctaaaataacagcttcaattgctttaaaataagtttaatgttctcaaaaggttaaatgaaggactcatattcattaaaaatgacagggaattttgaaacacaaacttgcagaaataaaaccagagcaaataattaggaaaaggagacaattagaaatcttagaaatgaaagtgtagccactaaagtaaaaatgtagtagactaaatagtcattgtcagtaggagagttagtaaattcaaattcagtctgaaggcacataggaaggcaaaaagatattccaaaaattgaaagcatttaagaacttgcagctctagcctacatttaataggtagagaaatggtgaggaatcaatatatagagatgagaatttttcagaatttgagaaaaacaggaattctcagatcagaaatatgttttgagtaccaagcaggataaataaaaagaaatctacccctgacactttgtagagacaccacagatttaaaaaccaaaacacgaaacaacccaacttaaaagctgacaaagagaaaaatcagaatactatcaacctaattgttgttctactgaagtagactttttacctgcaaaaatatgcagaaagcaaagatgggggagtgatttggaataatatccaggaaagagtaagaggaaaaataaatgctactctggaatttcatagtgatctaaataatcattgtagagtgaaggcaaaaataggaatgttatcatacatataaagatgaatgtcattttaaaaaaagcttattttctaaaattttgggaggtacatagtaggtgtatatatggagtacatgagatgttgtgatacgggcatgcaatgtgaaataagcgcatgatggagaatggggtatccatcccctcaagtatttatcctttggtttataaaccaattacattctgtaagttattttaaaatatacaattaagttattactgactatagtcaccctattgtgctatcaaatagtagatctttttctatttttttaatccattaaccatcttcatctctcaaagatgagagtcattttactaaacaacccctccacattaaaaaacaaacaaacaaaaaaaactattaaagcatgtacttctgcaagatgcagaagaaacctggagttacagaagggaaaggatgaaatatccaagagacaacaaagaacaagaaatggataaaatgtcctggtaaaactattgataataaaacagtaaacttttttttaatattaaatgctaaaactataatcaaccaggctcagtggctgaggcctgatactataaccaggctcagtgactcaggcctgtactctgagcactttgagaagctgaggtgggaggatcacttgagcccaggagtttgagaccagtctgggcaacatagtgagacttcatctctacaaaaaatttaaaaattaactttgatgtgatagtgttcacctctggtcccagctactagagaagctgaggtgggatcacttgagcccaggagttggaggtggcagtgagctatgatctcaccactgcactacagcctgggtgacatagcaagatcctgactcctaaaaaaataataataatagtatgatggaagacatttagatcactatgaaattctagagtaacatttatttttcgtcttactctttctcagatactactgcaaatcaccccctacccacctttgctttctgggcaacaagaaaaaaactgtggaggaatattaccagatttcaaattatactacagggctttaataatctaaacagcataggtttaggttactaaacctaaatcctttatgctgttttactgttataaagacagacacataaaccaatggaacagaatacagagcccataagtgaatccatagatatacagtgagctcattttcaacagatgtgccaaaaacatacattggggaaaggactgtctattcagtaaatagtgctggggaaaactggatatccatatgcagaagcatgaaactagaccccttctctcgccatttacaaaaatcaaatcaaaatggagtaaagactgaaatctaagacctcaaatgatgaaactatttaaagaaaacattggggaaactctccaggatattggactgggcagatttcttgagttagatcccacaagcacaggcaaccagagcaaaaatggacaaatgggatcacattaagttaaaaggcttctgcacaacaaaggaaacagtcaacaaaatgaagagacaacccataaaatgggagaaagtatttgcaaactattgatctcaccagaatatataagaagcttaaataactctatgggggaaaaatctaataatctgattaaaatgtggacaaaatatctcaagagacgttttcaaaagaagacatgcaagtggcaaaaaaaggtgtatgaaaaagtgcttaacatcattgatcatcagagaagtgcaaatcaaaactataataagatatcatctcactccagttcaaaaggcttttatccaaaagacaggcaataacaaatgctagtgaacatgtggagaaaagggaacccttgtacattgttggtgggaatgtaaattagtgcagctactatgaagaacaatttggaggaccctcaaaaaaccaaaaatagaactaccagcaatcccactgctaggtatattcccaaaagaaaggaaaacatacaaaaaaattagctgggtgtggtggcatgtgcctgtagtcccagctactcgggaggctgaggcaggagaattgcttgaacccaggaggcggaggttgcagtgagctgagatcgtgccgctgcactccagcctggcgacagagcgagactccgtcgcaaaaaaaaaaaaaaggaaatcggtatatcagaagagctatctgcattcccatgtttattgcagcactgttcacaatagccaaggtttggaagcaagctaagtgtccatcagcaaatgaatggataaagaagatatggtctatatatacaatggagtattatttaagcataaaaaagaatgagatcctgtcatttgcagcaatacggatggaactggaggttgttacgttaagtgaaataaggcaggcacagaaagaaaaacagcacgttctcacttatttatggagctaaaattaaaacaagtaaattcatggagagagagagagtagaatgatggttactaggggctgggaagaatagtgggaggtggagagtgaggatggttaatgggtacaaaactgcagttagatagaatgaataagagctagtatttgatagcacaacagggtgactacagtcagcgataatttattgtacatttaaaaataactaaaagagtataattgggttctttgtaacacaaacgataaatatttgagatgatcgatgctccatttaccctgatatgattattacactttgtatgcctgtttcaaaatacctcatgtaccccataaatgtttaatgtgtacccataaaaaattaaaatataaaagcaaatttaaacaaaaacccaaaaaataataaaaagttttttttaaagaaaaataatgttaaacaatagaaatacagtcttataaattccaaatagcaattgggggattggatgggaggcgaatatagaaaactttttcaatctaagagatggagacggcaggaaaagcgaaataaaaataaaagcaaagaaaacaagatggtaaactgaaaacaataagatggcagaagtacaaatgtaccacagttaagtagtcagacttagtggtgttccgtatcatttaaatgaactcataatctaaatatgtggaattagttaatttctgtttcattccatgttttcagagacttatattctggatcccctactaccccatctgctcaaggactttgcttttgggattatcctgttagcctactttatattttcttcgtggttattgcatcattcctatctctatgtaaaatgcagtcaacctttccttgattcattctcttcagctcctgctgaaagtccaaataccgcttccatttaatctcctattttctcctcaactattgtgtccattcccattcttgtccagaaactgctgttttcaggaggttccagtgatcttcatgttggtaatctagtatctattcttttttttaccacctagaaaaatacacaaatacctacacataaaattaaatattgttctaaacacaggcaatacaggaaggtggttaagagtgtagagtaatcaaaataactgtgcctccatgtttaaaatactagctgcgtgactttgggagaatttacaaaacctttctatgccccagtttcctcataacaaggaaaactggctctgtgactttgggggaagttataataatctctgtgcctcagttttctcataagatgaagataatagtattttcctcagagcaattttgtgacaattaaatgaaataatttgtaaagtgcataggacagtacatggcacatgttaaatgcttagtatatatagccattcttcataaactctgaaatgttattgaatgaggatataaatataatggaaaatgttttaagggtgagatttttacaatatatttgatacatacaaaaggatattataatacatatgtaagttaacaacataataaaatcaaaccttggaatttactactcaagctaagaacttcactgtcttgatcacatcctcctatctccatttgtcctatgtatccatgtgaaaaaaaagaggaaatagctttatacatttgtatatagccctgattatttacttttgcttgtttgtgaacttcgttgtgatagcttattgtatatattcttttgtgatttacttttttcattaaatttagttgctaagatttatcttattgattggtgtgtgtgtctgattcattaatgttcttggagataattatagcacatactgttcagggatgttgtatgagttaaatgagttgatacatgcttagagtagtacttagcacacagtaaaagctcaaagaaagatggccattattatgtttgttactatgcactgctgtatgaaatgttgtgtgaatataacatggtctatctgtctatctatctatctatctgttctcttgctaatgggcatttgggttgttgccagtttacaacaacagaacagagtcctgctctgaacactcatgtacctctgtccttgtgccctcatgcaagagtttcttgaagccaaatatattgacctagaagaattgctgggtcataaattatgcttgtgttcaactatagtagataatgccaacttgtttaccaaggtattgtgcccatttatatttccaccagcagtgtatgcattttcattgttccatacccttgccaacattaggtattctcatattttcctttttcttgatctgatggttataaaatagcatcttatgatttcatttggattctattaataatggggcagacattttttcaaatgtttattggttatttgtatatccttttctgtgcaagattgtccttcctattttttctaatggattgtcatttttttgatctagaggacttatttaaatattcttgattacttttgttgattctatttgttggaaatatcttctctcagtttgcggcctttcttttttctctgtttttttttttatgggattacttgatgaacagtttttctgagttttaatttggcagaaatttatccagtttttcttgtgttgtttatatcttgtttaagaaatctttctgtaccataaaagtattctgtattatctactataaggcatgtaaataccttaacatttaaataattaattaatctacctgtaattgttttttctttatggtgggaggtagattcaaattttttaaatttaatgtgttttttggtaggtgtagggttgtacagttgtcccagtcccacttaataatcattctttattgattgaatggtatctctggtacagttttaaatagaagaactgtgcattcttttgttccttaatttaaaaatgcatttaaacattcaccattaaagacaatgtttgttgtaggtttgttttaccctttaaagaaattcctatttgtcctaattttctaaaagggtttgagatttgcatggatgttgaattgtattaaatgctttttctttagcttctgaaatgattgtatagtttctcttctttaatctgttaatgagataaatagcttttgtaatgtttaactactcttacattcttaagatgaatccaacatggtctgatacattgtcgtttttatgcattgctatattacattggctaatattaattaagtttatagatttatgaaagcagttgtttaatgtaaacttcttttaataaactttacagcagaaggtataggcgcagaactcaaagctccacttaagcaagaacctctccaagtaagaggtaaatatattttatcctatttttgtattataaagatgttttgaattaaatatataacattggtttatgtagagctctttatagttatattattctaagagtatagtttattttttacttttatttaaatagattgaccataaggatttattctcttacgtataaactaattttctattaaatttattttgcatttttgtcacaaattttttcaaaagcccaagaaaggaataatggcaaataagaatcatcaattgcattatcatttttagaagagtaaggcaattaaagaacaagaggcccacacttttcagctactgcttattcaaatccaggtagagtttggccgttattgtctgactttattttctaggagaaattgaaggaattcctgtttgtagctctcttctgtataacaagctgtggttcccatctccaaagcagctgtttcatggaggcagcaactctatgattaacagcactgtggctttggcatcagataaaactggattaaatttgtggctccagtgcttaccagctggctgaccttgggcaatttacttgacttctctgaggcttagttttctcccctataacgtggtgctgaaaatgagacttcttttctagggtaactttgattaacacatggtagacaattaataacaattaatgttgttatagcagccatcattatcattatcatcctcaccttcatcattaataacctgggccagggttttttagctatttggaagaaatttttttaaaaattttttaaaaatttaaaaggcggtttagagacatgaaactcacgcaaaaaaaaaatctgtatttccttatattttttttcagataaggttttgattttttaattgaactttatttttcaaatattcttattacataatatttgtgcatttaatgtaagtatgtattattttaggaatctttttacccactgtagtgataggtaatcttaggctgaatttgctctttcaacttggaagtagaacagaaaattgtgaaataataaatatgagaatagaacatgaagtgaatagatgacaattcgaaatagaacacataagtttgttattttgctcttgcacttcaggtatttgcttatttatctctatcatatgaccaaaagtctcaccttataatgatttattaacatagaccaatgttctgtaatttttaactcacagactataattgatgccaaattggtattggtattggtgtcgctggcctttttatgagcagtttgatacttgacaatagaaaaacaatttattagaaggcaatatttaacctataatctgtaataattttttttgtaatttttaactgatgaaattattctgtacttttcttcagttttattacattatgtgaaatggtctagtggctttaaacttttttgactgtaacccacataagaaatactaattagcaactagtatacacatagattagtatatgtaaatgaaacaaaggttttcacaaaaaaataattatatgtagtagtctttgattactttatatttctactttgtatgaaatgctgatttcacctcacagtttgaaaagcactcaactactctgttattttatttatttatttatttattattttttttggacagagtctgactttgtagcccaggctggagtgcagtggcatgatctggctcactgcaacctctgcctcccaagttcaagtggttctcatgcctcagcctcctgagaagctgggattacaggcacccaccaccacacctggccaattttttgtattttttttttagtagagacagggtttcaccatgttggccaggctggtctcaaactcttgacctcaagtgatccacctgccttggcctcccaatactctgtaattttttatcaaaacttcagttcattttcatttagaccctaagcaatttaaattataccaatatgatttagacagaccagtaatacctgttcaaggtgttcattagacaaaggttgacattttgggatcagttatagatgacatatagagacaaaagctagatggctacaaatgcaatttcatcctattctgcacttggataattttttctctgatgtcattcagtgaaaaagatcagttttctgtgaaattcattagtgaagcctcttaagtatcagcctatattcatcttcacatgtgactttcaatgtgcatatttattatgttttcctgttttttgtttagttaaagcagtccttaagaaaagggagtatggatcaaagtacactcagaataatttcatcactggagtcagagcgataaatgagttctgcctcaaatccaggtaatttttttaaaaaatgtagccgtgtgtcatatctaaataatctaaataactattcctttcttagagtgtgttacctgctaccatccatatatggaaaatttgctactggctccttaaaatgaagagatatttttattcagtcaaaaatgttaaaaattgttagcaaactaaactgaatcctgccccagcattagcaattctagtctttcttagtttcttaaacccacaatggtaaattcttcaaaacctttccatcacacaagaatcttaggagttaaattgttaagtcattggtatgtgacagaattctcaataagattatttgcgtatttgtatgtttgactgttttggttttttggccagcagagttgagtacttaatttagtgagttaaatttatgttcatgctcccaactgtgatttctgttgagtataaattatttttactactttccaatatctgttattattaattttctcatatttatatttattgaaattatgttagtcacagatttaaacttttctccctcctttgtgcacgaattagagaaatcagatgatctatctttttttcagtcttcctcattgtcacagccactttggtatatatcaagaaataggtattcctataatttttaacttttataactattacatcaacaaccaattataatattgatttagttctgacacaaattttgtgaattaagtggattaggcattgctgtctccactttaatagaccaggatgagcataatacaagatgttagtgattgacccagctcatttaagtgagtcagtgacagggagaactagaatatatatcttttgaaagctgatccatacatttttactaacatgtgatggttattgatgttttttaaatctaggtttaatttctagaacttgataacattacatagtcacagactttttatttatagattgtttcattgctttaacaaaatttccataggaagatccatgattaaatatagaatgactatttagcagtgacttgatgaatatataagcctttcagaatttaagagaaaggaaaataaataacatgtaattgacacaaactctttatgacatcattcctttgaatggatattaccacttagtattaatctacatataaacaaataatgactgtaaatttttaacttaaattcttaagtagagggatgatattctaatccatgttctttcttcttttcgttttttttgtttgtttttttttgagacagggtctcactctgctgcccaggctggagtgcagtggcacaatcatggcttactgcagcctctacctccctaggctccagtgattcttccacctcagcctcctgagtaactgggactacggctgtgcgccaccacgcctggctaattttttgtattttttgtagagacggggttttgcaggttgcacagtctagtctcgaactcctgacatcaagtgatccacccacctcagcctcccaaagtgctgggattacaggtgtgagctaccgcaccttgcttatttttcactttttttttttttttttttgctttatctcctaggccaaagtacagtggcgtgatcttggctcactgtaacctctgcctcccgggttcaagtgattcttctgcctcagcctcctgagtagctgggattacaggcaggcaccaccacacccagctaatttttgtatttttttttagtagagacagggtttcaccatgttgaccaggctggtctcgaactcctgaccacccacctcggcctcccaaagcgnnnnnnnnnnnnnnnnnnnnatataaacaaataatgactgtaaatttttaacttaaattcttaagtagagggatgatattctaatccatgttctttcttcttttcgttttttttgtttgtttttttttgagacagggtctcactctgctgcccaggctggagtgcagtggcacaatcatggcttactgcagcctctacctccctaggctccagtgattcttccacctcagcctcctgagtaactgggactatggctgtgcgccaccacgcctggctaatttttttttttttttttttttttttttttgagacggagtctcgctctgttgcccaggccggactgcggactgcagtggcacaatctcggctcactgcaagctccgcttcccgggttcacgccattctcctgcctcagcctcccgagtagctgggactacaggcgcccgccaccacgcccggctaatttttgtatttttagtagagacagggttttgcaggttgcacagtctagtctcgaactcctgacatcaagtgatccacccacctcagcctcccaaagtgctgggattacaggtgtgagctaccgcaccttgcttatttttcactttttttttttttttttttgctttatctcctaggccaaagtacagtggcgtgatcttggctcactgtaacctctgcctcccgggttcaagtgattcttctgcctcagcctcctgagtagctgggattacaggcaggcaccaccacacccagctaatttttgtatttttttttagtagagacagggtttcaccatgttgaccaggctggtctcgaactcctgaccacccacctcggcctcccaaagcgctgggagtgagccaccacgcattacctaacttttcacttttttccccatatattagagatggcagtggtgtgcccatagcagatacaaatacaagtactggtgagggaagtgaatctctacatattatattgtggtgtctacactgagcatcaagagtaattttttttcactgtctctattttttgtatacaaaatgtcatctttaaactgatctttaaaagccattcacatcaatatttctctaagatggggatcagtgttgttgcttttatctgcccttagtaatcctctttaagtatataaactatatgcactttgtctgaataaattcaacatgtttctttctctagtgatctagaacaacttcgaaaaatcagacgacgaagtccccatgaagatactgagtcttttactgtatacttgagatcagatgtggaagcaaagtaagaacatagttctttcagaataaaagtgcaagccaaattttggattaataaaaatacattttagacagagtcagaattttttaaatgactttttaaaagcaatatttttgtatttgcaaatctgtttatttgtgagttactaatatgtactccttaactaaatatatgtcataatgtgtaagaaaatttgctgttgaatttactctagttgtttagatttcatttggaaaagttcctaagtcctttatgtttctccgaaagcaccttacactttgttgtaagattctcattagagaatttagatttaaatgtgatgtcaataaagtcattaaaattgttcattgtggtgaccatgtgtgtatgcacagatctttggaagtttggggaagccctgaagctcttgccagagagaaaaaattgcgtaaggaagcagaaatagaatacagagaaagtaagtatattcaatttaaagtcaagttaattgaaaaataacttgtagatgagaactgtatctgtaagaactctctagtgctagcatacctgttggcctaggctctgttgcttccagcaaatgctagtttccgttttgggattcaattatttcacaaaaacaggaactgtatttttgttttctcctgtatagctttttgaagatgatgagaggaagagaagctacagtttatcatttttataagacatataactatcaaaacttatctgatttaaagattatacttgttataaaagtgatagaataggaagtaattgctgtattagtctgttttcacactgctataaagatactacccaagactgggtagtttataaacaaaggagatttaactgactcacagttccgcatggctggagaggcctcaggaagcatacaatcatggcgcaaggggaagcaggcgcatcttaacatggtgtcaggcgagagacagcgtgtgtgtaggaggaactgtcaaacacttataaaaccatcagatctcgagaactcagtatcatgagaacagtatgggggagaccatccccatgatccagtcacctcctaccatggcctgtcctcggcacatggggattatggctattataattcgagatgagatttgggtggggacacagagccaaatcatatcaattacttttttacagaagggtctattaactcagctacattaattaattcagcagatatttatccgatacccgctatgaacaagaagctgtgcttggtgtttgaaatgtatatgcaagtaagactcttaggagccaggtgtggtggcacatgtttatagtcccagctacttgcctgtaatcccagctactcaggaggctgaggtgggaggatcacttgagcccaggagtttgagaccaccctgggcaacatagacataaatggggtgataccatacatattgtacatcttgctctttatagatagtggtataatcataaccgttttccatatctacatatagaaatctacctcattctttttaacagttgtatagtaccccattgtatggatgtagcaagatttatgttcttcagtttttcactgttagaaagaatacatcaataaatatttttatttttttaacgtgagataattgtgaatatttacataggattgagtgttaataatacaattttaggatcaaatggcataggcatttaaaaatttgatagatcctaaagaattactctctgaaggaaatatggtaccaatttacatttacaatcacagtgtatgagggagactattttttcatacccttgcccatgctggatattaacaagattttaacttttttgtgtatttgatgggcaacagatggtacctcgtttaattttgaatatctctgactactactgaggttatcttctatgtatagtggtttttcttagttcttctgtaataatttttatatgttttgttcacttttctattagattgtgtgtctcttaaaattgatttaaataagtttttggtggattttaaccaaaatctaaccaagttagtttcatatgttctaaatattttctaacagtctatcttgaaatttggtttctcctctttttagtagggaaatttcaaacatattcagaagtgcagagaaaaacataataaccttttaatgcccatcatctggctttacagctaccaacacatggccagccttgtttaatgtatatccctctcactaaccttcactctactggattactttgaaaccaggtccagacattatatcattttatttataaatattccagtatatattaaaaggtcaggatgtttgttttagtcagttcatgtgatggtgatggttgaactgttttagaaaagttaactatccattgcctgtagtaagctgtcagtcttagtaatcctctcatttgccctttggttgaaggtctaggatgttctcaaatagctttaattctgacaaagaaagtgattgaccttctgttgatgattccttttctagacaaaactgaaaatagtatgtctcttttcagctaacctagtcaggaggaataaggagtatatttgtgtgacctggaatatataatattaaatcatctagttgttgaataagtatagttttccttgtaaaatccaagttctttaaatcattggtttggcattttcaaaagtttgaaggagacagtgaatcctagtatcaaaggatttttggcctcagaaaaagttgttgattatttttattttattttatttttcgagacagagtcttgctgtgtcacccaggctggagtgcagtggtgcaatctcagctcactgtaagctctgccttccgggttcatgccattctcctgcctcagcctcccaagtagctaggactacaggcacccgccaccgcgcccaactaattttttgtatttttagtagagacagggtttcaccgtggtctcgatctcctgacctcgtcatccgcccacctcagcctcccaaagtgctgggattacaggcgtgagccactgcacctggcgattatctgtttttttttaagagatgaggtctcactatgttgcccaggctggaatacagtggctattctcaggtgcaatcatagtgaattatagccttgaactcctgggctcaagtgatcctcctgcctcagcttcctgagtagccaggactacaggtgtgtgccaccgtgtctagctgacaatccacagatattataaagagggcggcacttaaattaacagaagtgaagtatttactttcaatggaagaaatacatactggggacggatagtcctggaaattctggtgtactattcagttaatggtttccattgagtttctttataggtaatacaggtactaacacaggatgcaatcagatagggcatattccattggggaattagatattgccagtgcagttatatagttcttttactcttgggcacttatatatggtaatgtatcaggattaaagtagagatcgatgtactagtatttatgaaaaatgtatacatatttttctttgataatcaggctgactttattgttatctgttaaacgactaacagattttattaagcatcgtgaggtttctcagaagaatatcattgctgctattccctttctggtttgatagaacaatttattttttagtgttcctacttcttatcaatgacactgatttttattagtattagaaagggactgcacttgcttagggtttgagaagttaataaattttgccttgtatggctgttaaaagccctaagtttgttcctttttttttttttcatcttctcttttggtttcttgacagtgcattgcaatttagtttttccaatgtgaactaactgccagttcattttaatctttcttaccaccctatttttaatttaaggccctttaaccaaagagagcataaagggtcccttggcattctacatcagggtcagtgtccacaaattgtttatttctagaagtctaattctaaatttacctattaattctgtggggttttttttgtttatagttttggatcttagtgtaatcaattttaatagaggatggcttcctggatagcttacaacaacctatgtccctggctcttaataaataacttttgccggtgttacggcatctgtcttcagtagccagagttggctaactatggcccgtggaacaaattggtctgctgcctgtttttgtatagtttataagccaagagtggttttcatatttttaatgactgacaaaaaagcaaaagagtaacaatattttgtgacagatgaaaattaaatgaaatttaaatttcagagtccacaaataaaattttattgggacgtagccatgatcttttatttacatattgtctgtggctgcctttgcactaccaacagcagagttgagtagctccgacagagaccgcgtgtggtgctcctgtcactttgcactgctactcagttacaattcagtaacagttataattcaacagtatttcaaatgtcataggtatccttgtacatgacctttttttttttttagtatgagtgcatacctgtctggtgagtaagaaaagtagacatctagtgttgtgcttttaagtcacagttgagcatggattattttttattgaattagatggcaaagtactgtgtctactatgcagtgacaccatagctgagttaaaggaatacaatatatgttgacattactagattaatcaatcatcacagtattcccaactcacaggagtgtaacaatcagaaaaactagagaatttaagatggaatatattacagcagaatttgttcacaaaaatagaaaatgaaaatgaggctgcaaccaaagtttggtttctgagtggcttattagtcaagcaaagaaagtgggtttctaatggcaagtaaattaagtcctgtttaatttaagcagctgaagaaatgtatccaggactagtagtctttaggcaagactagttgcttcaagagttgaggacactgaggacagacatcagtagtcaattaaaaagcaaggcaaattattttgaatgatgttccttggctcttgataagttgacctgtgtaccaatactatttgaggagtgagtgctgagtttgaagagactggagaattaccctttgtgaatagtgtatgtggaacaaccacaggcaagaatttattttattttattttatttttgagacggagtctcactctgtcaccaggctggagtacagtggcatgatctcagcacactgcaacctccgcctcctgggttcaagtgattctcctgcctcagcctcccgagtagttgggattacaggtgcgtgctaccatgcccggctaattttttttgtatttttagtagagatggggtttcaccatgttagccaggatggtctccatctcctgatcttgtgatcctccctccttgtcctctcaaagtgctgggattataggcatgagccactgcgcccagccacgtgagaatattttcaaagaaaatgtgaaaatactaattcagtaaacctgatgtggaatctgctaagatgtcttatatagatgatggtggtaaaaatacatgtggagcagaaaaagccttagttggacaaatttataaagtttgtgaaaacataagatatttaaagccttttcatcagtagatacttcccagaaaatatttgtcatgagtaggaactttgtggaaaatgcttaaatcttgtttgctgttgaaccaatagtatcacctttgaacttgtggacttaaccactgaaagaaatagaagctgataatcctgacttgtccttctacactgcatttcagtggtttagcagttttactgccattttttgagctcaggattgaaaaattcaaaatggaaatttttctgaataagaagacccacctgtcaaccactattatcaaacactgagtggcttagaaaattaggttttgctgcagacgttatttttcttaatgcattcagtgtaaaattacaggggaaaacagtgcttatatacaaaacttactctgctgtgaagtcatttcaacagtagatacattatttgaatcaaagtaatgtcagtcagctttatgtacttcccatgctgttaaaagtttaacacaagcactcagatccgcagtggcagtggtgtgtcctgtctgcggagagccaggccagagacaatgagcaacacctcagagaacacgagggcgtgccgcgaagccgcccacccttccgactgcggcagctgctgacctgctgttgccatgacctgcaggaaagccaatgaggagggcagttggaagaaattcttctggaactcagagaagaaggagtttttaggcaggaccggtggcagttggtttaagatcattctattctacataatattttatggctgcctgactggcatcttcatcggaatgatccaagtggtgctgctcaccatcagtgaatttaaacccacatatcagaaccgcatatcaggaccccaccaggattaacacagattactcagatccagcagactgaaattgcctttcatcctaatgatcccaagcactgtgaggcatatgtgctgaacgtagttaggttcctggaaaagtacaaagattcagcccagaaggatgacatgatttttgaaaattgtgacaatgtgcccagtgaacccaaagaacgaggagactttaatcaagaatgaggtgagcgaaaggtctgcagattcaagcttgagtggctgggaaattgctctggattaaatgacaaaacttacagctacgaagagggcaaaccacatgttattataaagctcaagtgagttctaggcttcaaacctaagtctcccgagaatgagtccttggagacttacccagtgatgaagtataacgcatctgtgtttcctgttcagtgcactggctagcaagatgaagataaggataaaaatagaaatgtggagtattttggactgggcacctaccttggttttcctctgcagaattatccctactatggcaaactcctgcagcccaaatacctgcagcctctgcttgctgtacagttcaccagccttaccatggacactgaaattcgcctagtgtaaagcagatggtgagaacattgggcacagtgagaaagatggttttcagggatcctttgatgtaaaaattgaagttaagagctgatcacaagcacaaatctttcccgctagccatttaataagtttaaaaaaagatacaaaagcctgttagtcttgaacaaactgtcatatgtatgggacctacacttaaagcataatctatatgctttacacttgctttctgcatttaattggttagaatgtaattaatgtaaactaaagtgtagcaatagcaacaaaatattctactgtaaatgacaaaagaaaaattgagccttgggatgtgctcatttttactgtaaattatgattccataagtgacttgtaagcagtgtttctggcccctaagtattgcctcctatattttatttaatgtatagtactataggtgcatactctggtcctttttcaagccatgtgttatcgtatctgttttgtactttatgtgagcaggttttgctgtccaaggtgtaaatattcaatgggaatgaaactggcatggtctttttttttttttggggggggctctttcaaagataatggcccatcaatgagcatctttaacatattctatagtcttttcctgtggtgttaggtcttactttattattattttttctcctgggaatgggacagggatttgtcatgggggaactgccctttaaattttaagtgacactacagaaaaacacaaaaaggtgatgggttgtgttgtgcttgttttgaatgctgtcttgacatctcttcccttgtcctctagtatgttctaaagctgtgtctgagatctggatttgcccatcactttggctagtgacaggcctaataaatttgctttgtacattttcttttactttccttttttcctttctggaggcatcatgctgatggtgtgtctttatgagtgttttaaccattttcatggtggaagaattttttatttatgcagttgtacagttttatttttttctgcaagaaaaagtgtagtgtatgaaataaaccacagtcacttgtttgaaaataaatctttattttgaactttatacaaagcaatgcagtaccccatagactggtgtaaaatgttttctactatgcaaagtccatgttctaataattgccaggagtacagtgctcttgttgatcatgtattcagtcaagttaaaacaatggacaataaaagaatgaatacatgaaaaaaaaaaaacagaagacatctgcagcagatatattttccaagcccaacctatagttccagaagtgtttttcagatttccatgcaagtgcagaggaaatttacatatttcaaaatccattaaatagtgtagttgagcagctttctcctgacttcaattggaagtgattagtcgtcaatgtaagaagatgctaaaaggcaaatatcaacaagaatttcatagaattctataaatgctttcaaagcaatgaatatagttatttaaaattatgtttatagatttatatcagcatttggcagtacctatctgtaagattttgaatatgaaatagtaacatatcagatcatcatcaatagatgaacatttacaattaattttgatgataaggaatactaactgaatcccaattaagtgaaatattttatcctatccccccaaaaagaattctgttcttctcattagtagacctgtattacaaagaattgcactcacatatttttattatattttaaattttgtcaaaaaatttcatggaaatttgtagttatttcttgctataccttcatcatgtcctttatattacctcttggcctccaaagcatgaaatatttgctatctagctgtttagtcagttctcgtattgctataaagaaatacctgagactgggtgatttataaagaaaagaggtttaattagctcacagttctgcaggctgtatagaaagcatagaagcttctggggagcctcaggaagcttccagtcttggcggaaggcaaagatggaacaggtatcttacatagcaggagcaagagagagatgggggaggtgcctcacacttttaaatgaccagatctcatgagaacgaactcaccagtcgtgaggacagtaccaagagggatattgctaaatcattcatgagaattcacccccatgacccagttacccccccaccaggccccacctccaacaattggatttcaatttgacatgagatttggatggggacacaggtccaaaccatgtcaccagccctcttcgaaaaaagtttgccaaccctatttcaatggtttcgttaggattccaccccattttatttatttttgttattagtaacctggaaagaagctatgaaactggaaggatgtaactagaagccttggagtataaatatttaggaggattctaaattatttgactatctcagttctgcacaggaccaaggcttagaaatgacaatatttccttctccagatgagttggcaaaatttcaaagtggaaattgtgagacaattatggtcaataacccaggaagaaaagggatggagggagtttcttgagagtataggagttcattaccaggaggggagcagtgggataggaagatcaaggaagagggaagagggagaagaagatatgcaaggaaagaacaaagtagcagtgctcaaactgtcctaatgttggtcaatggaagcacctcagttggctcctaagtccctttgtcataactctagtatcatggcgtccttactttcaggaataatatgtttcagattcatcttgtacgtttcctgtcctgggttggtaatcaactatttctaaaaggagccacttttctttttactggaaaataaaatcaagttaaagtaattacatacttgatttattctatgtctctacacacatagagaataaagtgtagtttcaaatagcagtattaatactaacaatgtaatttaagatttctttgcttttctttgtatctttagtatatatatcccactagagatgtatagttcaatttctgtgtgttaaagtcacttaaaatttttctatatagaaatatcatcagtagatatacagttaggctcatttgtttcattttgcttctgatttttaaaaataattttgattttattttataattgcctaaaaatttacatgatttcttagtcaaacctacagaacagatatttcagagaactctagcttccatctctgtcctttccactctaagtcctctctcttgtataagtaactgttttaaagtttttgggttttttttttaatacttaaaatataagaaaataaagccaggctccatggctcatgcctataatcccgggactttgggaggctgaggtgggaggatcacttgagaccaggagtttgagaccagcctgggcaacattagcgagaccattttccttaccaaaaatttaaaaataaaaataatattttttaaaaaaacgtacacatttgtattaaacgccatacccttcataaataaggcatactatacatactttctgctcttgctttttttttgaggcggagtctcgctctgtggcccaggctggagtgcagtggcacgatcttggctcactgcaacctccgcctcctgggttcaagcaattctcctgcctcaacttctcaagtagctgggactataggcacatgccaccatgcctggctaattttttgtatttttagtagagacggggtttcaccatgttagccaggatggtctcgatgatctgaccttgtgatccacccgccttggcctcccaaagtgctgggattacaggcatgagccaccgtgcccggctgctcttgctttttttacttaactctgtcatgaggactatgctatagcggtaaatagagacatttcttcatttattttataatactctgttttttgatataccgtaatgtattcaatcattcccccataggacgtttctagtgttttgctattaaaacgataccatgagaagccttgtaaataaaagttaaaagaattttttgtaatacaaaaatactctctcatatttttcaactttgaggtaaaaatgaaggacttgtttttgtatcaggcttagttaacttttataaaggtaatattgagaaaagaatcttaccaaactgtctttatctcattgcaaatccagattttcctgcctccttttttattgtaaaaaacacatagcccaaaatttaccatcttaaccatttttaaaggtacagttcataagtgtgtaagtatattcacattgttgtgaaacagatcttcagaggtttttcatattgcaaaactgaaacactatacccattaaataactaccccccatttccctgccaccccccgtccctggcaaccaccattctgctttttgtttctattaatttgaatactttagatacctcatataagtggagtcatacagtgtatgtccttttgagatgggcttatttcacttagcatagtgtcgtcaaggtttatccatgttgttgcatgtgacaggatttcctttttcaaggttaaataatactccatcatcatatgtatataccacattttgtttatccattcattcatccatccacggacatttgggttgcttcacctcttgactgttgtgagtactgctgctatgaacatgggcatgtaaatagctttttgaggccccacttgctattctttggacgtatgtccagaagtaggattgctggattatatggtaattctatgttacaattttttttaggaaccttcatatttttttccataacaattgcaccattttacattcctaccatcagtgcaaaaaggttccagttttgacacattgccaatccttgttattttctgtttcttgtttttttaatagtagccatcctaatggatgtgaggtggtatctcattgtggttttcatatgtatttctctgatgattagtgatgttgagtatctttccatatgcttgttggtggtttctatataatctttggagaaatgtctattgaaatcctctccccattttttaatcagtttacaaatccaaattttttataacttaatatttttgctgttagctagtagcgcatatttaacatagtcctgaagagaatatcatgttcatctaaactgtgactggtaagaatatctatgacctaaatttattttgttattcttacagggctatttagaaaccaaaaaatattaagagaatacagagatttcttgggaaataccaaggtatggatatctttgtaataatgtgtgtgtttgtgttgcacagcaaaattctaatatcagtccattgtaaaattctagcatgtctgtgatctcaatctaagattttcttgagtacattgtagttcactgaattatagtcaattcattcatttccgtctgattttcctttttttttttttttgagacagagttttgctcttgttgcccaggctggagtgcagtagtgtaatctcggctcactgcaatctccgcctcccaggtttgagcaattctcctgcctcagcctcccgagcagctgggaccacaggcatgccaccatgcccagttaatttttgtgtttttagtagagacagagtttcaccatgttggctaggcgggtcttgaactcctgacctcaggtgatgcgcctgcctcggcctcccaaagtgttgggattacaagcgtgagccaccgtgcccggcctgattttcttgaaatttaaaacatttgtacataagttttctttaaagtcataaccatgttatgaaccttaagcatgtagatatagatgaggaagactttattttcttaggttttagtgagatttatatctgtcatacacactcttaattttctttagcctctctctttctgctcctaactctggttcaacattcagactgccaactctgtgcttgtatccaagaagcttagcccttggagaagaaaattacacagccagtgtgattgttctttcttccttatatgactatacaaaatcaatggatactcaatattatttgacagtcttactaaacttccagagtatgttcaccttcccactctttgaaatagctattgcatatctttttctttcttgccaacagcctcactctttactcttcagctgttgactttgcttcatattttattgaaaaaataggtgtaatttcataaaagtacctcatctttttcatcacctcatcttttcatcaccaaatttactaactcatctacacatgtgacaaaatactctgctttccttcctactagaaggaaattaatattgggacacatgtagaaagtttgcctctactgttctacctcttattttctcctgaacctaatccaattgggctttcaaccccaccaccccactgaaatgacttaccaaagtccccagcacctttaagatgccaagcagtctatggccaagttgactttccatttaaacttggctgggaggaatctcctatcaagaagttaatgtcatatttggataaaaggctacctatgcacattttcttctctctggtggcatttgagacattgcacccattttgcaaagtttagacattggcagtgatgataattttagccaaatcttatttgatatgctttccttttccatttattatcttcaagacctcttaatttccatttcccctttgatcactgcatttctggcaccccagtactgccctgaagatgtggactctcctctggtagagccttcatatgtcttacgagccagcattttcactctcatgcctcaagggctattgccattgcctcttgtgctgggataacttaggctggtgagacctgcctcctgggaagattcactcctcgccttcacatctgtttcacatggagaatcatcctcaccagattttctaatagtagctgttgacttatgaaatctttgttacttcagaagattaatactggtcaacttttgaatattccatgttttgaaatgattttttttgctattacaacgtttttttgctgggacattaggataaaactagtatttcatttccctctactgtacccctattccctttaggaatggttgttctctcactgaagatggttgctttccttctctaaaacatagggctaatcctgtttgcaaaaaataaaagccctcctttttttttttttttttttttttttttgttatttctgacccagacacttgtttttccaatatattcttatctcatgagaactccaataatgagatatatgaaatcacagtgttctgggtctgctcctctggtatttaatttcttatataataatttcccctttaatacctttctactttcccatgccttcccttctatttctaattcatgggtttcttgatatagtacttcagagaattggaagtacctttatctctgcttaatatatttaactccacaatagtatcaccttgaaatgcaccaataatgctttgaacaatttatgctccttttcctggtagttctctctgaaatctatccaaattttctgcacttgtcccaatattaaagaaccttgtttattgtgaatgttctcaaagatatataaaaatagaaaaatagatattggctatccagtttcattaatttctaacattttgctgtcctggtcttcaaaaaggggcagttctccaattgctctgattatggaattttttaatattttattttattttatttttgagacagagtattgctgtgttgcccacgatctcagctcactgcaacctccgcctcccgggttcaagagattctcatgcctcagcctcctgagtagctgggattacgggcacccactaccacagccggctgatttttttgtattttagtagagacggggttttaccatgttgtccacactggtctcaaactcctgagctcaagcagtctgcccatcttggcctcccaaagtgccaggattacaagcgtgagccactgcgcccgacctgattatggaatttttgagtagcttttacaggaagcttcccaagcaggttgtggatcctggctccttgtgatctcttgtttttctagatttttattctcttgttagagttccttggaccttatcattatttctagtttctaccaacacatcttcccgttttctacagccttctttattagagtggtttgggccgagtgaatctttttccttatttttcttattatttcttattctgatcttaaagatctcatttcctttccctgttttgcccctcccatgagttcccaaacctttcttctaaagaaatcttatttttcaccgtaagcagcattctattgttcccataataatttcattgagttttttctctattcatccaaataatacaatatattcttattttaataaaacatacattctgtttgttatcaataaacagtataattcagaaatctagacccatagtcagagtttatggcttacaaatcgaagtaaaagttgagatcacatggacaaggtttatccctgtgtagttccttctcttagctctgaaggcaggtcaatacagaattttgggtgtctgatttcacacattcttagagcatatgaatttcagcacagtgcatttttctactttattactagtttttatgtagccagctcagatcctttctggaagtaggcaggacatgaattacaaggaaacaaaacaaacaagtttctggaaagagacccagatatgctttcggttttaatctttccactttctaaacaagaacttctagagaaaaataagtaaatctaattcagaagttttgatagaggaaaatgttctggtctgtcaaagccaccagttatagtgcttctctgcaaaattttggaggtattaaaaaaagtttttgtttttttacagccacgctccagaacagcatcagtgttttttaagggaccaggaaaagtggtgatggttgcaatttgcatgtaagtactgaaaaataagctttgtgaaatagaatatattcttttaaatatgtatatccttaaatatgtaaatttattacatggtagctagctatagagtttgaggtttattttgttttaggaggaaattgaataagtctttattattgtcagtaaagtggtggggaaagagcatgaattcatatagataaccatgctcattctctgtatatttttgatgtagttagatctaagaatagttgctacctgaaaatcctttcttgtttttattggagttgatagaagtcttttttaaagaagttagctaaaccaacctgggttacagctactgaagaatatctttgtgcttattatctttattccacttatcttggaagaacataattatttgttcttgttatttttgcctcctctttttttttttttttgagacagagtcttgctctgtcgccaggctggagtgcagtggctcaatctcagctcactgcaatctctgcctcccgggttcaagccattctcctgcaacagcctcccaagtagctaggattataggcgcgtgccatcatgcccagctaatttttgtatttttagtagagatggggtttcactacgttggccaggatggtctcaatctcctgacctcgtgatctgcccacctcggcctcccaaagtgctgggattacaggtgtgagccactgagcccggccttgccttcccctttttccctctatcttcttgattcctattgttttgttcaccttttgtctgtttttctgactaatctattttaggatggatgaaatcattcaataattcattagttcttttattcttaaatatatatatgtaaaatatgtatcagatagtgtgataggatatgaaaatataaagatataatacataattctttaaggattggagggacactaaactagaggaagacatttataatacagacaaggaataatgctgtcataactacaatagtggtggtacagatagacgtagacagtttcaacttcttagaaggcatgttcaaggatagtgaccaggtttctggctgtacaattgtgtaaataatgtaccattcactgaggagagtactggaaggaggagcagggtgggagcagagaaaatgatgagttcatttttgagctggtggtatgtttagggcacccaggtggagataagtcaacagggttctttccaccagtaatacagggatagtgattatagcttttctcattggagggatgtatgtgtgaaaagtgcttaacatagtacctgctctaagatatgtacttaagaagtattattgttaatatatattggtctgaagctcaggagagaaatctgagttagaggtttgatagtttttagtatatagatgataactaaagccataaaagtaaagatcacctgaggaatgtatgtatatatagtatcaggaataaaaagtcctcaggaaaaattccttgaagaatgttaacattaagaaaaaggtggaggctttgggagacctcgtgatccgaggtcaggagattgagaccatcctggctaacacggtgaaaccccgtctctactaaaaatacaaaaattagctgggcgtagtggtgggcacctgtagtcccagctacttgagaggctgaggcaggagaatggtgtgaacccgggaggtggagcttgcagtgagccaagattgcgccactgcactccagtctgggcgacagagccagactctgtctcaaaaaaaaaaaaaaaaaaagaaaaaggtggaggaaaaagtgcctgcagaggagattgaggaggagtaaggagaaaagtagaaagaaaaccaggagtgtattagtccattttcacgctgctgataaagacatacccaagactgggcaatttacaaaagaaagaggtttaattggacttacagttcccgtggctagggaagcctcacaatcatggtggaaggcaaggaggagcaagttatgtcttacatggatggcagcaggcaaatagagcttgtgcagggtaactcccatttttaaaaaccatcacatctcatgagctcattcactatcacaagaacaacatgggaaagacccaccctcatgcttcagtcatctcccactgcgtccctcccaaaacatgtgggaattataggagctacaagatgagattttgtgggagacacagagccaaaccatatcaaggagtgtcaagaaagccaagggaagaagcatttgttttttttttgtgagacggaatctcactctgtcgccaggctggagtgcagtggtgcaatctcggctcactgcaacctctgcctcccaggttcaagcgattctccttgcctcagcctcctgagtagctgggactacaggcacacatgttttaaggaaatagcaggcctggtacaggcacacacctggaatctcagcactttgggaggctgaagcaggaggattacttgagctcaggaatttcagaccaccttgggcaacatagtgagaccttgtacctacaaaaaaatttttttaattagctgggcatggtgggtgatgtgcgcctgtagacctactcaggaagctgaggcaggagaatcatttgagcccaggagtttaaggctacagtaagctgtgattataccactgcactccaacgtgggcaagaacaagaccctgtctttaaaaaataaatagccagctagggggtggcgggcaagatggctggataggaagagatcctgtctgcagctcccagtgagatccatgcagaaggtggataacttctgcatttccagctgaggtacctggctcatctcattgggactggtcagacagtgggtgcagcccatggagggtgacccgaagcagggtggggcattgcctcaccggggtagtgcaaggggtcggggaactccctcccctagccaagggaagccatgagggactgtgctgtgaggaacggtgcattccagcccagatactacgcttttcccatggtcttcacaacccacagaccaggagattccctcgggtgcctacaccaccagggccttgggtttcaagcacaaaactgggcggccatttgggcagacaccaagctagctagactagttttttttcatactccagtggtgcctcgaatgccagtgagacagaaccttttaatcccttggaaagggggctgaaaccagggagctaagtggtctagctcagcagatcccacctccagagagcccagaaagctaagatccactggcttgaaattctggctgccagcacagctgtctgaagttgacatgggatgcttgagtttggtgtgtgttggggagttgggggttggggaccaccattactgaggcttgagtaggcagttttcccctcacagtgtaaacaaagccatcaggaagttcgaactggacagaacccaccgtagctcagcaaagccactgtagccagactgcctctctagatttcttctctctgggcagggcatctctgaaagaaaggcccagcagtcccggtcaggggcttatagataaaactctcatctctctgggacagaaaacttgggggtaggggcggctgtgggcgcagcttcagcagacttaaacgttcctgtctgctggctctgaagagagcagcggatctcccagcacagcgctcgaggtctgctaagggacagactgcctcctcaagtgggtccttgacccccatgcctcctgatggggagatacctcccagcagggatcaacagacacctcatacaggagagctccagctgacatctggcaggtgctcctctgggatgaagcttccagaggaaggaacaggcagcaatgtttgctgttctgcagcccctgctgttgatacccaggtaaacagggtctggagtggacctccagcaaactccagcagacctgcagcagagaggcctgactgttagaaagagaactaacaaacagaaaggaatagcatcaacatcaacaaaaaggatgtccacacaaaaaccccatccaaaagtcaccaacatcaaagaccaaaggtagataaatccacgaagatgaggaaaaaccagtgcaaaaaggctgaaaattccaaaaaccagaacacctcttctcctccaaaggatcacaactcctcgccagcaagggaacaaaactggacggagaatgagtttgacgaagtaggcttcagaaagtgggtaataacaaactcctccaagctaaaggagcatgttccaacccaacgcaagaaagctaagaaccttgaaaaaaggtaagagaaattgctaactagaataaccagtttagagaagaacataaatgacctgatggagctgaaaaacacagcatgagaactttgtgaagcatacacaagtatcaatagccaaatcaatcaagtggaagaaaggatataagagattgaagatcaacttaatgaaataaagcataaaggtaagattagagaaaaaaatgaaaaagaatgaacaaagcctgcaagaaagatgggactatgtgaaaagaccaaacccacatttggttggtgtacctgaaagtgactgggagaatggaaccaagttggaaaacactcttcaggagattatccaggagaacttccccaacctagcaagacaggctaatattcaaattcaggaaatacagagaacaccacaaagacagtcctcgagaagagcaacctcaagtcacataatcatcagattcaccaaggttgaaatgaaggaaaaaatgttaagggcagccagagagaaaggtcgggttacccacaaagggaagcccaccagactaacagcagatctctctgcagaaaccctacaagccagaagagagtgggggccaatattcaacattcttaaagaaaagaatttttaacccagaatttcatatccagccaaactaagcttcataagcgaaggagaagaaaagacaagcaaatattgagagattttataaccaccagtcctgccttacaagagctcctgaaggaagtactaaatatggaaaggaaaaactggtaccagccactgcaaaaacataccaaattgtaaagaccattgacactataaagaaactgcatcaactaatgagcaaaataaccaactagcatcataatgacaggatcagattcacacataacaatattaaccttaaatagaaacaggctaaatgcccctgttaaaagacacagactggcaaattggataaagagtcaagacccattggtgtgctgcatgcaggagacccatctgacgtgcaaagacacacataggctcaaaataaaggaatggaggaatatttaccaagtaaatggaaagcaaaaaaaaaaaaaaaaagcagggttgcaatcctagtctctgacaaaaaagattttaaaccgacaaagatcaaaaaagacaaaggtcattacatagtggtaaagggatcaatgcaacaagaagagctaactatcctaaatatatatgcacccaatagaggagcacccagattcataaagcaagttcttagagacctacaaagagacttagactcccacacaggaatagtgggacactttaacccctcattgtcaatattagacagatcaacaagacagaaaattaacaaggatattcaggacttgaactcagctctggaccaagcagactaatagacatctacagaactctcaaccccaagtcaacagaatttacattcttctcagcaccctgtcactcttattctaatattgaccacataattggatgtaaaacactcctcagcaaatgcagaagaacagaaatcaaaacagtctctcagaccacagtgcaatcaaatgagaactcaagattaagaaactcactcaaaaccgcgcaactacatggaaactgaacaacctgcttctgagtgactactgggtaaataactaaattaaggcagaaataaataagttccttgacaccaatgagaacaaagacacagtgtaccagaatctctggaacatagctaaagcagtgtttagagggaaatttatagcactaaatacccacaggagaaagtcggaaagatctaaaatcgataccctaacatcacaatgaaaagaactagagaaacaagagtaaacaaattcaaatgctagcggaagacaagaaataactaagatcagagcagaactgaaagagatagagacaccaaaaacccttcaaaaaaccagtgaatccaggagctggtttttttaaaagattcacaaaatacatagaccactagccagactaataaaaaagaaaagagaggagaatcaaatagacaacaatgaaaaatgataaaggggatgtcaccactgatcccacagaaatacaaagtaccatcagagaataatataaacacctctacgcaaataaactagaagatctagaagaaatggataaattcctggacacacacaccctcccaagactaaaccaggaagaagttgaatccctgagtagaccaataacaagttctgaaattgaggcagtaattaatagcctatcaactaaaaaaaaaaaaaaaagcccaggactagacggattcacagccaaattctaccagaggtgcaaagaggagctggtaccatttcttctgaaactattccaaacaataggaaaagaaggactcctcctcaactcgttttatgaggccagcatcatcctgataccaaaacctggcagagacacacaaaaaaaagaaaatttcagaccaaaatccttgatgaacatcgatgcagaaatcctcaataaaatactggcaaagcaaatccagcagcatgtcaaaaagcttatcaccaccatcaagttggtttcatccctgggatgcaaggctggttcaacatatgcatcaacatatgcaaaataataaatgtaatccattaaataaacagaaccaatacaaaaaccaaatgattatctcagtagttgcagaaaagcccttcaataaaattcaacaccgcctcatgctaaaaactctcaccttaaactaggtattggcggaacgtatctcaaaataaaaagagctatttatgacaaacccacagccaatatcatactgaatgggcagtagctggaagcattccctttgaaaaccagcacaagacaaggatgctgtctctcaccactcctattcaacatagtattggaagctctggccagggcaatcaggcaagagaaagaaataaagggtattcaaataggaagagaggaagtcaagttgtctctgtttgcagatgacatgattgtatatttagaaaaccccataatctcagcccaaaatctccttaagctgataagcaacttgagcaaagtctcaggatacaaaatcaatgtacaaaaatcacaagcattcttacataccaataatagacaaacagccaaatcatgagtgaactcccattcacagttgctacaaagagaataaaatacctaggaatacaacttacaagggatgtgaaggacctcttcaaggagaactacaaaccactgctcaaggaaataagagaggacacaaagaaatggaaaaacattccatgctcgtggataggaataatcaatatcatgaaaatggccgtactgcgcaaagtaattaatggaatcaatgatatccccatcaagctaccattgactttcttcacagaattagaaaaaaaacttctttaaatttcatatggaaccaaaaaagagcctgtatagccaagataatcctaagcaaaaagaacaaagctggaggcatcatgctgcctgacttcaaactatactacaaggctgcggtaaccaaaacagcatggtactggtaccaaaacagatatatagaccaatgtaacagaactgaggccttagaaataacaccaaacatctacaaccatctgatctttgacaaacctgacaaaagcaatggggaaaggattcccgatttaataaatggtgctgggaaaactggcaagccatatgcagaaaactgaaactggaccctgtctttataccttatacaaaaattaactcaagatggattaaagacttaaacgtaagacctaaaaccataaaaaccctagaagaaaacctaggcaataccattcaggacataggcatgggcaaagacttcatgactttcacaccaaaagcaatgggaacaaaagccagaattgacaaatgggatctaattaagctaaagaacttctgcacagcaaaataaactattatccgagtgaacaggtaatctatagaatgggagaaaatttttgcaatctatccatctgacaaagggctaatatccagaatctacaaggaacttaaacaaatttacaagaaaaacaaacaactgcatcaaaaagtgggtgaaggatatgaacagacacttctcaaaagaagatatttatgcagccaacaaacatatggaaaaaagctcatcatcactggtcattagagaaatgcaaatcgaaaccacaatgagattctatctcacgccagttagattggcgatcatttaaaagtcaggaaacagcagatgctggagaggatgtggagaaataggaacacttttacactgttggtgagagtgtaaattagttcaaccattgtggaagacagtgtggcgattcctccaggatctagaaccggaaataccatttgatccagcagtcccattactgtgtatatatccaatagattataaatcattctactataaagacacatgcacatgtatgttttttgtagcactattcatattagcagacttggagccaacccagatgcccatcaatgatagactggataaagaaaatgtggcacatatacaccatgggataatatgcagccataaaaaaggatgagttcatgtcctttgcagggacatggatgaagctggaaaccatcattctcagcagactagcacaagaacagaaaatcaaacaccacatgttctcactcataagtgagagctgaacaatgaaaacacatggacacagagaggggaatatcacacactggggcctattggggggtgggtggctaggggagggatagcattaggagaaatacctaatgtagatgacgggttgatgggtgcagcaaaccaccatggcacatgtatacctatgtaacaaacctgcacattctgcacatatatcccaaaacttaaattataaatttaaaaaataaataaacattgtttaaaaaaagaagaaaatagtgtcagatgctcccaggaggttaagagaaatgctaaaatatttccaggaatttagtagtatggaatggtaggtggtattgataagatgaaaactgtgacagacagaataaatatgatgtttttaagaagttatctgaggtggaggagatgggaaaagggtagctaaaagggaacatacagttctctcatttataaaatgggggtgttaatatttgtataacagacttgtaatataacatggtaactcactagataacgtctgagataaatcatattagtcattactgttagtatctgagcagctagtttcctcagagttaactgtgtttattttggcatctagctgcttctagtatgactctgagactgcttagagtcacctctggcatctgcctccttaagtaaacagattttcactgaagtcttgcctttgacactggcccaatggacagtatcaggtgcagatctgcttttatctacctgaaacacataattttcttttacattttatcttgtccacatatagaagaccgtcttttctcaccagttttcaaaatatacttaagtaatttgcttacacatagcatgcctcttaacagtacataatctatattttttcaaatttttactcttgttacctaaacaaagttttttaaggctagggattcttttaattgtacttgttttttttgttattgttgttgttgttttagcgatggggtctcactctcttgcctaggctggagtgcagttgcacgatcatagctcacttcagcctcaaactcctgggctcagatgatcttcccacctcagcctctcagtagctgggactaaaggcgtgcactaccacaccagactaagtttttaaaaaattttttgtagagatggggtcttactttgttgcccagactggtcttgaactcctgtcctcaagccatcctcccacctcagcctcccaaaatgttggcattgtaggtgtgagccattgtgcttagcctaattttactttcaacagaatctagtgtagagatatacagctgattgagtatgcttttggcttaaatttttgtccaaacctatgctaaattgttttctctttctcttctagcaatggattaaactgcttctttaaatttcttgcctggatttataccggttcagcaagtatgttctcagaagctatacactcattatctgatacttgtaatcaggtgaggactaaagctttttttataagtcaattttaaagtaatagttgtaggctttaatctaaaagttgatctattttaaaactgaatgattccagtagttggcttgtgggataaaataaaagtttacttttcagcaatgaagtgcatagaaatttaatcatagtattttaaagcagattgttatgctttaagaacctctgacaatggaatgtgaagtataacattgtcagtcactgagcagaaatctggtctctgaatatgaattctcaatgactgtaatagtcaatgaatttaaacttttggaataaagatgtaaaatcatatgtaattggttaaaatgctttcacattagattcataatttgaattactttccttggctttgcaaatggagaaaaatttttgtattaatacaattaaaagaccttctaaaccccctgtggcccaaattgtgaaaactagaaacccaaaacttttctaagaatataataaaaatttctgtgtgtgcatcctattacattttaaagagtgtggtatattaagaggataccttttcaatatttacttatttttagtcctgttatgtaaaaactgatttgggagaacttcaatgagagacacaggtaaaataagaatatttaagacaaggataaaaataacgtgaagataaggagcaaggagagcaatattaattaaaaattaagcctgtgaacttgtctcactcactgtcaaatcagatggattaaaacccttcataaaagtaaggaaagaagacaagcgtttgccattagtactaagtatttaccttgaacttaatttttatactcaatatatacttaaatactgtctctataaaattttaccattcaactgtggtatgcagtgggaggagaggggatagggagagatatataacttataatctctattttcttgtaagcttatcgaggaaagttgaaatacagaaatatttgtccatatggcaaggagatatgtatgatgttattagtttcaatattagtttttatttcaaacattgaagacagtgtttaagtgttcattctctatgctattcaggcatttaaaaagaatgtagtagatatctgtgtactgacctggaatgataaccatgataaattgagtaaaaaatcaagttgcaaaatactatgttcagaacttctgctttcacccatgacagactaacagggattgagtttaatcttttgccataaacaactaaaagctagacagtatattggataatagcagcataagaccatgatctctgagagataagaaacaaattatttgaactctctgatctctctggctttttgcttgaacacatatttgggatagtggagcaggatgggaaataacagtctcattgagttgagaagacagaaatcagtgttcagggcgtctgaggtggctagaacttacaaggaagagttccacagaggaaggagctacaaggacaaaaagctatagaagtctacatagggatttccttgaattgaatgtttgctgaatgttaagttacacatgtgtaagatgtgagcatcaatctgggcagagaaccagcagggagcagtaactgactaattcccactgctcacacaaagctaggttacattcaggttctgactagctgacgtaagagagttctcattgattatcgaggccaatggaaggctcaccttaggagtagggctaaattattcttaacgtaaaggctgttctagaaccctccctaacaaatcttcctaaaagttctaaaggatcaagctgatcttcaaataatttaatcacttgccagaacaaagcctcacattctttaataaaggcagcaaaatccaaacactcagtataacattcacagtgtttagcatccaataaaaaagactaatcgccagtataagaagcaggaaaatttgactcataaccaggagaaaaatcagtcggaagcagactaaacagatgatagaattagcagacaaggatattaaacagctatttcaagtacagtcatgtattgaaaggaaaatatgaacataagaagataaatcaaaggtataaaaaataaaccaaatgaaacttttagagctaaaaaaatatatctggtgtgaaaaattcactgtatagaattaacagcacattagacactgcaggtaaaacagtcagtgaacctgaatatgtaacagcagaaaatattcttactaaagccacagacaaaaaagattgaaaaaaatggaggaagccttggtaacctatggaacaatatcaagagtattctgtcaagcatttagggaagaaacaatgctgagtacacagactttcagaaatagagaatgaaatgtttttctactgctttaatgaggctagtataaccctgatgccaaaattttacgaagtcattatgagagggaaaaaaccctacagaccagttattcctcatgaacacagatataaaactccttaaaatataatcagattttattatataaatatataaatatgatatatataaaaatgatattatatcataagtgagtaagatttcaggagtgtaaagttggtttaacattcaaaatcagtaagtatagaaggttaatatgaagaaattaattgcatttctactatcagcaaataaatggggaaggaaattttaataaattccataagtagtatcacaaaatattaaatacttagagataaatctagcaaaagacatacaagacctttacgctgaaaatcataaaatgttgctgagagaaatcaaagaagacctaaagaaatggagagatacaataccgcgttcatagattggatgtcatagatctgtcaaatctccctaaattgatttacagatataatggagttccattcataatatgaacagacttctctgtacaattgacaaaccgaataaattccaaaattcatacggacatgcaaagaacctggaatattcaaagcaatcttgaaacaagaaatttggagaacttcaagacattataaacttatatagaaattaggacagtgagttactggcataaggattgacaaatcaatggaacaaaattgaggatccaacaacagagccacatttacatggcccgtgcctttcggcaaaggtatcaaagcaattgagtgaggaaatgaaactttttaaaacaaataatgttggaaaaattggatccatatggggagaaaaaggaccttgactcctacttcacacactgtatacaagtttgaaatggatcatagtccaaatataaaagttaaaactatgaagattctagaagaaaacctaggagaatatcttttagacctggtaggcaaagatttcataaataggacacagaaacaatatcataaaataagatttacaaattcaacttcatcaaaattaaaaacttttgctcattgaaagacatccttaaggaaataaatacgcatagattgggagaaaatagtcacaaagcattctgacaagggactggtatccaggattaagaaattccacgattcagtaataaaatgagaacccagttttttccccccaaggataaagatttgggcaggtacttcacaaataaggaaacatgaatggtggccagtggacacctgaaaatgtgctaacaccattaatgatcaggaaatgtatattaataccacaagacatctctgcatatccactataatggctacaagtaaaaacctgacagccaaatgttggtgaagatgtggagcagccagatctcccagtcattgctggtgtattactaaaatggtacaaccactctggaaaatatttggcagcctcctataaacatatacttatcctgtgacccaccaattccacttctaagtatttacccaagggaagtgggaatgaatggtcccaaaagatttgtataagaatgttggctgggcgcggtggctcacgtctgtaatccgagcactttgggaggccaaggcaggcagatcatctgaggtcaggaattcgagaccagcctggccaagatggtgaaattccatctctgctaaaagtacaaaatagctgggcatggtgatgggcccatgtaatcccagctactcgggaggctaaggcaggagaatcgcttgaacccgggaggcgggggttacagtgagccgagatccgagattgcaccactgcactccagcctggatgacaagagtgactcggtctccaaaaaaaaaaaaaaaaaaaaaaaggaatgttatagcagctttacttataatggctgaaaaaattggaatcaacccaaatgtttatcagcagtacagcagataaacaaattgtggtatactcatacaatggaatattatctggcaataaaagggaatgaagtacctttctgactggcaacatagatgtatctccagcaaggaactttaatttttaatagtttaaaaaaattgggaaaaatggttgcgtctgatgtcggggaggaaagaggcacagggagctttttgggaatgatggaaaggttctgtgtcttcataggaatatatgtttcaagggtatgtgtatttgttaacaaccagaactgtacattctgggccaggtacggtggctcatgcctgtaattccagcacattgggaggccgaggtgggcagatcactggaggtcaggagttcgaggccagcctggccaatacggtgaaacccgcatctctactaaaaatacaaaaacattagctgagcgtggtggtacatgcctgtaatcccagctactcaggagatggagacaggagaatcacttgaacccgggaggcagaggttgcagtgagtcaagatggcaccactgtactccagcctgggcgacagaactagacatctcaaaacaaaaacaaaaacaaaactgtacattcaggatttgtgcatttcattgtatgtgaattttacctcaaaaaaattctccctatgtggaaatgtgattacttagtagatatttgataatagtaaggaattagtattgattttttttttttttttgagacagagtctcgctctgtcacccaggctggagtgcaatggcatgatctcagctcactgcaagctccgcctcccaggttcacaccattctcctgcctcagcctcccgagtagctgggactacaggtgcctgccatcacgcccagctaattttttgtatttttagtagagacggggtttcaccgtgttagccaggatggtttcgatatggtcttgatctcctgaccttgtgatccacctgcctcggcctcccaaagtgctgggattacagacatgagccaccgcacccggccaggaattagtatcgatttttaaaagtctgataatagtcttgtggctgtattttctaaaaagcctagtttttaaagagattcatccaaaatatttaaagatgaaatggtacgatgcttggaatttacttcaaaatattcatgagggagtagatatggatgaaataaaacatatttggttacatatttataattgttaaagcttaatgatggatgatttgagtttttaaaaatgttctatcagggccgggcatggtggctcatgcctgtaatcccagcactttgggaggccgaagcaggcagatcacctgaggtcaggagttcgagaccagcctgaccaacatggcaaaaccccgtctcttagagttttcaaaaagacttcagttaaaaatatttcaactggacctttctgaatagatggaaattgtatttcagaaagttgtttctttcgagacctataatatttttaaaattttaattcattgtaacatttttatgccatatgttttccctcacttcttgagagacttaagtacctccaacttttaaattagacctgtgtctctaattataatgtagttttttatttatttatttacttattttttgagacagagtctcactgtcttgcccaggctggaatgcagtggcacaatctcggcttactgcaagctccatctcccaggttcacgccattctcctgcctcagcttcccgaatagctgggactacaggcgcccgccaccacgcccggctagttttttgtatttgcagtacagacagggtttcaccatgttagccttacaatttctgttacagttcatgttggaaaacttttctgttaaatattgcacatcgtatcatttaatatcaactgagatgaatttattgagcacctgagtttgcaatgtagcaagtgtttagaagaagacatggttctttctctgtcttctttaaacaggttatatgcggttatatgcacataaaacaactagaaagatcttctaaggtaccatttatgcaggtgctggatagtatgatacttaaggaacaccagaaacgtgaagggtgatcatggagtagagagcatttacagtacttcttagccactagatgttaatgttcgttatgctgcaaactaaacaaatgctctgtaggttatatatacgtactgatagagatttatgttgtaaatgtgtagaaaaaggtctggaaggatacatatcaaatataactgtgattctgtcttacctctgaggagagctggttggggtggtctcatttttgttagaactaataaatatggtccatattcattttataaaatagttgacggtatctcacacttcattgcacagccaactgaatattaaggattttttaaatagttgaatgtttattgaatattttaaaaataatataaatacatatatatgtatacatatatacacataatgtgaataatgactgtcacctttaatgtacaggtgtgtattagtccattttcacactgctgataaaaacatacccaagactgggcaatttacaaaaaaaagaggtttaattgtgactagggcaggctcacaatcatggtggaaggtgaaaggcatgtctcacatggcagcagacaagagaagagggcttgtgcagggaaactcccctttttaaaaccatcagatcttgtgagacttattcactatcacgagaacagccgaggaaagacttgcctccatgattcagttacctcccactaggtccctcccacaacatgtgggaattcaagatgagatttgggtggggacacagccaaaccatatcttcccgccccagcccctcccgaatctcatgtcctcacatttcaaaaccagtcatgccttcccaacagtcccccaaagtcttaactcatttcagcattaactcaaaagtccatccaaggtgtcatctaagacaaggcaagtcccttctgcctatgaacctgtaaaatcaaaagcaggttagttatttcctggatacaatgagggtacaggcattgggtaaatacagacattgggtaaatacaatgtctccatttggcgacattgggtaaatgtctccaaaagggagacattggccaaaacaaaggggctacaggccccatgcaagtccagaatccagcggggcagtcaattcgtaaagctccaaaatgatctcctttcgctccatgtctcacctccaggtcacgctgatgcaaaaggtgggctcccacagccatgggcagctccacctctttagctctgcaggatatagcccacttttggctgctttcaggggctggcattgagtgtctgtggcttttccaggtgcactgtgcaagctgtcagtggatctatcattctgggatatggagggcaatggccgccctctgctcacagctccactaggtggtgtcccagtaggttttctgtgtgggggctcccaccccacatttcccttaagcactgccctagcagaggttgtccatgagagccccgcctgtgcagcaaacttctacctgggcatccaggtgtttcccatacatcctctgaaatctaggcagagatttccaaacctcagttcttgacttctgtgcacccacaggcccaacaccacgtggaagctgccaaggcttggggcttccacctactgaagcaatagctggagctgtaccttggccccttttagtcacagctggagcagctgggatgcaaggcactaagctcccagactgcacacagcagagggaccctaggcccagcccacaaaaccacttttcttcctaaacctccaggcctgtgattcaaggggctgccacaaaggtctttgacatgccctagagacattttcccccttttcttggtgattaacattcagttcctcattacttatgcaaatttctgcagctggcttgaatttctcctcagaaaatggaattttcttttctattgcattgtaaggctgcaaatttttgaaacttttatgctctgtttcccttttaaaactgaatgccggggctgggcacagtggctcatgcctgtaatcccagcactttgggaggctgaggcgggcggatcacgaggtgaagaaatcgagaccatcctggccaacatggtgaaaccccatctctactaaaaatacaaaaattagctgggtgtggtggcacttgcctgtagtcccagctactcgggaggctgaggcaggataatcgcttgaacctgggaagcagaggttacagtaagccaagatcgtgccactgcattccagcctggcgacagagtgagactttgtctcaaaaaaaaaaaaaaaaaaactgaattcctttaatagcacccaaatcacctcttgaatgctttgctgcttagaaatttctccagccagacactctaaatcatctctctcaagttcaaagttcacaaatctctagggcaggggcaaaatgctaccagtctctttgcttaaaacataacaagagtcacctttgccccagtttccaacaagttcctcatttccatctgagaccacctcagcctggactttattgtccgtattgctgtcagcattttgggcaaagccattcaacaagtctctaggaaattccaaactttctcacattttcctatctttttctgagccctccaaactgttccaacccctgcctgttacccagttccaaagttgcttccacattttcgggtatctagagcagcaccccactctactggtaccaatttactgtattattctgttttcatgctgctgataaagacatgcccaagactgggcaatttacagaaaaaggaggtttaatggacttacaatttcacatggctagggaagcctcacaatcatggcagaaggtgaaaggcacgtctcacatggtggcaagacaagagaagagagcttgtgcagggaaactcccctttttaaaacaatcagatctcataagacgtattcactagcacaagaacagcatgggaaagacctgccctgatgattcagttacctcccaccagatcccacaacacttgggaattcaaaatgagatttgggtggggacacagccaaaccatatcagggtgtaaaagagttatatcttcctttgaatttcctgtcattctcttagtttaattccctgaaaaatcatgtatattttaggtggtttgctcccttttcccatggaatccagtggtaaaagcttataatattctgtgtatttagggtagggtttccaatattaagacctaaaaatatatttgtattaagtattttcaagtttctttaatctctattttttattagaaaaaatgtgtctattaaatttcttgtaacctaagggaaacctcatctgtgaagaagtcattatctagaaacttcacttatctgattatttgatatgatgctggaaaaaggaaaagcctcagattaatcaactaaaattacatagggaattcactcagaggctttatatttttatcaaatagttctaataaggtagtcttatgatgtgatttctagattcacatcaaattaggatggaaaggacttactagggacaagcatactactattgagaagttccagtggataactctttaacaaagggcaaaactttaaaaaccacctaagtggaaatgaaagaaagaaggaagaaatgatgaaggcaagtgagacagaggagaggcagtcagaaaggaaggaaagaaaagaatatgatatataattcctgtgcatggttttgcagttttaatagaaatgtgtgtgcccatacacaatatatatatattgtttaaagttgttattatcttttacttgtacagctatacaagttattcttcctgtaaaaagtcaaatattagactaccttaattctgcctctcttcagagatacaaacatagttacttgcatgttcttttaaaccttttctgtgctttacattatatgtagtttataaaaactacaaagcgtaagttctgtactgtacatactgttcctaacttgcttttttctcttcttccacttaatggtatgtctaggagctttatccatgtcagtatagaaagctctactctaaccctatttttttaacctactgtagaagtaatttatggtttatcatttattttgtcattcccaattgatggattttttttaggttgctttcatgtttctcatctttataaacaatggtgttttgaacccctttgagttcatctttattttttaaggtaagtactagaaaccagaattgctgggtcattggacatgcatatgttgagtgtttctttgtcattgttagcctgcaccctccacattggctttaccatattatactctccatcttgctaatgattattcacctttttttcttcttcttcatagggtttactagcattgggcatcagtaagtctgttcaaacaccagatccttctcatccgtaaggacattgccttattttgtttttgtttgttttggcgataagtcattgaaataactaaatatcagaaatctcctgcaatttatgtacctgcagtttgttcaagatttggtcatttcttccactgtagtatctaaaatgcagaacttcccactgtgtcaaagtaaattcaaggtataatttgaaaatggagttcaagttatttttatgctttgtagcacggcatggagatcttgttttctccatatttgataataataaagcacatattttgatcttagaggtctgttttatttggtccaaggaaacatatattctagatttagactcataggctgcccaatctaaaattttgatgataacttctattagatacacacttattttaatcctcctgttgtgatttggaaatgtattttgttaatatttcagaattatttatttgtaaaatgagtatactttttagaatgtattattttgaatcatagccattatttgatacagagatttttttctattgcttctattaacataaccatctaacacttttgaattccacaaacatcattttaagactagcttcagtaatataatttgataaatcttaagaccaaaaaaagtgcacttttatttctgtaaaggagtctacctctattctttagaaatgcctttctttacttgaaagcaatactactgttttcccataaataacatatttgaatgttttgtaactgtcaagctagtatagagaatagctctctagtgtgttaattacccatcattacagtgttttaccatcttaagaaaaatttttttttcatggccagttttatgtacaaaagatttaaaaacagaaggtacaaattttaaattttaggttgtgaagatttcttctcaaggtatttttatagtctactttagtgctgcccaacagaattttctgcaatgatggaaatattttatatctgtccagtatggtagtagctaactacatgtagctattgagcacttgaaatgtggccagtgcaactgaagaactagattttaaactatatttagttttaatttatttaaatttaaattgccacatgtggctagtggctcatcatattgggcagtttagacctacataatcaaaattttcaataagttaataattccttgaaatcacctgaagtaataccatttattttagatcttaatttactttaacgtgaatatatattcatgttactttagaagaaagtaaatttttctgagtgagctgattgtcacattgtcacatctataaactgggaattccccatggcaggattactctttgcaaaaaggaattccaagagcagcttgattaagaattcttgttgaaagccgggtgcagtggctcatgcctgtaatcccagcactttgggaggctgaggcaggcagatcacctaaggtcgggagttcgagaccagcctgaccaacatggagaaaccccatctctactgacaaaacaaaaaaattagccgggtgtggtggcgcatgcctgtaatcccagctactcgggaagctgaggcaggagagtcgcttgaactcaggaggcggaggttgtggtgagccaagatcacgccattgcactccagcctgttcaacaagagcgaaactccgtttcaaaaaaaaaaaatgtcgggcgcggtggcccacgcctgtaatcccagcactttgggaggccgaggcaggcagatcacctgaggttgagagttcgagaccagcctgaccaacgtggagaagccccgtctctactaaaaatacaaaattagctgggtgtggtggtgcatgcctataatcctagctacttgggaggctgaggcaggagaatcgtttgtactcgggaggtggaggttgcagtgagccaagatcctgccattgcactccagcctgagcaacgagcaaaactccgtctcaaaaaaaaaaaaaaagaattcttgtttaaatttgtatttctcagaagagtgccactgagtttgggtttgggactaaattttccaggaaatatttttattaatgagtgattcttttcctcctctagtatgttattaatatatttttgagcacctttaatactaagtattgtgtcagtactaacaataatacaaaataatgtacatattgatgaagcatgcttgaaaaataattgagattttagcaccatgaaaacacccagaaaactgaaggtcttagttctagtaatagttgaaagttgctgtgtgctaacctattcagaaccagcaataaattatgtgttgtaaacttctgtatccagcatcaaattataggtattataaataatagactggctgcacacaaagatgaaaatattcaattagaagctgcattacaaggaaatttaaatgttatcctgttcattaaacatctgaatgcattttttaaaagattaattttaccaggatctgtggtacataatagtaaagtagctctctaaatcaaaataggctatttggaaaagagatcagaaaatacctgaattaaatggtattcactttatgtattttcaaaattcttacagttttttccactttacatattgcttttcaagtttggcacttaacatcttacttaaatataaaattataacatcttgatattgttagtctttttcattgacctattaagcacatatattttaaaagaaaccatttgtatttcttgcgaactatattcttttctatttttcaggtacggattttcaaatatgcgctatatttcttcgctaattagtggtgttggtattttcatgatgggtgcaggactatcttggtaccatggagtcatgggattgcttcatcctcaaccaatagaatcccttctatgggtaatcctctttttttctcctcagttttgatgtcttatgacatagtgattgtgtacagtagaaggcctttgtcatattggtgttaaaggagaatgacatacaccttcttgactgtgtattgtagggttatgtatctatagtttaatttttagaatgtgactggacataacctctaaatccataagattcaatgatgttgaacaagatctctgtaggtaccaattatcaagccctgctccttggttaaaatcttgggcagttccactaatttctccagttactgttgaagaacaagaaaacctctgttcacttttggtcccaagaatagtctcatttcagtaattaaaatattcagacccatgtaatagtcataagttggaactatatttgaagttaaagcttctcttttcccgcatcctgggcttccttcaggtaggaagcctgcactgggggaatgggaggatagcaggatgatcacccgtatgatcccctctggggcttctgcccctctctcctattccctggaaagtgttgagggtttggataagggataaaaacataccactttactgactacagtgttattttgcattggtttcctctggcctttgtagatgtttaaaactgtctttttttttctcatgggcacttcttggagattaccctgcttggctgctctggctatggctgcccaaattgatcacatagcctaccctctcagcttctgcatctcatggtgtggtttccagacagtgctgaagttgtcttgcatttggaaagaatgccctttgagcagctgatctccttataaaagactcctagggacctgtgtgttaaaacagacatctttaacacactttctgtgggagtgcaggtttttctctcaagcccaatgatctactctgctgatacagccaatatcagttagtaggcttgcgtatggatgtatcactcaggtatgcatcagacagtttgctgtgatatccaatatcccgggggacacacatcaaggctactgaacaatcttagtagctcaacagctttcaccaaagaaatcttcatttttggcctcctcaatttcagctcttcttatgtggtctagaggatgtggagctagcatgtagtctagtgggtagaggccccaggtttgggctaccttctgtgcaaggcctgaatagatggtataacacctccttttggaatgtggggatacttgtacctattttcttctctattttgggttgtagtcagaactagacagaatcaatctgtctacttttttaatatcctgttatatcatacaaatctacttaataacaagcacattaaactaggcttatttgttattctctagttttctatagttttgattgactagtttcttaccataatacatttcatataattaaaacaaacaaatgtgtttcctccattctgaaaagatttggccactttatgggtacttcattgttctagcgttcttctaatttgtatagtgtcactttataggggcaaagcactctctgtagttagagattaggtaattagttaaattttcagttgtgtataagttttaaaacttctaaaagctcttgtgtctttcagtaactaaatgggtttccattagactatggccctttttaaaatagtgttggactaggttcaaagttttcagacctctattttaggaaagcctagggttctaaacattgttgaaaattctgtagatgtttggtttgaatttcattaaaataaaaaaaatgtgttgctaggttaactttttttttttgatacacccctgtctaaagctttttttaccatctttaattgaagagtgtcctgggattgcagggaatgtggtattaccaaaaaacaaacattggttactgtttgtaactacttatctttctgaatcaggattttcttggtattaggcatggaagcaaaatccagaagttacttgagtttgggtgtggatcttactgtatctggtgtctaccactcctgatatcaaatattgtattcatatctcattgtcctcctcatttgagttgtttcccattagtaaccttactgtctggcttaaatttgaattcgtgtttttgttttagacattacggactttatatatgaacaattgtgattggaagtacttaatttatgctttattttaatatttcttttctaggcatattgtattttagcaggatcattagtatctgaaggaggtatgtactgtcacaaagtatgtctctattcttaatttagtaatatatattcagctgtccattattatagtttgctaagttctgttgattaaagaaaagcaagtgtgggaataggcatctaagctttctctacttttagggagtaaagtctttgcataatgtactgtggttgttctgtaatggatagctgtgggggggtgtgtaactgcgccctgccatgggatggcatcctggcaaggcctcatttctctttgtgtcctgagctgctaggataggctcaagtaggtgactatcagatagatggaagacagtaactgatgtggcatgaaagcgcttagcaagcccaccatatttgtggttatttttaaactatgtggtggtaagaggtgttccttacagttttcactttgcaagcattattccttgattgaacccaccaccactactatcgctgttacttgccgattcactaaaaattggataaataattattttacttatttaaaagggaaagtatgtttcatttttgagtatcataccataatactcaaaacatttgaaatggagtataaaaaacataattaaactgaacttttaaaattagagtttaataatattcaccagaagaatattatttactggctcttgtgagacaaatatttcaaagtttttgaaatacacagctatagcagtatgatgacagagaactgctaatatcagtataaaactgcctgattcactgctgtgctcatgtttacttctgaaacattgtaactttctatgtataatgttcccttcatctatttttaaaattaacattttttattgacagatcctaattgtatatgtttatggggcccctcgtctttgaaagtctatgaaatggttataacacaacctgcttcaaaagattgggaggctcagaaatgaatgtggttagtgtggtgctgccaaatagcagctcttcaataaactaaagctgttgttattagtaattatatttaattattatggtttagaactatggggttcattttattataatgattaattgataacaactaattaacatagaacttgtccttattgccaaccctagttttaaaatgttgtgcttatttgtttatcttttgagatgccatctttaaagtttggaggcatgaagtttctgtcttgctgatatgaatgcttttcttttagcaacacttcttgttgctgtaaatgaacttcgtaggaatgctcgggctaaaggaatgtcattttacaagtatggtatgtattttagaaaccaagtgtttgtttcacctcccttatttgcttaaaattacttagtactgttattgctttgttcctaatagaaatgtacaaaatatatctgaatatcatccctgtgtggctcttacatatccttcagcccttattaaaaagaaatgtagtatagaaatttgaacatggatactttatatttggatttgacttaagtgaactaaggtatttctttatatggttatataacttgagaaagtaatttgactttatgtatcagttattgttgacatttaagccaagaaattatgtttgcattgagcaaggtttttaaaatcataatctctcatacacttttttatcttaacttatatcttgattttaaatggatacttactaaaatgttacctgatagtatcaagttaagattttagaaattttcttgtcttgtctcttccccaatgactagtaatggaaagtcgtgatcctagtacaaatgtgatattattggaggatactgctgcagtcttgggagttataatagcagccacttgcatgggccttacttctataacaggtaaatattccttaaattacaggtgatttatttgtcctacttaaataattctctaatatgtgggaattttctcttatatcattgaataatattaaaccaacaaattgttaaatgttaattccatactaatcattgacttatgtaagacatttggtcagcagaagtattcaggtttatttgaattaaaaatgtctctaaattagaaataaggaaggctatttgtaaaggatttctgtaatgctgtaagtctttctagctgtgacttaaaaaattgtgcaatcactctgaactttttatttacctataaaagtgtggataatatttaccttggtaacctcttaggtttattaagaaaatatgagagttttaataaactctaaagttccaaataaatatacataggtcctcaaataacattgttttgttcaacttgattttgttataacattgttgcgaaaaatatcaattcctaactggagctaccatctctgtggagtttgctcattctccctttatctacataggttttctttgggcaccccaacttcctcccacatcacaatgccgtacatggtcagtgaattggggtgtctaaatagtcccaatctgagtgagtgtgggggtgtgtgtaagtgtgccctgccatgggatggcatcctggccaggtctggttccttcctgtgtcctgaactgctaggataggctcaagtagatgataatcagacaaatgcaggacaataactgatgtatgaaagcgctcagcaagcctacatatttgtggttgtttatttttgaattatgtggtgataggtgttccttacaattttcactttgcaaacatttattctttgatttaactcaccacccctactattgctgatactcactgattcaccaaaaattgggtaaataattattttacatagtttttattaatttttaaaaatgtatatgtagcccacatttatttcagtgttcaatattagacatgttttgggtcttagaagttgagtgatgtttttgtgaccagaaatatgccataggaacttaactcttttttttttttttttgagacagagttttgctcttgttgcccaggctggaatgcaatggtgccatgtcggctcactgcaacctccacctcccaggttcaagcaattctcctgcctcagcctcccgagtagctgggattacaggcatgcgccaccacgcccggctagttttgtattttcattagagacggggtttctccatattggtcaggctgatctcaaactcccgacctcgggggagatcctcccaccttggcctcccaaagtgctgggattacaggcatgagccaccacgcccggccggaacttaactcttgtttgtatcagttagcttatggtaaaattggttttgttatatgttgttccctataaagtcgcagtttctaagaacctattgacaacatgaatgaggacttaaccgtatattgtggctcttgttcatttgtctttttccacacttaatgccaataataactactgttgccttcctatttctttaattctaagttgtttgtgtccttattttggtagctaattaaagtgttttgagggccaataaaatacaagtaaatgaaaagacaattctattttatttttattttcgaaaacaaccatttagcatgaaaagactcaatttatgaagttggaattctcttggaaaggaacttcttccatacttctctatttgtccttacatatttaaaataattttaggtgacgagcttccacagttctgcagtgtttcttcaaatagtctgaaatatgaatacttctttctcattctgagtgtgcattttaataccaaactagcattctctgatgtttattgtgatccaaaatatttgtaaaaatgttgattgtttttctggttgaccatatagttttagactgtttttgaacataaattactagcaaaattttaggcttaagaaaagtgtgacttgatgcagatgtcaactttgaataatttattttcttttacataataatagaaaccaatcaaatcaaacttacaaaaatatgtaatgtgttttacatgaattaaatttttcttaattagctaatttattcaaattaaattaaataacatgccaagaaataaaagttttcttaaaaaaggtattttctttcagctaatattcctgtgatttctttaagagtacatgaatgtatatatttaaataaaaataactcctcacatttggatttctaaagagcagtatttgattttgagctctataattacaaaacttctaatggataatgttttacaagcggatcatttttaacacttagtatagattaacaagtttgctttttagtgttacagcttagcaaaatatatgttttatcaagcattaagaagagttaaatatattgatgacatttcatctttgggataaaaagacttgtagtcataaaagccatgtgtaaaatttattataaagatttaaaacgtatttattggtgtctattatataaatattacctatacattcatagatgataaatcagcctttctcattggttctgggagagaagccctgacaacctaaggcaaatattagaatcagaatcacctgaagggcttggggaaacacagaatgctgaaacccacatccagaattttttattcaggggcctgaaatgaggtctgagaatttgcttttctaccaagttttcaagtgatggctgctggtccaggaaccacactttgagaagcaccaccttgaggcacctatggcatgtaatgaattaagttctctcctttttatctagaatgatactagctatatatcatccttggttggatgagaagagagtcacccatattattttctgtagggcttaattctcttacagaacattagtaggaagaagatacggaaaaaggtttctttcagcttttgatttcactgttattttgtctatctggtgtaggaaaagtgctatggatatagctaaaagaaatggactcttcattatgtcatttttttgtattggtgtctctaatctaaatgtgctcagaaacttcacatatgtaatgacaggtacaagtaagagatcttaattatgtcacatagtactcttatgaaagcaagttgtagcatcctcattttgtggtatattaaaactattaggagttgttaaaggaagtaattaaagaaattaggaataaatttcaagtgccttgatttactcgttctggttctttgctctctataaagttcactgaaataatataaactgttaatttactgatttttttatgtgcttcatttaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaaggtcagccttattccagtaatcctgttaaggcttacaaaaacatattaaaaaacagaaatgcctggtttgtaaatacttccagaggaagttttggattcctcgtcttcagaacgttttagtctgtaacttttcagaattataatcctggaaggaagaaagaatacacttaggaaactccttctaagtttccttttaaattttctatacttctaatttttagagtaaggaagagtcaagttgatataatgagaatggaagtttgcaaagtagttgtcttcttagtggaaatacttaatatggaacctgtagagttgccttatattcgcattgcaattacaaattgaatatattaaatttaaaaagatttttgttcattgggcaatgattaccaaattaaatataatttatatttactttgaaaatagactttgttttagcttattttaagtatttttcttataatctttatcttttaaattatgtaaaactaaagaactggagacttaggagataatcagcagaagagatacagaattctaatagtgcttttcagtgaaattctagcagcattgtggttttataatgaaataaaagaacaaacctttaaaaacccagttttctactaactcgctctatattttttcaaactttaaaataagatttttttgtgtattgtacttgaaatctttaagttaaatctttttaaaatgacccgtatatctgaattagtaaaatatattaatgattactagatttatattctgtgccctatatgtttaatcttgaaaagtaactatcttattggaacaagattagaaaatgagagacgggcacagtggcacatgcctatagttccagctacttgggaagctgaggcaggaggatcacttgaggccacgagtttgaggctagtgtgcaatgatcatgtctgtgaatagccactcactgtactatattctgggcagcatagcaaaaccctgtctcaaaaaaaaaaaaaaagattagaagttgagcattatgaaagtcagtattagagttattaacataatgtgagataatccaaattaatatcctttccttgtgatgtttttgtctggttttggtattaagataatactggcttcagagaatgagttgggaaatgttctctcctatttttttggaagagtttgtgaataattggtgttagcttctttaaatggtagaattcaagtatctggatatgagctttgctgtgtgggtagttttttgattagtaattatatctcttgttatggatctgttcagattgtttcttcttgacttagtttaagtagcttgtattctaggaatttgtcttttacttctaatttacctaatttgttggtatacagctatttataatattcctttgtaatccattttatttctttagtgttggtacaaatgtctcatctttcatttctgtaatttgaatctctccttttcttggtcagtgtagctaaaggtttgttcattttcttgatctttctaaagaaccagcttttggtttaattgactttctctgttgtttttctattttctttttcatgactttctcctttaatctttattatttttttccttctgcgtgctttcagtttagtttgctctttttccactgtcttaaggttaagcttttaatttgatgtttcttcttttttaaaatagacaattacagctacaaattttcctttaagtattgctttctctgcattccacacatttccatatattgtgccattttcattatctaatagtattttctaatttctttttttattcttttcagttatttaggggagtatgtcacttaatttttacgtatttgtaagttgcacagatttctttccattattgatttattattttgttctattgtggtcaaagaatatgttttgtattagttctgtccttttaaatttaccaaggtttgttttatggccttacatatagtcttggataatattcatgtgcacttgagaagaatgtatattctgctgttgttgtagagtgttctgtagatgtttgttaggtttaattggtttatagtgacttcaatttccctaattatcttcttgctctattgttctatccttttttttttttttttttagatggagttttgttcttgttgcccaggctggagtgcagtggcacgatcttggctcactgcaacctccgcctcccagattcaagtgattctcctgccttaccctcccaagtagctgggattacaggtgctcaccaccatgaccagctaatttttgtatttttagtagagacgaggtttcaccactggccatgttggccaggctggtctcaaactcctgagagacgaggtttcatcactggccatgttggccaggctggtctcaaactcctgacctcaggtgatccacctgcctcggtctcccaaagtgctaggtgtgagcaccgtgcccggcctctgtatccgttactgaaagtatcgaagtctctagttattgttgttgtattagctcttcctcccttcatttcttcttggttttggcatcatatattttggtgctctgttgttgctacatacatgtttataattttgtatatattgtttaataagtaatgtctaaaaaagagccataaactgaaagactggcaaattcgaaattttgtggaagagtgaatatctgtggattcaattattggaaaaaatacgttagtaatccagaaaattcatacaatttttttaaacagtatattagttacctactgctgtgtgacaaattggcccaaaacttagtggtttaaacaacatattaccatcttacagtttctgtgagtcaggaatcagggcacagcttatctgggtcttcgacttcagggtttctcatagactgtaatcaaggtgttgactgggattatagtcatctcctggggaaggggctgcttctaaccttactcacatgattgttcgcaagatttagctccttgccaaatgggcctcttcaacatggcagcttgcttaatcaaagcgtgcaaattgataaggcaatagagagtgagtgtgaacaagacaaaagtcacaggttagtcacctggtcttggaaatgacatctcatcactttgccatatttggtagttatagcccacattcagtgagaggagatcacacaagggcttgcgtataggtggcagggattgatcatatgggagccctccaaacagttttctgtctgtagttagttatatgtaagaacataaggaaaaagtatatctaaatatatttattagttgctactcacataccagccaaataatgaaatgtgttaatactctgtgaagactaaagtagaaatgatttttgaaaatgaataaatatgttctgtgagttaccaggagagaaaaaaaaaagaataaatgatatagccttttgccaatctgaaaaagttttgttttaacttgagcacatgtaactataaatattaaaacattaattcttatttcatccttgatggttgattaaaatatagcttccttatatggataaaaaattttggactcagtgtttagtaacctgctcaggatccctcagaaattagggtctaatgttgtaagaatacttggagtcttacgtaggcttgtttttctagtaaatctccatgtcctcagaattcagagtgttttgttatttcttatatgtgctgtacagaaaagatcttacagtgatcactgtagaaagaagagaatttctcagcagtttctagggaagattgtttactgagggttagagcaggaggggtgaaaagtagttatgcttgagtatctgctttcctgtctgggaggcaaaagggtatgatgcaaataccactgggcttggatttctgaagagctgggctggggagtcctaatctgctgtttactagctaaattaccttgagcaagtcacttatgccactctaggatggttttatcatgtataaaataaagatgtcaccctatccacttatgaaagccatccattaaatgcctgccttatagttcttactgtattaaacattttatatatgtattagctcattattcctcacatcaagtcccatgtggcagttattattaacctcattctaatagagaacttcacagcattgtatgaagacttttaaagaagctagtgaacatacaattggttaatatactctacaacaccattataaattaaaacaaatttttatatggcatttaggaaattgataagtagatatatggagacaaaggcttatgagataacatgacattttagaaaattgatttagagttaatgaatatatatatatatatatatatatatatatattttttttttttttttttttttttttttggaaacaaagttttactttgttgcccaggctggagtgcaggggcacaatttgggttcactggaacctttgcctcccaggttaaagcaattttcctgcctcaccctcctgagtagctgggattacaggcatgcaccaccatgcctggctaatttttgtagttttagtaaagacagggtttcaccatattggccaggctggtctcaaactcctgacctcaggtgatcctccctgctcggcctccgaaagtgttgggattacaggcatgagccactgcgcccagcagagttaatgaacttttaatacatgagctttataattcataaattaccataaaataatatttgttaagtttgcacctttgtatgatatcatgccaaaaaaaaagctaaacggacaggccttggaaaatgataggtggtacttaatggtgaatactctgaagccatcttagtccattctcgtaactagtggggaaaaaaacaataattcaagcctttgtgctattaaagtatatatatgtgtatgtatgtataaataaatttgtatgcattgttattgattgcagggcaattcatgatgttaaagccacagatctgggattaggtaaagtaagatttaaggcagaagtagattttgatgggcgagttgttacaagatcatatttggaaaaacaagattttgaccaaatgttacaagtaagtttatttgttgttttcttacataactgagggttagaaaaatgcttttaaggtaaacaaaatgaaatttttttttatagatcttaaaggcactttagctctcaacttcttaggttccaaaatttaacagagacctttatatttactatggaggggttcagaggagacagcaaaagaacaaacttactatttcatgcttgctatgtgcatttaatctttttttatctaatttaccctcaacaaccctgttatttcaacaatgaaataacatttttattttaacatatatagaaattgaaagacagagattaagtaatttgccttaagttgtagtgccacagagatggagtcatatatgaatcgagatctgcctgactccagaatccatttttttattaagaatagtttaaaagagaatttataaaacagaatataatgaacagcacagatgttaccacttgcccctgtcaaatcttaacattttgctatagtgtatttgcttaaggtcttaaaaaaagaaataattacaaaaacagttcaagcccccattttctctttctatatctcattcttcttcttccatccctagaattaaacattatgctgaatttggtacctgtcttttccattcagatttttatacttttcagcattttttagtgtaatatgtaacattttgaatgtttaaaaattggtataaatggtatcctactgtatgcgtctctacaattggcataacaacatattttttagattcttccgtgttaatttatatatctctagtcagtttaccttcattgttatagagcatttcaccctatgaatatgctgtaatttatttattttgtctccagttgatggacatttatattactgttagaaacaatgccatggccgggcgcggtggctcacgtctgtaatcccagcactttgggaggccgaggtgggcggatcacgaggtcaagagatcgataccatcctggcccacatggtgaaaacccgtatctactaaaaatacaaaaattagctgggtgtggtggtgcgtgcctgtagtcccagctactcggcaggctgaggcagtagaatcgcttgaacctgggagttggaggttgcagtgagcctagatcgtgccactgcactccagcctgggcgacagagcgagactccgtctcaaaaaaaaaaaaaaaaagaaagaaagaaacaatgccatgattgcattctcacacgtttccttgttcacatatatgaaaatttctttagtatggtgtatatatagatagctagattttaaataggtgggccattgggtgtacttaccttcagcttgcctaggtcttaccaagttattttccaaagtgtgtcaatttaacttccatcattgtatatcaaggttcttgcttcctattcttacatgattgtattaatagagttattaaatttttgccagtttgataggtgtgaaatagtatcttgttctaattttatttcttggagcattgaggttaataaacattgaagttcattgaccagtgggatttcctctacattgctccctgatttttcatgttttaagttcatttgcattacacttatagatttgaaaggtctttattttattgcattgtattattattttttgagacagagtctcgctctgtcacccaggctggagtgcagtggcgcgatcttggctcactgcaacctccgccccccaggttcaagcaattatctacctcagcctcccaagtagctaggattacaggtgcctgtgaccacacccggttaatttttctatttttagtagagatggggtttcaccatcttggccaggctggtcttgaactcctggaaaggtctttatttttaatatcctggatgctaattcttacttgtatatatgcaattatttttttctagtttataacttccttttctttttgttgttatacaaaatatttaatatgatttttaattttaatgtgagatttgtaatcttttcctctgtgctttttattcttttgcatgaaaaatccttccatatcccattatcataaaaatattctcttctcatctagtagttttgtggtttgttttttacccttatgtctttcatccactttgaattattttaatggtctgacatagggattcaatttttttttcttaagggaaaatattctaacactatttattgactatattatttccccagtaattttgtagtgctacctctgtgtagtattatactcagttttcttgatccgaattgttttggaaataggtaatccattgcctgtggcttaaagttttaaaaatgttcattaaacttaatggcgtttgttataggtttgtttttttttaaggagtcataagtgtaccactatggttttttaaaaatttattttcctgttttcattttctttataggaaattcaagaagtgaaaactcctgaagaactagagacctttatgcttaaacatggagaaaatattattgatactttaggagctgaagtagatagacttgagaaggaactgaaagtaagatgtattcataaaaataacataatgataatggcagctatttttttgagtacttactctacagcagacactaagtgcatccatcacatgcatgctttaacccactcataactccacagtgtgtaggtatttataagcaagaaaatgactgggttagataagttgaataatttacccaaggaaatagggaaattgtgatttgaaccagattctttacttttaaacactattttatgcagcctgcttagtttctaaaatagtcaaagggggtttttttgtttgttaataaataagcattttgaaagttcctagagaaagatgaaaaggaaactttagactgtggtcaaaagttagaaaaaatagaatgtatatcttgcttttagcccatttgaaattattttctgtttttgtttgtttctattcagttggatgttattgtaatttattgattatgttactgaaatattacctgatcctgatcaggttgtcttttaaaatgtctcagtgttctcaaattgccatttattgacatttgaattctgtttgcaatgaataaaaacttgtaaatgatctttaatgtatataatttgttgaaggcagtgctttttctgcagttgatattgaccattctttaattttgtaaaaaattgaagaaaaaaacttccatctctacttttcaagttttcctttgagaatctggatatccgattagattaatacaagtacttcaaataagattttgttaatattatagttcatgagctttatttgacataatttttgaattttctagatgatattttggtcttaagacgctttcattcttaaaaattattgcagaccccaaagagattttatttatttgagttatagttattgatatttaccaaatcatgcatgaaagtagataaattttaaaatatttatcatttacttttaaaaacatacacctatttaatataaataactttttttttttttttaactaagaatctcactctgttgcctaggctggagtgcagtggcacgatctgggctcactgtaacctccgtctcctgggttcaagcagttctcctgcctctgcctcctgagtagctgggactacaggtgcctgccaccatgcccagctaatttttgtatttttagcagagatgaggtttcaccatgttggccaggctggtctcgaactcctgacctcaagtgatctgcctgccttggcctcccaaagtgctgtgaagtgctgggattacaggagtgagccaccccacccagtcacattttttttttttttttaactgagacggagtctcgcactgtcacccgtgctggagtgcagtggcacgatctcagctcaccgcagcctccgccttccaggttcaagggattctcctgcctcagcctcccaagtagctgggataacaggcacccaccaccacgcctggctaatttttgttttgttttgtacttttagtagagacagggtttcactatgttggccaggctggtcttgaactcctgaccttgtgatgtgcccacctcagcctcccaaagtgctgggattacaagcgtgagccaccatgccaagcccacatttttatataaatagttatattttccaaaatgaaaaaacgtagttagaagagtgatatttcacatttttgcaaaagtctcttatgcctggcttagtagaagacagctacattcccatatctgcttctgccttcagttgtagtgatttgattgtttggccgaagaacatgaaggaaagggagaactgttcctatagccttttgagataattgtgatactctcttttggtgttataacagctggtagaaaccaaatcaatgaatgaacttctcatatgctacttgtgaaggtagggggcacagtctacaagactgtccttccttctaataccaactgtgagttcaggaggttccctagagcaccttcagatttaataactcactaggactcttagaactcaccgaatcatgttatacccatcatggtttggtttattacagggaaaggatactgcttgaaatcagccaagggcagaagaagtgcatagggcagggtccaggaaagttccaaacatgaagtttcagttgtcttttctctgtaatgtatagtattactctcctggcaatgaagtgtgacagtagcatgacgtgttgccaaccgggaagctcatctgagacttgatgaccagagattttattgaggctccatagttgactgcataagtagctgaccttttgtctctagcccttctagaggtagagcagatactgtgtggccaaaggcccccatcatatatcacattctaaagttaatgcccccagataaacaaagacactcttaggcaggacatgtcaagggcctagaaattccctcccggttatggagaacaaaagccaaacctccctttgggtaagattaattctctactatacactgttatattaaaatctgttggtctatttttatactctgaatgaatcttttacccatgcatgattctataacattatgaattagtattttggaaaatactggttcacagaagtacttagatctttcagatgttgatacatttctaaatatgggtacactctcaggctgatggggtggatatgtttttcaacttaaatttccacttaaaagcttgcattttatcattagcaacaaatactgttgttttccttgaaataagactcattttgttcattttttaggagatgcctgccaaatacccaaatttgaataaaccgagtttgttaatctttcaaataaaaatgtactctagattaaaaagcagtttattcagctcacaacttaagcaatcaaagaagtacttttacgtactttccattttgtcacagtatttttaaaagtgaactcaagggtttaggtttaataaaatggatacatttgctatttcatgaaagacttttttaaatgaaactggctttttttttaatgtcaagtgtgggacagtagagacaatgactactggtattgtttgatgccatttgtgttgaattgtgcaaaggtgcaagcagttttacccaccattgtttttatgccatcaggaaatgtcagcatagtaaaaaaagcaaagaatgtcttacagttactgtgaaaatagttgtgaccttagagtccccctaaaaaggtctcaggaccccagcagtccttgaaccgcactttgcaaacaactaatctgtataaaatgtgagacaatggttatttttgtgcaaggtagcacaagattgaataaactttgctctttattctatttgtttttattttgctggcaaggaaaataatggactaaatatttgctttacattttagtagatacaagaaatcagaagccagatttaagaataatcaccaaattggtccttgtcacctacatttactcttacaacaatcagaccttattgtttttgtttagctaactttgtactttaactagaggctattaaatcattaataatgtttttgaattatgtaagtctttcaaaccaggaaggtaagtataatccatacattcaggtggaaacgtctttggctaagataataaagcatggccgggcgcgtgcggttgctcatgcctgtaatcccagcactttgggaggccgaggcgggtggatcacgaggtcaggagatcgagaccatcctggctaaaatgacgaaaccccgtctctactaaaaatacaaaatattagccgggcgtggtggcaggcacctgtagtctcagctactccggaggctgaggcaggagaatggcatgaacccaggaggcagagcttgcagtgagccgagttcgagccactgcactccagcctgggtgacaaaccgagactccgtctcaaaaaaaaaataaataaataaataaaataaagataataaagcataattaatcttaagtcaaaggacatgttcatagttgaggtgccaaaccaaaagggaatgcatgaatgtaattgtttttcttagtcatgaaaataaggtgatttccttttgaaaactaaaactttgttcactggcatattccttcatttttagtatctcagtttaaattgtaattattattggattattttgggaggtcacactcatttatataattctgtaccagtggagtcatctctgttgagtaatgccattgagtgttgaaatagattatatttttggcttaaaattccagaacttgtggctgggcgcagtggctcacgcctgtcatcccagcactttgggaggccaaggcgggtggatcacctgaggtcaggagttcaagaccagcctgaccaatatggtgaaaccccatctctactaaaaatagaaaaattagcttggtatggtggcgggcccttctagtcccagctacttaggaggctgagacaggagaattgcttgaacctgggaggtggaggttgcagtgagccgagattgtgccactgcacttcagcctgggtgacagagcaagactccatctcaaaaaaaaaaaaaaaaattctagaacttttgtatagttatctgtaaaggtgttaaaaataatagagactaattcatagattcccatattacaagataggaactacaaaattaatataaaatatatcttgttattattttgaagttctttgacctgttaaacattttttgtcttatctctgtatttcagagtatagataaacctttctcctatccctccattaagttttttgtttatgatgattaatggaaattagttcattgggaggctgctgtagcattcataaattccttataaataatggctgaattaaatgctctgttctttactttgcctttgtttctccagtttctcttaaagcattgtttttaatgaatctgcagcattgtaaaataaattatgtaatttgggctttaactctctgcaagtattggaataaaatcctcatggtgtgtaaaatagcctaatcggtattgagcaatgcaaggaatatagattttaaagtatttgttgaataagtgggtgaaaattttaaattggataccaattattgattttcagttctgttcaataaatattagtttctactatacacatgatatcttgttaagcagtaaacattgaattttaaggatattaatcatatttattcattcagcatatattgtatgctttgtattgtgcacatatacttttacaaatttgattagtttactctgaaaacttgattttaaaaagcagagcaaatttttaggctttttttttagataaagcttttattagtacacatatatttatatcatgctttttagacagaataatgtcaaacttttaatgaacaggtaaatttttcaagtcatattaggataggtaagggttgattggagtaggaagatacaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgatcgacactagttataagaaaaatccctgtgtgcactcagtagagtgttcttgctggagcaaaactccaatattctgcgagattttgtttttataactggatgcctttaatacgagtaatatgcacatggtcctaggttatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttatattttaagagataaccatttttaatacttttcagtgtgtctttatttattgccatatttctgcataaaagtcttatactacttctcttgatttaacagtatttcctctacgataggtgtagatttagttcttttatacactactttctgtcctcccttctcacagtattaatatgttacattttattatatttgtaattccccttaagttgatttaggtgcccttcctttattttattttattttttatttttttatttttttgagatggagtcccgctctgtcgccaggctggagtgcagtggcacaatcccggctcactgcaacctctgcctcccgggttcaagcgattctcctgcctcagcctcccgagtagctaggattacaggcatgcgccactatgcccagctaatttttgtactttttaatagagacggggtttcatcatgttggccaggatggtcttgatctcttgaccttgtgatccgcccgcctcggcctcccagagtgctgggattacaggcgtgagccaccgcgcccggccaggtgcccttcctttgtgcactcacaggaaaaagaaacccaaaatctttactttgctctgtggtagccgagtgttgtaattgcctacttaatttacctatatcacctcactaccaaacgtaagtccactgaaggcaaatactgtttgttcccagctcattgtcatatacacttcaatgcctggcacagagtaggcatgtaatagtagacagtattggttgttattgaattgaagttccttaagctagcatataagatttttaacaacctgatttctgcctgtctttccagcctcattaccaaccctaccctttttgcagcttctgtgctagctataccatagtgccagtgcacactttgcaggctgtctgactttgctgatgttgtgttttctgtctaggcactcttcattatctacctggaaggctcatcatatgcagacctagcttagatattatatcctcagtgaaattttctagatctcatgagcaaaatggctgtctcatttttgctcccagtgttattatttagtacagtgtaataggagcttgggatctggaatcaggcctggagtcaggcctggaatcaatcctggctccatcacttactagcagtgtgacttcagacaggttagttaatttcttcatacttcagttttccctgatgtatgtataagatggaaatagtaattaggttatgaggcttttaaaacacacatacatgtgcatatgtaacacagtacttgatacatgagtgagtgagcaataaatgttaactttttattattagctctaatactttaacttgtagatgattactgctatgctggtctccctagctaaactgagtcactcagggtcaggaacagagtcttatttaataatcatagctctgttttctagcacagggcccggcccaagaatatatggattgttgctaaagtatataaaatgagtggttgtcaatttactctttttgattattattgttttgcagtgattttcttttcaccacacaaaaatgtgtatttccagtgcttcgcaatgcttggcatgtactagatccttaatgcacttttgtattaacaaacacatgaacaaacttaggaatgtgatactacttattgtactgtttatagtatgtctatttacctattgatcttactttttttcttatgcaactatttctctcattagtatgctatagtgaaatagtttgcaaatgttttcattggctctaatgaccaaaaggaataaaaagaaacaagattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaagaaacaagattttattttgctacaaataatgtggtggtgatttttctttccagaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgatttttgacccagaaatctcatttactggaaaattgtgagactttacgttggtgtatttttctttttttttttttactattacagagtattttgcatgctgtacattttaagtgaaataacattccagttttatttttaagatagaaaattgttatatatatatataatttgatactctattcttacagtttcaaattccttatcccttctttacaaaaaaaactttttttttacctgttatgatttattctatacttttttcttcttccttcccctttcccacttgccatttattacttcatgtcattgccatatgagaaagtaccaaattatatccagtttcctcctagtgatattactctgaaaaatttcacaaagccagacaagaataattactcattttttttcccaagacgaccctcaaagttaatgtgcagcaggtattccaaatggtaatttttttttttaggattccctaataaaaaaaaaaaaatttctgatatttctttttaaatctgattttggttgaggtcataccattcttaaataataattgaaggtttatgttgccatcttttctaattctgttttgcactgataaacttacataaagtttgtttatgtaaaataagacataaaggagtacaacatatcaaggaatttgagtatttatgtggaatcaggaaatttttctagagtcactgaattttcaaatcagagaatttgggctggatatggtggcttatgcctgtaatcccagcactttgggaggccgaggcaggaggattgcttgagctcaggaggtcaagaccagcctgggcaacacagcaagacctcatctctactaaaaaaagttagccgggtgtggtggtgctcacctgtgttagtccattctcacactgctataaagaaatacctgagactgagtaatcaaaaaaagagctttaattggctcatggttctgcagactgaacaggaaacatagcagcttctgcttctggggaggcctcgggaaacttcattcatggcagaatacgaaggggaagcagtcatagccagaggaagagcaagaggcggggattgggggtaggtgccacactcttgtaaacaaccagatctcatgagaactcactatacagtaccaagaggggaaggtgctaaagtattcatgagaactccacccccgtgatccagtcatctcccaccaggccctacctccaacatgggattacaattcgacatgagatttggtggggacaaagatccaaagcatatcagcatctgtagtcacagctacttgggaggccgaggtgggaggatcacttgagccccagaggtcgaggctgcaatgagctatgatcatgccactccagcctgaatgacagagtgagatcctgtctcaaaaagagaatttgggtctctttctccaaaaataaggctatatttagtttttcaggtttcttgttattttaccaaattaatgtttcttactttgtttgtatctactttggcatatagcatttgagtattaaagcatataaatcatttttaaggaaaatattctctgcaggagaataattacaaaaataatactggacagaggaggggcagtcaagggtccatgattgattccttcttgcccaaaactaaaatctaggatttatcaaaggtgaggtatacagtggtccctgacttataatggttgcatttaagaatttttatgatgggtttattggcacataaccccataataagtaaaaagcatctgtacctacttttagctttggctgagaatggatctctaattcactgtaagtagcagtccccaaactatataaggtggcacagttttcatcatggcagtgggaggatgaggggtggagtgtttttgttttttttgtttttttttgagacagagtttcgttcttgttgcccaggctgcagtgcactggcacaattgcagctcaccgcaaccttcacctcccga

SEQ ID NO: 12591 - DNA, 65744 bp, Human
  misc_feature (1)...(65744): n = A,T,C or G
aagtatagagcagtgctggatggagagagaagtacattctcgggggagcagaagcctcagggggattggctgcctggtagaagttactaccatttcaagattcctcctagaactcgagtacaaagagattgctgaggggcatactaagttgctggggccacataaacagaggtggagtctggtgcttgaagacatttcctgactctggtcagggaagcaatctgtggcttcgggtttttttttttttttttcaagttcccaacactcagtgaaaagtgggtttatgctgggacaaaacagccttggaatgagcagttagcaggtaagctcatttactaggtcttctggggagaggatgatggggagaatgggaaggatcctcacctaggtttcttgcttccacaaagcccagctctgtgtgaacaggacagtgtggttcaagtggagtcagggtataggggaacaggcagccatgaggtttcttgggaagacacagacccaagtactaatagcagagaatgggcacacagtcactggctctgatttgggacagttcctgacctgacagggacagaaagtggaattggacatcgtttgagtgctttttttgtttagctcatcatcctgagagcttagagagctggttagtgagggtgaatacacacaggggcagcttggagttgcctgagtattacttgttttagcaaggaggttatatggccatgagatggaaagaaccatttgagaatcatgagttccaggcagaatgataggaattgaactgacagtggtaccactgatggtatgaagaatttgagaaggaatttgtacttgcagggggaactcatttcaaatgagctcatttcaaaatatttttagttttgagggtggtaggagcctcaacagggtatgctcagaatccaacaggtagaggcctgaagttggggcagcaggccagggcttgagacttgtagatcattcatgttgaaatcaaagtcttgagaaaacaaagagcccacacaaactaaggagcgatcggagaaatacagaaaaaataggaagtcactgttctcaaaagacaaagctccagtatggaggtgagaactgtgaaaattctggtgagagaggttggacaggctgagaacagaaaaaaaatactgtcctgaggaatactaaagaggagagatgagagataggggtcaagggtgacttcggagctggggacatttgctttaaaacagcagtaaaaaggagcaagaggagaaggagaaatccaccacaccacccaagattttttcttcgggagggaagtgtttacgagcattgggaaatctaagcacaaaccgatccaatctttgctgtaaggttgatgagtttctgtgtacagattcctagcgtgagagatgacttatatcagatgtttacatgtaaagaaaaccgactacacagacacacacataatccatacctttgagtcgattgttttatgaactgctacagtgctctgtgtgtgtgtggtgtttttttgtgtttttttttttttctttcccgatgaggacaatacaaggagaatccgatttaaatttaaattacagagatggagattgaggctcctcccaaggggacaacttatcctgttaagagacactgggggacgatattgagatgggttatgaaagatcaattcctatgaaagatcaattcccctgagagctctgagaataggatcaaagtagaaagcgcagtctgcctctgcttggttacactgagccgatgtttctttagccaaaggcagtgggctagtttagacggcctttcattcccggcagcgcctgtgggtgcgtgtgacctgggacagaggggcaaaggaacctggcagagcgagcttgggatgccgcggcccctttaagagcggcggcggcggcgcgcgctccgacggctacccccgggccccgcccctttcccgtgagccctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccgaaaaaaaaaacccgaacgtgaaataggctacagaaggcttagggcatttttaatgacatcccatttattgtactatgcctctaatatctgatatggatacctgtggttgacccttccaattcaggcatacaaaagtgaggacgaggaagagttaaggtccttccagaagtatagtgtactatacgatgatcaggacagttcagacaaacagtaattacaaacaccatgcatatgcagtatgggtgacttgctgttggcatgaggttattgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgttgataaaccttctatgtattatgctcagaaaatacaaagaggtataagatctttgccttcaagtcacttataggcaggtcatataaagaaaataatggcatcttaaatttggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttaccatcatctatatgttggggatgatgatagtaggattactgtgaggaagaaatgtttttagactagtaactgacccttaagtaaatgcccaagaaatgatagctgtgctattattattattattgctgttacaactgcattttctcagattaggcccagaacaactcttttaattggtcagtctcataagtcaagggacaaatacagtctttttaagagaatcaaataggggctttgaattgccctggaaatattttctctttggtagctggtatcattaacctcatctaactctaggactgaagtagaaaaggattaccgattgcattttgtgaggtttctaagttaataaaaagtgatagagcaccttggtgttagtattttttgaaggaaaaacaagggtatctcttgtggaatgtaaagtgcaagagtgttagtctgggagtcaaatctggagttgacttggcgttctttagcctgtcctattttctcattgtgggcaatgggtgctgtggaccaaacagcctcctaacttaactcgcaagtccagttcgagaatagatgggattgggtcaaagtttctttctttctctctctttcttttctttctttctttctttctctctcttttctttctttctttcttttctttctttctttctttctttcttttctttctttctttctctctctttctttctctctctttctttctttctttttttgtggagggtcaaagtattttcaatagcatgaaaattgaagttttctttttcctttttttatttttgatagagtgttgctctgtcgcctaggctggagtgcagtggtggggtcatagctcactgcagcctcaacctcctgggcttaagtgatcctcccacctcatccttctgagttactgtgactacaggtgtgcatcaccacacctggctaattttttatttttatttttgtggtgacgcgagtgtgggggggtcttcccatgttgcccaggctggtctcaagctcttagctcttgggctcaagctatcctttcaccttggcctcccaaagtgctgggattataagtgtgagccacctcgcctggtcagaaatggaagttttctagtcctatttattgtctgttatttttcttatagctctcacaacatcatagctatcttattattattaatatattattttaaaacctttatttttcagcatgactctggggtcaaaatgggatgcctagacctctaagattcagcccactggtgatcttattcctgtgatattgggttagctacgtaaatcctggaaaatgctattaaaaataagcttttcctttatctgagaagcaggagtaaaaacagtttaaattgccaaagtggtcagtttctagattgtaatatagatcaattgctccagttacaaacacacaattgcaaagtacccacatgttttgctccttgggttagctttcttaagaagcttaaaagtgagtcactgttagtaaaagttgtcgaggtagttaaattaagtctgaaaagtgatcacgcactacactgtgcttacagatggtataaaaagcaaaatatggcagaaatatttgtattgccttaagcttaaggcatctggagtccgaggtttaaccaatgtgattcatcaataaatattgattagatgtctatgatgtatgggatatgatgagaaatacatgtttgagccacagtatctgccctcaaagcacttatcatctaatgactatggctcataccttatttctcatcatatctttcacaaaactaatctgtagaaattgtatcagttttggtcacacttaatgccctagtgatgttcttcctatatttttgactatcagaggcttcaggtgtgattggctggaataatgggctgaaatccatgaggaaaccagtcactgccaactgggagaatcacacattagtagggccttgggtgatgctgattttttttatcactgggagacttttcagcacaggagggtcaggaatgtgtaggagggttaggacctctctgttttgtgaaagatatctctttgtggttgtgttttttttgtttttgtttttgttttgagacgcgttaggacctctctgttttgtgaaagatatctctttgtggttgtgttttttttgtttttgtttttgttttgagacggagtctcgctctgtctcccaggctggagtgcagtggcgctatctcggctcactgcaagctccgcctcctgggttcatgccattcttctgcctcagcctcccgagtagctgggattacaggtgaccgccaccacgcctggctaaattttttgtaattttagtagagatggggtttcactgtgttagccaggatggtctcgatctcctgaccttgtgatccacccacctcggcctcccaaagtgctgggattacaggcatgagccacagcacccagccatggttgtgttctttgttgcctgttagtggtcatttaaagtttcataatataaatattttctgtgcctccctctatgtaggaggctagaagtttctgctttagtctcttaacaaagctctgtttttgtatcctttcactgagaattgctttgactctatgactaggatttggccttttacagaaccctcgttaacttgatctgtgaatttttttcaaataccaatttttcagatgcctggtgccataataaagggatcttgattttgttttcaacctaaataattattctccatgctgttgttttatcgaccaaggtatgtgtttcaaatttgcccaagtgctgagctctcctcagggtacccagtgatgcttcagcatagggttgggcaaacagtagaaccagtgggcactcgggaggcggaggttgcagtgagccgagatcacgccactgcactccaacctcagcaacagagtaggactccgtctcaaaaataaataaataaataaaataaaaaaaaagaaccatggttgggcttggggacatggaaggaatttatgctgccattattagcatttgtagtagcttgtctgtgatttttgcatgtaaatataagaggacagcttttactgagcctcttaattagctcttgtggaatagtagagaaaagagctgtttctgtctcatacaggcagaacgactggatctacaggcttttctcttctaggttatgtctgtcaagtgcagttgctatctaacagtcagtttttaattttgtttttggaggtgagatatttttaaaaggtgtctttcatttattttaaattcgaacctttgtttaaacgtttttaaagttggtgtcattatactactgttcacgaatgaatcattactactctaaaaaatatatgtgactataaattgaccagaaggatccctcctctctgctccctccctgcttcctgggcaactactgccttttttttttttggacagagtttttgctccattgtcctggctggagtgcggtggcatgatctcaactcactgcaacctccacctcctgggttcaagcaactttcctgcctcagcctcccaagtagctgggattacaggtgcctgccaccacgcccggctaatttttgtatttttagtagagatgaggtttcactatgttggccaggctggtctcgaactcttgacctcaagtgatccacccgcctcggcctcccaaagtgctaggattacacgtgagccactgcgcccggctggcaacgactgctcttatacctcctcatttctgcttcatcacttctcacttgggtctggtttccactcctgctactccactgaaactgctcttatcaaggtcacctatggcctccttgttgccaaacccaatggatacttctaatgcctgccttactcgactttactatagcatttgatagtttttatcacttccttctcctcaaaaatgaattttttccctttcttcctgactttgccaccactggttcctttttttttctactcctgtgggttttccttctcagactccttcatcagctccttctcctctagcagccccttaatgttggctgttaatagatcaaaccccagatctatatcatagtcttcttcccattttacttgctcccctggcgatctcatctacatctgacttcaaccatcttatgactgcacagtgtatatctccagttgagacccctcgctttagctccagataccacatactcaactatgcgtgtgtcacaagtacatccaactcaacgtgtccaaaactgaatgtagccttttcccctgtaaatctgttcatctgtgtatgttccttacctcattgaatgtccttgttatccccctcggtgctcaggccaacttacccacctggttaccaaatcaattaaggttcctcttagtctttcatctcccttcctcagtcactaaatcttcctaaaatataataccttcaaaaaatccttctcgcctcctgtcagtactctcttaggttaggacctaaactcttattgcctgaatgcctacagtagccctgtatctagccttttagaccctctttagtctagaccagtctttctaaagtagaaatctgctatcaagcctctgccttctatgacttcattttacttttgggataaacttcaaattcccttccccaacagataagatcttttatgattcaactcctgccaatctttcaaacctcaactcttgtcactttataagccagccatactaaactacttgattcactggatgggctgtgttgtctccatccttgactgatatgtactactattcccctacgtggaatatacccatttcttctagtttgttacctgcccaggtgacatctctggaaagacttccctaatgtcttactcccccagggttgcatagttgtctcttttctgtttttataataccttgtatacatatatatatatagcattatgattgtttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtgaatacactaaagaccactgaattgtacagtttttaaaaggataaacttttggtgtttgaattagatatcagtaaagccattactaaacaattatagtcgatcaatatagttttatagggctgggcatggtggctcaggtctgtaatcccagcagtttgggaggccgaggtggatggattacaaggtcaggagttcgaccttggtcaggagcctggccaacatggtgaaaccccatctctactaaaaatacaaaaattagccaggtgtgttggtgtgagcctataatcccagctacttgggaggctgaggcaggataattgattggacccgggaggcggaggttgcagtgagccgagatcatgccactgcactccagcctgggcaacagagcaaaatttcgtctcagaaaaaaaaaaaatttagttttacagtacctagaacattgtgcatatttgaatgtcagtaggatgatccagcaatctgtttgatgtcatagtgccagattcaggacttctattccatgttttgattttgaagcagatttttaaaattaaaatctgatcttttagaagtagaagaactcaatcaacctacaaatattattgacttttcaatttgttaaatgtgcattgtttggccagtcatgtgctttgggaataaacttgcgaagtgcattgtttaagtcttataaattgatgaatggaggtgaaaaacaaatttctttttttttttttttgagacagggtttcactttgttgcccaggctggagtgaagtggcatgatctcggctcactgcaacctctgcctcctgggttaaagcaattctcacacctcagcctcctgagtagctgggattacaggcgcccgccaccacgcccggctgattttttgtatcttagtagagttggggtttcaccaagtttcccaggctggtctcgaacttctgagctctcaggcaatccacccatctcggcctcccaaagtgctaagattacaggcatgagccaccgcgcctggccagaaaacacatttctaacacgattgcactgtcgagttgggacacattggagcatattctgtctacagatgatttgaagatattttctccttttgttaccttcctcattacttatttaaatattgatctagaaatgcagtgatctgtgctgttgtcctagggaatgtttttctctcctgtttcactggattatatgaagattgggctgtttgttgtatgaatttagtaatattttaaaacataactgcatttcatctaaaaatcagttctgagctacagggaactaccgtaagagattttctcttatccatagttatgcgtggggtacaaaagaagtggtctctgtcggcaagaagagcttatgttgttcttttttccaggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggtaagttcttaaaggaaatctttgaatcttttttgtgtctaactagcagcaaaatgatccaggagaaaataagtaatggatttttaatgatatttaaaataatgagtctttttcaatggagtaaaacctcaattaacaaatgtaataatgtaaggaaatggatatgtctgtacaactcattttctgattgaggttaagtagtataactctttttgtttctctctggattgtttacagcttgttgtgataaatggagactgggattgagttaagcagaatttataagcgtttctttccatttgcagatggtccttatagttttctttttctttttctttctttattttattttttctgagatggagtctcactctgtcacccaggtagagtgcagtggcatgatcttggctcactgcagcctctgtctcctgggttcaagcaattctcctgcctcagcctcccgtgtagctgggattacaggcatccaccaccacacccggctgatttttgtattttttagtagagacggggttctaccatgttggccaggctggtctccaactcctgacctcaagtgaatcccccgcctcggcctcccaaagtgctgggattacaggcatgagccactgcgcccagccggtccttatagttttatagtacttcagcacattggctttatttgataatacctaaaatattctattaatatttctttcaattctttcttgccttgcttgtattctataccgatcacaatttaatctttctttgattcacaatctgacacaacttcaggggccctaagtgtgagtctgagttattgtaccatattgtgcataaagctttatgttagagtttgagttgcaattgtactggctcccagaaatccctggagctgctttctcctgtctccctcataggtttatcatgacgtttctcatgataaacggctcaatgccactttgctcatgtctctttgttttctcctacctttgctgtttgccttcacttctgtctgctacattggcaggacttgacttttttttttttttttttttttttttgacacagggttttactctgtcacccaggctggagtgtagtggcacgatctcagctctctgcaacccccgcctcccaggctcaggtgactctccaacctcagcctccttagtagctcagactacaggcacgtgccaccatacccggctaatttttgtatttttagtagagttggggtttcaccatgttgtctaggcttgtctcaaactcctggactcaggcgaaccacccacctcagcctcccagagtgctaggagtacaggcaggacttgatttttatagctacttggttgtgtttctgaccatctttaatgcttttaaaatttcatatgaacttgaggtttaccttgcagcaggagttctttccacctgtggaaaattccaattccttaaaagttctagttaacgaagttttagcatgggtttgtgtgtagctactttgtgttcatgtcacattctactgcagccttatgaacagaagggggtatttacatttttatggtgactaggtcttaaaatgagtgggctatcggaagtagaaatctgagctgtacagaaactttttactacaatattatacaactttagagatgttatctatgtaagaaatctgtttctttttgccaacaataatactgtactcttaagttttatattaccagtttggggtttcattcattcatttattttttgttgttgttgtttttgtttttttttgtttgtttgtttgtttgtttgagacagagtctcgctctgtcgcccaggctggagtgcagtggcgtgatctcggctcattgcaagctccgcctcccgggttcacgccgttctcctgcctcagcctcccgagtagctgggactacaggcgcccgccaccacgcccggctaattttttgtatttttaatagagacggggtttcaccgtgttagccaggatggtctcgatctcctgactttgtgatccgcccgccttggcctcccaaagtgctgggattacaggcttgagccaccacgcctggcctcattcatttatttttgggatggagttttgctcttgttgcccaagctggagtgcagtggcacaatctcggctcctccgcctcccaggttcaagtaattctcctgtctcagcctcccaagtagcggggattacaggcatgcaccaccatacctggctaattttgtatttttaaaagagatggggttttgccatgtcggtcaggcaggtctcaaactcctgacctcaagtgatccacctgcctcggcctcccaaagtgctgggattacaggcgtgggccacagcacccagccaggcttcttttatttaaagcgaaagtaatgttcatgctttctctttttttttttttttttttttttttttgagacaaagtctcactctttcgcccaggctggagtgcactggcgcgatcttggctcactgcaatctctgcctcccgagttcaagcgactctcctgcctcagcctcctgagtagctgggattacaggcacacgccaccacacccggctaatttttgtatttttagtagagttggggcttcaccatgttggctaggctggccttgaactcttggcttcaggtgatccgcccatccgcccacctccgcctcccaaagtgctgggattacaggtgtgagccactgcgcctggccctatttttaacttttttcttggtttgtttagatggagtcttgctctgtcacccaggctggagtgcagtggtgcagtctcagctcactgcagcctctgcctcccaggttcaagcaattctcctgcctcagcctcctgaaacattttttaatgacatagtattttaatacactttccacagataggccttaactgattgttccaatgctatctcctggtcgtttggttgagaagtagaatagaaactatcctatatgaaatatttttaagttagcacagtaatgttcttgcctttgactagtttaacatatagtattttttctttttgatcatttgataatggaatatgaggtcttctagggaattgatctaaaataactctttattttaacaggttacttttgatccagaagtatttttcaacatattacttcctcctatcatattttatgcaggttatagcctgaaaagggtaagtccttttgtctttcatatactttgaataatcttaaactcagtgggctttgtaatatttgacacttcagaaatgggctgttctttccagattaccctcctttctcctctccttatcctttttagatgctgaaatttatacctgtacaagaatgctttctcttatttatcctagtgaataatgcatttaatcctagtgaataatgcatttcatattagcatagcatagaaaaccttttctttttcaagtaactggtaagtattctaacagtgtaactttttttttttttgtcagagacatttttttcgaaatcttgggtctatcctagcatacgcttttcttggaacagcaatttcttgtttcgttattgggtaagtattttaagcttaaaatactttgtggccttcaaattataattttaaaataatatatttttgatttatgcagtgttatatattcctgactgggtctaaagacttttgcaatattcacgtaggtaataagttgtttgaattttccttaaggccaaagtattaccatatttcaatgacatgaattaaatttgggattagtcacaaagtactacagtaaacccatcttcttactttatcctaatttttttaacagttgatatttttttctaaagtaggactgtgtttattgaacaggtcaataatgtatggctgtgtaacgctgatgaaggtaacgggacaacttgcaggagatttttactttacagattgcctactgtttggtgccattgtatcagcaactgatccaggtatgttttatatgagtggagtttacatacttgaggtgcattgttttgcagtcaaatacatgtgggtttttctttctttgaggtgtagaattcatgattagatacttccttagtactatactttctaattgtggaggaaaaaacaaaattcatgattccttttggcttcagcacaaatttgttttccttttcctttttttttttttaattacatttgcctattactggtccacaagttgacgctgtttcaacaaggactataaggtactttcttcagaaattcatgttggtctttatccctagtgattgagtatagaagatgaactagattatagattagtttaaatgggtaataattatatatttcctttcaagcttttagaaaaccagttccctaaaaatctttcagtttctattcagctgtatgcatttaacagtaagaaaaaatgtttacaaatgattgttagaaggcagttgtgctaatacaggtttgatttggagtcattggaggactttaatatacattaaagaattgtttttataaaattggctttatgattatacagttgtttgtttaatattaacacaacttgttcccctgtgctttaagtgtcagatcttctaaaagttgtgttccagaatgaatttaattgtactgagttaggttttagttttcctgatagagtattggtaaacttaacagctacattcaaattaggaatttggagaagacacagaatggaaaggttggggtaggaacatagactgatgtttttgaactaaggatggaaattttcttttagcatgctttaagactttcgttgaagctcattttgttttactttttaaccttgtaagttaatcatctttaattgtcatccagcacaattaaaggtagaatcctaaggttatctctgcattcctgtgttaactctgataacacagggctttatgggaaggagaaaaatgtgttcaatactctatgagagatattttggctggacacagtggctcatgcatataaatgccagtgctttgggaggccgagatggtaggatcacttgagactgtgagttcgagaccagcctaggcaacacagtgacaccctgtctctacaaaaaaaaagaaaaaaaatagctgagcatgggagtgcgtgcctgtagtcctagctacttgggaggctgaggtgggaggaccacttgagcctaggagtttgaggctgcagtgagctgcagtgaggctgcagtctcattctgcctgggcgagaagggcgagaccctgtctccaaaaaaaaaaaaaaaaaaaaaaaaaaagattttaaaggattagttagagggccattttagagaatttgtgtagtttagcatttttaaaactggaaattaaattgcttccttaaagaccaccaaagctgtcctctcattgtttgtagctactcccattatcaacatgaaggtaggatggttttggcaaggagccggtggtctctggtttctgtgtcctttcattataagcaaggttctcaacttttcaaatcctatgagaaatctgagtccatgagtccattggcttggctacattatttcaactttctggttttgtttgataggactattgcctgaatagcccaagcaaatatcttttgcttatataaagttggactgttatttttttctgaattatgtaagtacttgccccatttctattattttaccattgttagcttgctcttagaagggtgaggtatgggtttcttttagaaattctgcactattgctctactctccttctccccctctcttgatgagctttggtatcagtatattccagctgcaatgctttgtagtagaaactatatcttttaaaatatactggacatggtggctcatgtctttaatcccagtgactcaggaggctgaggcaggaggatcacttgaacctaggggtttgaggctgcagtgaactgtgattgtgccactgtactccagcctgagtgacaaagcaagaccctgtctcttaaaaaaaattaaataaataaaatgcaagtttcttgtttttatgattggcatttgaaaaggctctctcagctgggtctggtggctcacgcttgtaatcccagccctttgggaggctgagacaggtggatcatgaggtcaggagattgagaccatcctgactaacacggtaaaactctgtctctactaaaaatacaaaaaaaattagccaggtgttctggcgggcgcctgtagtcccagctactcgggaggctgaagcaggagaatggcgtgaacccgggaggcggggcttgcagtgagccgagattgcgccactgcactccagtctgggcgacagagcaagactccatctcaaaaaaaaaaaaaaaaaaaaaaccaaaaggctcacctctcgttatattaatttttcatgtccgcttgggtttctttagtaactgagctatgtgacttagtaattaaagttataatataacttcaatttcatctgattttctaagatttctcatataattgctttcctaaaaggaggatttattgtttttcttcttaagctggaatattctcatagttggctccttattaagacaaatccagcagctgtaattctggtcataaattttaccccaaccaaaaactaaacctatgttttcatttcctactgtctttgctaaacctttgtgcttgcaatttgtaagtcaagtacaaatgagttgtaaggcccaaagaaacaaagtttgcaacattagattcttttcataatattcttcttcattaaagattaatgactacatggtctataagaaattctgaatatattctttgtgggaaagaaatgtacaagacacgattattaacatctgcgtgaagaatgtaggccaactcagttcttcagggttactttcagccatttttaagagagagaggagaagtttgtgcaggtacacaattagaaaagaaaaatatttatataaaattacggggtctttaatatggtaagagaatgtttattaggattgaattctaggaggaaatgaatttctaaataactctcagagtcatctactgaggagaatatgttatatttgtaatgtctaagtattcctctgactctttttacttactagtgactgttcttgctatattccacgagcttcaagttgatgttgaactctatgcacttctttttggtgaaagtgtcctcaatgatgctgttgccatagtgctgtcctcgtaagtgtttgttttcttattatattctgaatattaagtgtgagggtactaggaactgaaagtcacttattgaataaagtacattatgaatggaaacatttggaagaatgaggcatttttttccctcttgaagaaatccatattttatagataaattggaaaatacagggaagagaaaaatatgtactgccaccacctaaagacaattactgtaaacattctagaacatttccttttctatgtatgatattgttacatagttgtgattgtagtgtctgtataattttgtattcggttttaacattacaacatgagcatttaattttttaaattagatttaatattttctttcttttttttttttggagataagagtctcactctatcacacaggctggagtgcagtggcgtgatctcggctcagtgcaacctctgcctcccaggttcaagtgattctcctgcctcagcctcccgagtagctgggattataggcacccgccaccatgcccggctaatttttgtattttagtagagatgggttttcaccatgttgcccaggctggtcttctcctgacctcaggtgatccacctacctcgatttcccaaagtgctgggattacaggcgtgagccactgtgcccggccttaattttttctgaatacataatatattcacgtggctcataaattaaagtcatgtaaaaagttacacacagaaaattcacactcttacatctgtcctcatccacctgtccccctagttccttgtagataactttttttttttttttttgagacgaagtctcgctcctgtcccccaggctggagtgcaatggcacggtcttggctcactgcaacctctgcttcctgggttcaagtgattcttctgcctcagcctcctgagtagctgggattacaggctcctaccaccacgcccggctaatttttgtatttttagtagagacggggtttcaccatgttggccaggttggtctcaaactcccgacctcaggtgatctgcccgcctcggcctcccaaagtgctgagattacaggcgtgagccaccacgcccggcctagataaccatttttattagtctcttacctatcttagtatttctttattcaaatgcaggcacaaccgtgaataaatagtcttatttgcctctcatttcttatttttaaagttacatactgtctatcttctggagaactttgcatgtcaaaagagtgaatattctcattctttgcagctatatagtattctctgtgtgaactgcattattgtttatttgctcagtctcctatagcaggacatttgaagggtttttaatcctttgctgtcccaaaaggtgctgcagtgattaaccttgaacttaccttgttttatacatgtttaggtataatggtaggctgaatgtcccaaagtgagattggtaggtaggttaaagggtaaaatccatttgtaattttgttcgacattgttaaattgctcatcaaagaaattgtagcacttcgcactttcaccattaaattattggtctgtttcctcacagtttcgccagcagaatatttgtcaaacttttatatttttgctaacttgataattgagaaatatctcattgtagcttaatttgtgtttctcttatttgacataatcatttcaaaacatttttaatctctagaagtgttaatatatattatagatatgtagttatgtattacttataccaatttaattgcagacaattttgaatgagcaatattttttatctaattatagaaagtactatacatgttactataaggtgtttgcaggttgaagaatgagtctgaacctctgaggaattcaatcctgcctccctaatcttttttttttttttttttttttttttgagacagagctttgctctgtcacccaggctggggtgcagtggcgcaatatagactcactgcaacctccacctcccaggttcaagcaattctcctgcctcagcctcccgagtagctgggactacgggcatgtgccaccatgcctggctcatttttgtatatttagtaaagacggggtttcactgtgttggccaggctggtttcgaactcctgaccttaggtgatccacctgcctcggcctccccaagtgctagaattacaggcgtgagccaccatgcctggcccctgcctacctactcttattaggcaaatatctaactctataggcagttgcccttacttcataccagaactttctatgagagagaagtaagagcccttcacattttctctttatttttatttctctccttaattttcactttgttagttatgaaagaataaaacatcactggctctgttttgcatagcctgattgtcttctgcaaagttggaaattattatttctcagatgtaacattaatcccttaaacgttgtatgtgaagatatacaaaaggccatatccttttttgtgaatgcaatgtatgtaaatattaccccctccccaccatatttattgccagattttttttgcagctgtctgcaactaatataaatttaacttgagaaataaaacctaaaggctgtaactcatattgatactgaactttagcaccttcaatgatgataggtgcagaataagagttttgtattatttgaagtaagggagaaatggatagtatggttataaaaaatgttataaaaaatgaagcaacaaagattgttgaagcttccagtacgtaggtacatgagcgattaccagcactacaaagtaaagagagtaggtacaggcagtcacttttagcatcgattccctatcctagacaactattctactgttcagtcatcttactagtaactgttgtcttatcattgccctaatggcctaatggattaagagttagaaaatctctgttctggtcttatcttaaactgatgtgccctgtgccttagtttttcctattaataaaattgcctgtttcctgcatctttaggaacagttgattagcgttagaggaaaagataaaaaccctcattgaaagattttgagcttggagttataaataatctatttcctgcaacattaggaatagttgattagtgtgaaaggggtcaaaacctcattgaaagattttaagcttgggggtgtacataccagtgttggtgaagaataaatgctaaaaagagagagccggctgggcgcagtggctcatgcctgtgatcccagcacttcgggaggccgaggcgggcggatcacctgaggtcaggagttcgagaccagcctggccaacatggcaaaaccctgtctctactaaaaatacaaaaattagtcaggcgtggtggcacacgcctgtaatcccagctacctgggaggctgaggcaggagaatttcttgaacccaggaggcggaagttgcggtgacctgagatctcggcactgccctccagcctgagcaacggagcgagactgtctcaaaaaaaaaaaaaaaaagagagagagccctttccatagcatttctcacaaagggccatacttcttctcttgcagcctttctcaaacagggttttctgtgagagaatgaagccttataggaaacaatttgagtgagtcttttctcatttcacctaaggatgatagcgagctagtgccattttaaatttgtaagagataatacgttaactcattacaacctcagtgggattctggtggagaaggactgtatcttgagaggaacataacagagaaattgttagctctgtgttttaatagaattgaaaaaatgagttactgcccaaaagctgaagggaaagcagttgtgtgctcgctgtgggagtttactagctggaatgatcagtggtatcatgctcatcattcttcatttaccttttatgtgttttgaagtgggttagatgcagatagtctactttgtgttgaattttcttagtttgaggattatctactgtctgcattctgtgtaagcagctttgcatcaaaggggagggaacccctttttgaaggagttctgtttggcagttaacaggttaaggcaactcatcttgaaatttatgttggaggttgtttttgtttctgtctggtttttttttttcccaacttttattttaagttcaagggtacatgtgcaggatgtgcaggtttgttacataggtaaatatgtgccatggtggtttactgcacaggtcaacccatcacctagatattaagcacagcatccattagctattcttcctgaagcactgtttttttttttttttttttaacctattggagtagcagttattttattttattttattttattttttaaaataatgcttttaatccagtgagggtgaagtgaaattgactccctcatacatggctgcatgaggtagatctatatgtatattgatatattatgttagatacggtatatgtagttagagataaagtatacgttgcatagtattccactgaatggattaccgtgattagcctggggacctaaatccatattagtttaaaatatgttgtttacagtcatttatatttttatgaaagaagatgtacagagagacaacaaacgtgataaactgtttaacttcactaattaccagagatacatgctaggatcagtagccatttctacctattcaattaacaagacataacttttttttttgagacagagttttgctctcgtcacccaggctggagtacaatggcgcggtcttggctcactgctacctccgcctcccaggttcaagcgattctcctgccttagcctcccgagtagctgggattacaggtgcacaccaccatgcccagctaatttttgtatttttagtagaggtggggtttcaccgtgttggccaggctggtctcgaactcccaacctcaggtgatccgtccgcctcggcctcccaaagtgctgggatgataggcaggagccactgtgctcggccagaattgttaatgataatgacatagtacagtcattcttagccaggggcaatttgccaccccctcaccacacacacacaggagatatttgacagtgtctgggggcattttggctgtcatcaatgggggggggttcctattgacatggcctagtgggtagaagttttcaatgcacaggacagcattcccctcaccccacccccatcacagccaacaaataaatacctggccacaaatatcaataatgctgtggttgagaaaccctggtgttgtaaaactagaccactcatacattgttaacattgaaattggtattaccttttatcactatttatgataatgttaaaatatgtttgtggcaaaaatttaaagcatttgactcaaaaagtagaaaattcctgaaatttcagctcagaaataaccactattaggattttaatccagactttttccgttaagatagtagtatacatataaatatgttaataatctttataaacaataaaggcatagtagtatatatacttttctgtagcttttttacttggatattatactatattaatacctctattatcacattgggtggatgcattacaaatttacctctccaatcccctattgattgattaatatttggtattttctaatattgtattatgactagcatggcagtgagcatatttatgtgtaaatctttgtgaatccttgtaaatatttctgtagggtattttttaggagtagaattgctaggtcaatggtatgatcattaaaaaaattgggagatattatcatatttccctccaaaagtgtaatggagaccttttggaaggcagtggagcaacatgtaaaatgagccataggtatagtaatagtctatttttagaaatatagtgcaaggaatagtctaaaatatataaaaagcaagaagatgttctttcagttatttatagtagcaaaaatagtagaagcaactttcaaatgtctaacaatgaggaaatggttgaataaattgtgctgtatccatttggaccattgtgaagtcttaaaaactgtagttataaagactatgaatttttttttttcttgagatggaattttgttcttactgcccaggctggagtgcaatggcatgatgtcagctcactgcaacctccacctcccgggttcatgaggttcacctgccttagcctcccaagtagctgggattacaggcatgcaccaccatgcccggctaattttgtatttttatttttagtagagacggagtttctccatgttggtcaggctggtctcgaactccccatctcaggtgatccgcctgcctcggcctcccaaagtgctgggattacaggcatgagccactgcgtccggccaagactatgaatatttttatgtcattgtcagttaaaaaagcataattcaaaaccacacattcactgtgattacagctaaataagaattagcatgcatgtaacacaaagaggggaaaggaatacagaaggaaaataaaatcgatctatcagggtagtggaatgatgggaagatttttccacctaaactgtacattttattactttcagggtttaaaaaaaagtattcataaaaaatgctactgcctcaagataaaatatcaattgatacagaaaagatgagttaagatttcaatccagaggctagtgtctgcctaagagagaacaaaacgagcctgtcatctgttctcagcccatcatgtttcccatgtgtccttatacattttaatgattaaagaatgaaataatgattagtgtgaatcttgaatttacatgaactaatccagggaaagcaacctcaggaggcatggcataggtattttgttccagagagcattttgaaaaataccaccaaagaaaaagaagattgtatagcaatttttttcttttctccagccagttactgtattttcatgttataatgaaatcagatctcatttatggtagtgggaccctttatatatatgtaggtaaggtagcatggtgttaaaggccatttcatatttatcaaaatgatatcaaatctactgttccaaaatgatctggttgctttgcacatttaaacgtaaatgtttaacattttcaatttagagtgagtctcagaaatttctggatcccattatcagaaattaatattagtgctatatttcaataaaataagtacaaattaggagattttagtttgatcttagattttttttttaacctgggagatatgaaaagaacttgtatatggtatagcaaacatttttcagccttgaatcagaaaaaaacattgcagcaaccacagggagaattcattatatttttaggaatgtgtttttccttcttttctttgacgtgatttgtatgatgttgttgagtctggactttttataatgctggtctctcaattaactgagatgagaactgatttagtaacggtaagcaccgttgccaaagacctgctggcaacagcaattttctcaggcatttctatttcctggggtggtaactgttacaaaagaagctttttcagaccaggtttggactgtgagttcaagatggagagcatctcctataattgcctgtcttggcctggtatagagtgactttctttcagaagtttgaggtggaagatccagctggttatgctgaaagtactgttgagtggattctaattccttgggaggtctttcgagtgctttttcctataatagtccatttcagtgaatgaatagatattaggcatttggcccattctagaattctaaaagttggaagggtccttcagttacctttttttctcataggaaaaacaaaatgtgactgggttgagtattgaataatgttctttatgttcttatgcctctactggaaacaagtgggatttttcattagtttgttcacattagtatgttaaggctttcggacactcagtactagtaattctgaaacagaatcacaaaagaataatactgcacagtatcttggggatgggggaaaaagcttggtgcaattttcatatagaggattttacaatgttctaccccccccccgaaattaacatttaagggaaagccaagttttcttgctagccagatacattgcaggatttttgggtaattttgtccttattttggcaattccaatcgaaagcttgtttttcttctccctctaatttcatctttcaagctctatactacataatgtttttttaaaagtaaaggttgttttcagaagtaaaagcagtctctcttctgtagctcaatagtggcataccagccagctggagacaacagtcacacctttgatgtcacagcgatgttcaagtctattgggatcttccttggaatcttcagtggatcttttgcaatgggtgctgctactggagtggtgacagctttaatatccttttgttatatttatcttttcttgttaacataatatagtagttgaatgctgtattccgttgtttttcctagttctatgattagaattatgttagaattattaatcttataactaagtacttggtttgaaaacattaagcaacagtctttgccaataaataaataaaagaactgtattgttctgcatagggtttggtgccctaaaactttcactgcaagtgtataattagagatgatatctctctgagggtgaattttatagttgtagattaaatagctgtaaaggtagacatattccaaagagcctctgggtgttctgtgttgctggtcagcctggcagtcttttgctctttgtttaataggacaaataggaaatgtacaacagcgacgccgaatgaacaaaatgtgtttccttggttaggatatgtaagagttcatctcagctctcccgattttaaactttgtgctctagagccctggacgggaagcccaaaggacctgagttgtagtcctggtactaccacttagtcaagttattcttgtgttcatgcaaaggccattttatcccggacttcaccaccatgcaatatatccatgtcataaaactgcacttgtgcatcctgaatctataaaaacaaattttatttttatttatttatttgttttttgggacgggggcgcactcgtttcgcccaggctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcctcagcctcccaagtagctgggattacaggtgcgcaacaccacacccagcaagtttttttatatttttagtagagatggggtttcatcatgtcggccaggctgatctcgaactcctgacgtcaagtgatccacccacctcggcctcccaaagtgctgggattacaggcatgagccaccgtgcccggcctaaaaacatgttttaaaccccccacccaaaacaaaaagccagaaggcatgtctggatcacctgctacatgtgctgtgctctgtgtatcaaagctaaagaagacaaacatgacctctgcctccctggtgctttcgatatagtggcagacacaaacatgctagaagctttgacacttcacctctttggatctcagtgtaggaaattggagggtggggacggtaggaaagaggagtgggactagatgatgtctaaagagtttccagctctggcctggtgcagtggctcgtgcctgtaatcctagcactttgggaggccatggcgggcggatcacaaggtcgggagatcgagaccatcctggccaacacggtgaaaccccgtctctactaaaaattcaaaaaattagccgggcatggtggtgggcgcctgtagtcccagctactcgggaggctgaagcgggagaatggcatgaacccaggaggcggagcttgcagtgagccgagatggtgccactgcactccagcctgggcgacagtgcgagactccgtctcaaaaaaacaaaacaaaacaaaaaagtttccagctctaaaacttctatgatacttgtataaaacagatacgttattctttgtcaaggacttcttagtttggtatacttcagccttgtgctggaagaggcttcttttatggctttttataagtgaactgaggcataaagcagcagtaaaaagagttctgaaggtgatgccaagagtgatagtatctcttccccattacaagttccttgagggtagaaagtatatcttgttaatcattttgttgtagtgcctagttgtagaaatgactctagattctagcctgagattggtcgtaacttggcacaggcccttccactgtcagctaacaaatacttgttaaactagtataaagcagtgaagtgcctcaatttcttcatcatggaatgaatgctctatatcatagaagtggtagaggatcaaattcgtgtaaaatctcttggaaattatgtatttttataaatgtaaattgctacaattatggaagctgtctagctttgggtctcagattaatagaggtggcatgttatagatctgatctgttactcccgtctctatctatcctttactgcatggtttctggcaaggtgtgtgatacccgtgaaacaattggagtggctaagccgtaaggcttcctcactgaagggaaggcagctgactcctcagtaagatgctcattttaaaagtctccctattctggtggtaccttattctgagatttctgtgttagagaagctagagaacctttctttcatggttgccttgcttaaactgttattttttctagtcacacttttgtgttacaagatctcattactagccttaacagtcttacgtgacaaagttcaccaaattacgggagttccagttgttggagacaggcctgttcttcttgatgtcctggagtaccttcctcttggctgaagcatggggcttcacaggtaggtgacttgctccctttgattgtcaacccttaaaaggagtgactttgccagtcaattttgctccaagtggatcagctccgttagtatttgaacatacttattgtggttgggatttaggttgttgctttagaacataaaaaaaaattttcagtggaagtggttcctcttaacaaagtaagtcacaaatgagaatttccagacaaagcctataatctactgtgaagaaagaacctcagtataaaaggtgggaaccatccttttatgtgaacttggaatttgttgtctttataggtgtagttgcagtattgttttgtggcatcacacaagcacattatacgtataataatttgtccacggagtctcagcatagaactaaacaggtaagaggaactttatagtttgtgaataggcttttccttctttcagcaaaatagaagtcttttttactaaaaaaaaaaaatagtctttgatctgttcaagatgctatctactcattttggctcctcttcctttgactctaaaagtaggtgggattggcaaaatgaagaatgacagcatttagggtggaaatagatcagcagaatagccagagactgttactattgtggcttcaataaccagtgaagtagcttccctttttctcagtgttttcccaatttaatggcttttaaggggaatgttttggaagctcactctggttttacttgaactactgctgtgtgacgtagataaggttaacttctgatctgaccagacctactaagagatgacataaagaaaattaacttctgatattactagaccttctaagacatgacataggtaagattagcttctgatctgattagacctactaagagaagataaacttccttcagtccgctcaggtgctgcaaagctactatgtttccaggaatgtcaggggactagtcagtggtctggttttatttggtactgaatgatcagttgtgcagggtatctgaagggaattataaaggagataggaatacaatttttccagtcttaggaggtatgtgggacaaatacatgaaaaaagtgtaatgtctggaatagaaataggtgcatacttgattatggctatagtgagaaacagaaggtttaaattttgccaaatgacaagaaggttgtgggattcgcctgaaaaggagtggtgctaaaagcaggagcaacagtatttcttcttccggctagagccacaaatcaagtttatgacctatgcttttccccagcccctcaaaagagattaggctttttcccccaagtgtatacattagggctacaaatcctttttacaaattaattcagtgcaataagtaaagagaagaaaatcagctggcagggggcggtgggggaggggagtcagcatttttccaggtcgtgggaagggaataaaaaacaagaacaggccgggcgctgtggctcacgcctgtaatcccagcattttgggaggccaaagcgggcggatcacccgaggtcagaagttcgagaccagcctggccaacatggtgaaaccccgtctctactaaaaatacaaaaattagccggatgtagtggcttgcgcctgtagtcccagctactcaggaggctgaggtagaagaatcgcttgaacccggaaggcggaggttgcagtgagctgagatcgtgccactgcactccagcctggatgacagagcgagactctgtctcaagaacaaacaaacaaacaacaaaaaactagaacagggtaagagcttccagtgttgttggtgatatgatatgaagcttatgtacatttaagaaatatgaggaataggaatcctagattatgtacttcagattatatgtcatagaagacatcagagaagtaggggaaatggtttgaggcttgaggatctggaaagtatcctagaagaaacagtacccttagaaggatggggaagatttaggaaggcctaggggaggcagtacagataaaggcaggaataaaaagaaggcagtaaagtgtagagcagagggtggcggactccagccctccggccacatccggcccttgccagtgagctaagcatggttttctttccatccatttttaattggttggcaaaagatcaaaagaagaatatgttgtgacccatgacagttatatgaaattcacatttccatgtccaccaataaaattttcttggcacacagccacacccattttttaaaatatatagtctatggctgcttttgtgcttcactggcagagtgaagtagttgtgacagagacttcttggcctgcaaatcctctcatgtttactctctggccattcatgggaaagtttgccgatccctatgttgcaaagtaaagctgggactctggagtcactgtattgttttaaatcctggttctactacttgctggctgtgtgaccaggaggaagttccataacttctctgtgcttcagttttgccatctttgaaaatggagataataataatacctacctcactgagtttttgtgggattaaaacgagataatgcatatgaagtccttagtatagtatcagacacacggtaaaaactgaaaaaggtatagctgttatcattagtataaataagtagtaataatagcatattaaatcatttaaagaaaaataaatatacgcttacttattttaatttttattctcatttttgggtaataaggcaaccctggtttaaagagattaactaatttgcccaaagccacacagccagcaaaggggaagacagggctcaagcctaagcattttcattcttaagcccatgttcttaaccactattctgttatgtgtcagagggctcattgtagataactctggtggccagagggacacgagattatgaagggccttaacttcattcagcaagtatcatataccattgccaaggctatgatgtgaatgggatggggcaggcgggcagcagggtttagttccccccacagatagttctgctatcctacagatcgatctcttccacaatgtggaagcccctatctgtaggacgcttactccctatacgagaggaagacccacgcaaaaagtgaagtcacagggcaagctgggagtacgagagttctcacgaagcactctatgctaggatcagaaagttgaaatgaatcttatagcttgcaagaggaaagtatcttgaaactatcagttttagagattcattggtttgggggagctggaggatgagggatggttagaggtcctttctcatcattatgggtaggaagtgatgaaagtttgactaaggcagtagcagggacacaggaacattaaaaaaaactgacagtttggaggaagaggagaggaataattgaagatggggctttgaagaagggaagctgttaggggaaatgagggggcaacattcctggctttttctgcaggactagaaatgtcgtctccacatttgctcccttctgaaccacatattttgtgtgtatgcatgaagtttatatatatgagtgtctgttttaatatcttagtaatactcatgctttcaaattatgtaactttatttgctggactaatcttttacaatttcgtttcagttgtttgagcttctcaatttcttggcagagaatttcatcttctcctacatggggctgacactgttcaccttccagaaccatgtctttaacccaacatttgtagtaggagcatttgtatcctttattatgtgttttattttgaaaatatttttaattgagattttcatgtgggttttgagtatgtggttcataagaatacatttaaatatatacagttttcctctgagtaaaacaaataaggattccagctcttttttctagtctatttattttattatattctatttcaatttgtggttattgcacaaataatgttgacagattaaaatgacagacaagtgtcccactgttctgccaaccccaaaagataagtgttttccctttattactacagggaaggagaggttggatactggggagcagttagcagtctatgccacagggcagaaggcgaaagataaggaaacgttgaatgaggccactttctttctctttctctccctcccccaacccctctctctccctctctctttctctcatatatatacaaagagtcttataaaataaaaaccccaacctgggcaatgtagcaagaccccatctttacaaacaaaattttaaaaactagccaggtatggtggttcatgcctgtagtctaagctacttgggagggtaaggtggaaggatcccttgagcctaggagtttgaggctgcagtgagctgtgattgggtcactgcagtccagactgggtgacaaagggagaccctgtctcaaaaaaaaaaaaaccaaaaaaccaaaaaacagttggaaggaagaaactgagtatatgaaagagaggaggcaatagtgaaagcctcttgagaaggcaggaatgaaatccaaagcatgtagagagaaattttgccttcactggaaggagagacaactccaccatgactacaggagaggatagggtatgtagaaatgaaggcacatttgtaagatggagccatcctctctgatggcttctatgtttatctgttaagtaggaggtgagatcatctgctgagagtaagatagggagttatctattgtgtaacaaattaccttaaatttagcagcttaaaacaacagacagttattatctcacacagtttctgagggtcaggaatcctggagcagctcatctgggtgattctggctccaggatctcttaagaggtcgcagttgtgctcttggctgggactgcaccttctcaagacttgactagggccagggaatccactgcaagctcactcaactcacatcactgtcagcaagaggcttctattcttcacgtggatatctccatagggcagcttacaacatggcttcttcccccaaactgagtgagctgagagagccctaaaatgaaagccgaagtgccttttgtaacctaatctttgaagaggcataccagcgtcacttccataatattctgttggttatacagaccaacctggtacagtgtgggtggggactacacaagggtgtgaatactaagaggcagggatggttagggactatcttgggggatggcttacacagatcatagggattttgaggaagatggaggttcgtgaaatagttgttgtagagagtgggagaataagttgaccaaagaaactcaacaggactgctaagaagtactagggatccattgtgtttgagaaataggaattagcagtagaaccaatctgccccattgaatgagtttgtccagcagtacttactgtaagcatggaaaaaagagatagttggctccttccaggtttggagttttttcaagtgggtgcaatgaaaacagaaggacaagagatcatagtgttattacatgactgatgcactctaaacacttcatttaatgtttaacattaaaaggtgttattaacatgatgataagaagggaagtgaggaaagaagacattgtttaaggaaagaatatagggatctttggactgaaggtcccagtgctatggaggaatgatcagagtgggatagttgaacacaaaatatggaaggagcaattgtggtcagtgggaatgtttgaataaggaatttttaaaagaaatattttaaaacctcacatcagaatgaagattctgccaaagagattagtggaagtttttttttttttaattaaaactctagataggatctctgttagaaagcgaagtattactgaaatactattctgcagagccttagtctgtgaatgaactttaggcaaaaaagataaagtactgttaataagagaagttcttagctgaaagataaccatgagatcagtaacttaatgtcctgctagtcttggagaaaatttggagcagtaaagtggctcgatccactatacttagtctggaaacaaagctaaatattctctgtaggtttctgagtctgttaggaattaaaattcctcaatacaaaatcctaccatgaaaatggcctcgtaacaggagagagttgctctatttctggctatgttagttaggacataggttggtttcatgtgaaaagactcaaactaatccaggtttaaacaacatagaaatttctttcttatctaaaaatctgaactggtatggcagttctgctgcatagggtcatcagggactgaagcaatattgttgctaacatccttagggacttgctgttgttcttgtgatccaacgtggctcacccctgtctgcccgttgccttgaagggcttgacccagaatgtgcacacgtcccttccacttaacatcattgattacacctactcacaagggaggctaggagttatatactttatctgggtggctgcataaagatgaaagggaggagtgccaactaccaaggaagaaagcaagaacagatgttggggagaactagcagtcactgccacgttggcccacatgtttcgtggttacattttcttttctttttagggaatcactttttaaaataaatgtttgattttagaatagttttaggtttacagaaaaattgtgaagataatacagaaagttctcatatgccccgcactcagtttcccctattattaacatattagcatggtacatttgtcacagtgaatgaactaatattgatattactaactaacgtttgaactttattctgattcccatagtttttccctaatgtcctttttctattccagggtcccatccaggataccacattacatttagttgtcatgtccccttaggctctgcctgactgtgacagtttctcatatgtgttcattgtttttggtgacccttgacagtgttgaggggtactagccatgtgttttgtagaatgtcctgcagttggaacttgtctgatattttccccatgattagactggagttacatgttctttgggaggaagaccacagaggtaaaatgccattctcatcacattatatgaagggtatatacttaataatgttgacgatagtcttaatcacttggttgagatagtgtttgtcagatttatccattataaagttacacattccccccccttcccccgccatgttgtactgcgtggaaggaagttgctatgagcaaggattgaggaatggggagttaggttccacctccttgaggacagagtatcagcaaaattatttggaatttttcacacaggagatttatctattcttcctcatttattgttttattcagtcattttttaattattattacttttttttttgagacagaatttcactcttgttgcccagactggagtgcaatggcatgatctcagcctactgcaacctccgcctcccgggtccaggcgattttcctgtctcatcctcctgagtagctgagattacaggcatgatctgagattacaggcatgcgccaccacgcccggctaatttttatattttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaacttttttattttcttgctgaaactgttccagcttggccattgagagctcttttggcaggctctcctgtgtgcctttgatatatcctcatcattgtttttaatttttatcttcatcattgtttttaattttttttttttgagtacttccttactccctggaactataagatgcttcaggctcatcttgtatctgttctggctcagcccaagaattggccatttctccaagaagtcctggttccttttattggagaatagtattagaaaccaaaatctgagcactaggtgtgctcagtgttacttggtgtctttgcttctaggccgtctcagctgacagattgcttctaggctctctcagctgacagagcaaggagttagatatgtatatatctatatatccatatatgtagatatatatactaactcatatatacacatatatctatacatatttctgcatataaccatctgtatctctgttaagctcaatatgggttcatactgatgtctccaactttaattcattaccacatggatgattctggcctcctcctctttctgaactgtaaactcccattctaacagtaagaaaccttgttgtcaccacttgccatccatttacctaattgttcagtttcagtatacatgtataatagtttcagaattgttaaccagtgttcccatgggaaacagctttgtcatgagcatagaatgcttttgtgcagtgtcttctgtctttagtcttacagattcttctgttttccaaagttacttagaccaacaccattccccctaccttgtttgttttgagacagggtctcgctcttgtcacccaggctggagtgcagtggcacgatctcagctcactgcagcctccatctcctgggttcaagcaattctcgtgcctcagccaccagagtagctgggattacaggtgtacaccaccacacccggctcatttttgtatttttaatagagacaggtttttgccatgatggccaggctggtcttgaactcctggcctcaagctatcctcccgccccggtctcccaaaatgctgggattacaagtgtgagccaccatgtctggccttgttctgtttttaatcttagattttcccttatatttttctcaggaaatgggatggagactgtatcgtgactcctgaaataaaaattgccatcataaagcaggagtcccatagacagcaaactggagaaaaagatactaaaattggtttctagttaaaaccaatctgaattcacattaaactttccctttgaagcaagttggaagtataaacttagtggagtacagtgggactggtagccattttagtgctgtgaggtggtgattcagctgcccttttctttgttctgaggaaggaaggggaagttttctcagtattactcttcttcctaccaacactgacaatgaaagtgaattaacctattctattaataatcttaaaagtatagtaaagaaactgcttttaaacgtgtttctcttaatctagtaaatttcctgcatgttacacttgctctgtctgatttggtagcaactagccaaatgtgattattttaatttgaagtaattaaaatgaaataaattttcagttccttgatcactctagccacatttcaggtgctcaccaaattggacagttcagatatagaaaatttccatcattgcagaaagttctgttggacagtgttatgttagacaatggaaccaagagactgtgtgttagaaactgagttccctaaaatagtctttcaccatcttgagtgtatagtctaaataatattaatagtaaaatgaaatgatccttaacctattaataattttaggttgctattttcttgggaagagctgccaatatttaccccttgtccctcttacttaatttgggtagaagaagtaagattggatcaaattttcaacacatgatgatgtttgctggtaagttgtaactttcttctcttgcccacttcaagcaaccattcacaatgcgtgtgccagcttgatgtaacactgagatgttatgctggtcatataatactcctttatttttatattatttatttatttagagacactgtttcactctgtcgcccaggctgtagtgcagtggcacgatcttggctcactgcaacctctgcctcccaggttcaagcaattctcgtgcctcagcctcccaagtagctgggattacaaggcatgcaccaatatgcctggctaatttttgtatttttagtagagatggggtttcgccatgttggccaggctggtcacgaactcctgacctcaagtaatccacccaccttggcctttcaaagtgctaggattataggcatgaggcaccacgcctggcctataatactcctttaaacattgaagttgcatccttgaatagaaaaagaaaatgtatatatatatatatatatatatatatatatatatatatatatatatatatatatatatagtgtcccattcccttctgtgggaatttttcatattctgattccaaatccttggttcagaattatgtcatacaaagtgagaaagataaggatgaagtcattttcaaacaaaaaccagtaggtgaatgtatagcagttcttttcataattgccaaaacctggaaacaacccacttgtctgtctctcagtggtcaaatagctaatcaaactgtgatacatccatgctatggaatactactgtgcactaaaaagaacaaacaatttacccatacagcatggatgaatctcagaggcattatgctaagtgcaagaagccagtcttgaaaggttacctgctgtgtgattccctttatatgacattcacaaaaagacaaagtcgtagcgatggggaatgcatcagtggttgccaggggtttgatggagtgacaagaggttagactaaaaaagggtaatacaaagaaatttgacagggggagggatgatgaaaccattctgtgtcttgattgtagtagtagtcacacacacctctatgaatttgccaatattcatgtggctatagaccaaaaagagtgaattttactgtttgtaaatgaaaagtgaatttaaaaaaattactgaaacatcaatgcatgtcagtaagtaacatacacaaattctatttctgtttgtactttttttttttttccgagatggagtcttgctctgtcactcaggttggagtgcagtggtacaatctcagctcactgtaacctctgcctccctggttcaagcaattctgcctcagcctcccaagtagctgggattacaggcatgcgccatcatggctggctgatttttgtatttttagtagagatggggtttcggcatgttggtcaggctggtctcgaactcctgacctcaggtgatctgcccacctcggcctcccaaagtgctgggattacaggtgtgagccaccatgcacagcctggacatatttaagtatgttaatatttactgcatatttgttcacatgcttctaagtttttagaacgtgctttcttgctctgaatttatgaagcttgcattggtaatgagttattgaagaaataccttttctgttcccctgtaggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcaggtaagtactaactagagacctcattttaagattaaattttaatttggtttatttttctgcctgttttcaatttttaatctttggagaatctgtaatgttttattttttccttttaaaaagtatgtaatatatagtacagaaaaaggaaaatatatatgcaaaagaaaaattcattgttaagactttgagggatatctttccagatcttttgctatacatgatatatatttttgacaaaaaggggcaacactgaaggtactcttgtagcctgatttttaaatgtaatatagcatggacatttacattgtaaatatatttacatcattgctttaatggctgcatatgtcctgatttacttaatcaaaaccctgttgttggacttttgtattgtttctaggattttgctattaccattaccatttgaggattttgctgttactattaccgttaacgatgtgaacattcttaaatgtatacaccactgtgtacttgtttgattattttttagaatgcatgtctagaaatgaaattgcttgctcaaaaggatatgtatatatttaaggcttttgatcaatatcaccaggtcagataaaaaatttgccttccacctgcaatgtatgagacaatgcggtttactccaaccctaatcactactagatattatcatttttctcatcagcactgtttttaacctaacaatccaaagccgagatcgtgaggtcttagtcttgaatgtgtaccagttaatgtattcaatttgaaagctcccttgtatctcaagagttctgcatttgtttccatggatacagcagcctatgctgctaaagcctttgtagatttgagttctgtgtttggctgaaacttcatagacattaagagctaccaagcttccagaatacataggactcattagagaaaacagtatttcacactttatagatcctgtcctccatttttttaaattctattacaccttttttaagacttctaaaaaccagccagccctaaatcacactttgaatgttgttgttattgtcttaatttctctttactattcaaatctcttataatttctgtgcttttattgtgcatagtataaaatacacaaaaataatgttcttataaccttaattattactttagggaggacctggcatttattgaacacttactatgtgctgggcattgtgctaagtacattttacatatttatccaaacatgataactccattttacaagggatgaaatagaggcttagaaaggttctgagttgttcaaggtcatctggataattaaatggcaggcagaggagcctccagtctttcttaatttttttagaaattaatttcatcaaataatggtcatggtacattttgaaaggacacagttcctttcttttctcaagagcttgtagatgaagactttccctcattgtcctaaggataacaaaattaaatgtaagaacaaaccaaacaaaatatctacgcttaccatccccgcaaaaagaaaagacaaaaacgtacctactcacacaaaatttaatctacatcactagctgtcaaagctctttggccgcatagtgcctgtcctgtaacatagttggtcacttaattataatattgtcttatagtcttaggttacttcttattgccttcttgttttattggcattattcttggcctcttcgtgaacaggggctgtattttaagcttttcttccctccccccaaatttgtctagtacaattttaagggcactgcaaagtcctgaaagtttaagattcatgcagacttagacttggctttgagttcttgccccttcactgatgaattctgtgatctttggcaagttctttaaccttttaaagcctcggtttcctcatctgtaacatgtatgttatagtacctacctccttgggttgttgtaaggattcagtgagctaatatctgtaaagttcttagcacagcatttcaaattaccttttattcattcattcaataaacatttactgaacaccagccatgtgccgggcactgtaggttacaactcagtggttctttttttttttttgagacagagtcttgctctgtcgcttaggctggagtgcagtggtgcaatctcagctcgttgcaacctccgcctcccaggttcaagcaattctcctgcctcagcctcccaagtagctgggattacaggcatgcaccaccacacctggctaatttttgtatttttagtagatatggggtttcaccatgttggccaggctggtctcaaactcctggcctcaagtgattcgcccgcctcagcctcccaaagtattgggattacaggcatgagccatctcacccagcctcagtgcttcttaactggggagaattttgccccccgcccaagggacatttggcactttctggagacatttttggttgtcacaactggaagagggggcctctgctggcatctagtgagtagaggccaaggatgctgctaaacatgctacaatgcataggacaggctcctcaccacctgccaacagagaattatctaggccagaatgtcagtaatgctagggttaagaaatcctcctctagagaagcacagtgatcaaaataagatagaaaaggttcctcgactcataacatccatactttagtgagagaagacagacaataagctagtaacacataaatgaacctgataactgcagatgatattaaatgctgtgatgggaatcgggcaaggtactgtgatagtgactggggatgggggtgtttttgatacaaggaggccagggacggtttctttgagaggttatgtttgagttcagtcttacctacgtgactagatggtgccagttaaacagtcatcaggaagaagagcagtctaggcagagggaagagcaagttgtacaaatgtcctgaggaagggacaaacttggcctgttgaatgaacaggaaaaaaactctcatggccggagtatagtgactgaagggtagataggaagtgaggttggcaagatcctatggaagcaggggttctgcacacttaactgtcaagggccagagagtaaatatatcaggctttggaggccatatggtctgtctcagctactcaactctagtgtgaaagcagccctagacaatatataaatcaattggtgtggttgtatcccagtaaaactttatttacaaaaacagaagaggtgctgatgtggcctgtaggctgtactttgtggacccctaatgtatagtcttgtggaacatggtaagggatttggattttaaaatacaattggaaatcctggaggattttaaagcaagggagtgacatgaagtcatttacagtgtaaaaggttcactttagttgtcatgtgaacggtggatccacagtaaatttgaaacagccagctattcccatgtcctttcacatagtttgtgacagtcacatttctatcatttactacacatgctttgcacttctgcgtctctgagcctttgctcatactgttccctctgcctggaatgctctttcactgtcagtaaatgacacagctaagtgccacctccttttccctctgttcttttccctcggaaccactcttatgttggtgcaacattgggcctcttcattgtagcacttattttattcagtcttgtgataatattgttataagagctgccacttagtgttaatgtttcagatactcttttaaaagcttttcatacattttctcattaaatccttgcagcaactctgtgtggtggatattagccccattttccaggtgataaagtgatgatttataagactgcctcacttgactgagttcacacagctagaaagcagccaagtccagatttgaacccagagctccctgatagaagcccttagggattatgccctagttgtgttggtttcccccactagtctgtgagttccttgagggcaggggccatgtttaattcatttctatgccctgtgcctagtacagtgcctggcaaataataagtgctctataaatgtttattacattgacttagcttctaataatgtaccatctattacaagtgtgctatcttcaagaccactagatgtcactggagatgcataaatgtggttagagtttaatgtgactgagaagatgttaaaacagctcctggccattttaacaaaggaaaaatgagccattctttgaattatgaatctggtcatagcaatctgttttcaggtccttgaccatggttcccttgctttccagatgcagccttgcatcattttctcccttcagtgttatttgtgttctgggatgctactgctacagcttctagtactgctattttttctgtgttgtctgtagtagttaatttaatcaataaacatttgagcacctattgtgtgtcaggtactgtgctagactctggggatacagagatgaattgagacatggcctttaccctcaaggaactcacagtctttttggggagactgacaggtaaataactatactctactgtgctaagtatcataataaaggactgtagaaagtgctgcagatgcacagaggagaaaatgattctgcttgaaggggtcgtagaatggttactttggaacttgaaaatcgcttaaaaaatgagggaaagcacattgcagctggagagaacagcatgagcaaaggcatgggaggcacaggagaggatggatttggggagatgagcaggcaggtatagctagaatggggcatgtagaagagaatgatgggaaatgaggatggaaaagtaggttggagtggggtggggatgctagtttgtagagagtcttgaatgccccacaaaagacttcagacttgaccctctgggttgtaagccactctcagagtcctttgtcaagggagtaacacagcgagctctatgctggcgacagctgactctcggggagagcctggcagctggaaaagcttccacgacagagcccgtgagcctcaggatgagggctgcccttgagcagttgggatggaaaggagagaagacttgagagaccgtttagaggaggaatgaacagagtttgtgagtgcccgtgtttagggaatagagaggagccagagaactttgtagtgaagcttttccctgggatacagaaagcaggaattttaaacagataaaacaagagttgtgaagaagcaaggctaatgtctatccattagcctatgaaaaacctgtaattgggccctctcttcagtcatcgtaacagaatgttgccatgagagctgcgaagtgaattgcactgtgccatccttgtttttggagctagccagtaattcttatttagcaactggggcagtgctgctctccctgattccgcttcgagtggacctatattcagagaaaaaaaatgctgtttttttctgaaactggtaagtaagattgcaggaagagaatcatgggtacaccctgcttgccttagaatccaagctgttgctaaggaaagtggcaggagccaaaaatctgcatcaacagctatagagaagcaagaaaacattaaccattccatagcttctgtgttgagaaaagtagttgcctgacaatgtatatgtgtgaatagaccattttttggcttcaaaatctcatttgctctttgtctttctcctttagggttggtgttgattcagaccaagaacacttggtaaatatgcgtttttgttgttcctggcatttctgtcaaatgtgcagtcatttggaaagaaaacaatctactataaacttcaaccttctatttagatcctgtcctctttgcctcagctttggaggaatgatatcattcctggcttttctcactgctccatagagacaaaaccaagtttgccacagtgccatagtgtgtggttatcaagggtgacagctttcatgtctctgggccatcctgcctgggcttttgtcccagaggagagcagtcttttaagcactcctgggttttcgagtgactcctctggcacggggaggctttttccactttggtttgcgcatgaaggcttgtctctgatgtaagccccactccagctgctcttcctgtgtaactttcaaatcgaatgaccagcagctgccctagagaactgcctagaagcttttgaatcttcaaccagtcttccctgcctgctcagggaaacgcactttcttaccttgcccctcagccttggccacgtttccttgcttccttccttctgttgtgtcagtttctcagttgttgctatgaacttgagcccgttggactgaatgcattgtaactcactgccctctctagactgactacccttgtctggtattttccatctgtttttcaattgcttctgagcaccattgaatatgtgtctccatatcagacgttagatgagaaatcacagaaattagatttttgaacatggaaagcatctctttcaaaacacaatttttttcttgtcagaaacaaaccacagtcagtatatttgtcttcagggtgaggttaaaaaaaacatttctcagattcatttcctaaatgctaattttgttagctgttgagtgatgagtgtgaatgtatgtatgagatatagtaagtacttgactcttgtggtcagagccttaaagtagaattccatgggcttgacatacttgtaaaaaccaagctggataaattcccatgatgccgggctcctggtgtagtgtccaaggggtgataattcctcagtgcctcctccctgtgtgaaaacaagaataaagttaatcatgcagttcaaaagacaaatgctcgatcactgtgtaagtctccaccagctgtgtcacctgtgtaaccacagaggagaaatggaaaaggagtgacagggagagagccaggtaggtgagtgccagtcgtgacatacagaacaaaggaccgttttttttcccataccttcaaaaccctatggctgggccgggcatggtggctcacgcctgtaatcccagcatattgggaggccaaagcgggtggatcacacgaggtcaggaattcgagaccagcctggccaacatggtgaaaccctgtctctgctaaaaatacagaaattagctgggcgtggtggtgggtgcctgtagtcccagctactcaggaaactgaggcaggagatcgtgccactgcactccagcctgggcaacagagcgagactctgtctggaaaaacaaaaacaaaataaaaaaaaaacaaccctgtggctgtcttggttatattgttcctttaatattttgaatgtccacgagaaagcacagaggaaccttatactaagtatggagtgtgtgggggtggggtatacaggtgttcatgtggtgaggggtggtgaaatgttgttcttcaagaggtggaggcacagaaagatacttctatgatgtgaaaggaattgcaggtgttcttcagctttcgtaagcccatacagtgtttccaaacatttttgtgttatatataagttgatacatgacacgtgacacgttgaagcagagagaaatttattttgagcattaggaaggacaggaagaagccaaaacccagaatctaaactctgtgcttgcttgcttatttatttatttatttatttacttacttactgagatgaagtttcactctgtcggtcatgctagagtgcagtggcacgatctcaggtcactgcaacctccacctcccagattcaagcaattctcttgcctcacccttccaggtagctgagactataggtgcctgccaccacgcccagctcatttttttgtgtgtttttagtagagacggggtttccccatattggtcaggctggactcgaactcctgacctcaagtgatatacccgccttggcttcccaaagtgttgggattacaggcatgagccactgtgtctggcctaaattctgtgcttttagaaaagaagattatggaaacatagaacatgagcactggaaagggccttcagaattctctaaccctcatcatgtttttatacatgaagaaattcgggcccagagagagaaagggacttgcttaaactacttaatgtcaataagctgggactggaagcagattgcctaactgcccaactgctgactgcaccatattacaaataaagacacagtttatatttttggaaacttttagaagacgcctacttgctatgttagtttctcctcctagctggtcaggcttaccatggaatttccctacttgtttttattttgctagtgtttcaagaacatagtagcaactttgaagttgctagttattttcgagatccatgacgactcccaaatatagggatgttgatgtgatattttctaaggtgctattattacattgagagttaagtctttcaggttcagtacatgaattataccacattgattttttttcttttttttgagatggagtctcgctctgtcgccgagtctggagtgcagtggcacgatctcggctcactgcaacctctacctcccgggttcaagtgaacttcctgcctcagcctcctgagtagctgggattacaggcaggccccaccacgcctggctaatttttgtatttttagtagaaacggggtttcaccatgttggtcaggctggtctcgaactcctgatctcgtgatctgcctgcctcggcctcccaaagtgctgggattacaggcatgagccaccacacccggcccccacattgattttttaagtgagagtagattcgtaagttagcaagcagcctgagtaatagaggtgttcagaaaaacatttcaatttcctattccaaagctgcaatatacaaactattaaatttctaatgttacccttgttggagagtgtcttataatatagtagcctctatttctgattctccaaaggaatggctctaaataaatgttcatatctttgtatagatattgatttctgtattatctatctgcagggtgttcctgaaaatgaaaggagaactaccaaagcagagagtgcttggcttttccggatgtggtacaactttgatcataagtatccttaattgagggaaaaaaaaaaaggataatgtggacatagataattacagtttaatggaacaagtgttttgactattctcttcctggagcagaatataaaacctacctttcatcttccctttccccatcagtgctgtggaaaaggaaacccacacagacagattcctcttcaaacccatgaaaccgtagggactggtcatttcagaagctggctgtgtaaagggaaccaaagcccaaatgacatactttctttgatatataggtttatttattgagcaaactttaatatttgttgtcctttagctaatttagtgaatcccacagaaggtatttcttggttcttgtctgcgtacttggcagggtaagagaggaaaggcttgggaaaaagcatgagaatgaaatcaaaatgcgataatgttcaatactgcgctgttcagcaatacacttttttttcccctgacctttccaaagactaggagattctctctgttcagcatgccacagatagctaatgtttttgtttgccagatttccttcttgccctgttgtaagtctgtttcatagctgtactttgagtagtgttgatattctataacctctttaaatcagggatccccaactcccgggccgcggaccagtactggtccgtggcctgtcgggaaccgggccacacagcaggaggtgagcaatgggccagtgaacattaccacctgagctccgcctcctgtcagatgagcagcattagattctcacaggagcccgaaccctgttgtgaactgcacttgcgagggatctaggttacatactccttatgagaatctaatgtctgatgatgtgaggtggaacagttttatcccaaaactgttttgttcccagcccagtccatggaaaaattgtcttccacaaaaccggtccctggtgccaaaagagttggggaccactgctttaaatcatgccttttaaacattttatcattattaaaattaatttcttatttgaaaattcacctagcaaaaacagccatggagttctttcaggctctgatttatcagtaaatgattcaaaacttggtttatgttctattgaagcaaattggagacaaccgtgtaagaaatttgtccttgctttcaactttctgatgaaagccttgtatatttaagaaaaatcacttgacacttaatgattagaagctactacttaccatgttctgtttggtaatttttgcattcactgcttgcaagtacttcaaaattaaattattgtatggaaacaagaatgcaagcatatctggggtattaagactcccattagagaaagagagcctggctcttaaaattttttaaagattatgtcattacttttggctccattgtcagggttttggatataagccactctcatatctcttggggctttttcatccctctaatttagcaataattttttagtgagttttctgcataaaatgttttgtacattttctacataatatataaaacagttcaatgatcctaatgttgagaaagcgtagaataatagcttattcttctgtatattttatggaagtaaacaccaaggcttgtttgactcagtactgccctattaagtcctactcaatgaagacctgatcattttaatacctagtgccctgatataattaaatattcattattttagatttcagttcatttgtgtaggcaaatgatttgttataattgagctataacttgaatacaataaagtacacgaatcttaagtgtacagcttaatgaatttcaacctgtgtcaacaactgtgtgcctcccacccatacaaagatacaaatgaacattctctatccccctccacaaaggggtaaccatgattctgactttcatcaacatgggttagttttacctgattttgatctttatatatatggattcatatattaggtattcgtttctgtcttgcttctttcactcgacatctgtgtaatttatccctattgtttcatgtaacagcaattcattctttttttattgctgtagtagggtagagctctgtagtaggaatatactacaggatttttgtttgtaaccagtctactgttaataaatatttgggttggttctagcttttggctattacaaaaacctgcatgaatatatatcttttggtggacatagcactcatttctcttgggtatataccaaggagtgcaaagagtggaatttaggacaagtatatgtttaacgtgttttttgtttgtttgtttgtttgtttgtttgtttgcagtagtgtctggctctgtcacccaggctggaatgcagtggcacaatcttggctcactgcaacctctgcctcccaggctcaagtgatcctctaaacacagcctcctgggtagctgggactcctggtgcatgtcatcacacccagctatttttttttttttttttctcaatgtagagacatggtttcaccatgtttcccaggctggccttgaactctgggactcaagtgatccacccacctcagcctcccaaagtgctggaattataggagtgagccacttgcccagcctgtttagctttaaaacagacattgccaaccaaccagttttccagagtgattgcaaccagtttaattggttttaaccaacttggtgaatttatgattatttccatcagcaaattaagggagttctatttttcagtcttttaaattttagccattttgatgggtgtgtagtgatatctcatatggtttaatttgcatttctctgatgaccagagaggctgagcaccttttcttgttttttgaccatttagatatcctcttttgtgaagtctaagtctttcgtccattgtttaactgagttgtttttttctctcattgatttatagttctctctatattcctgaattgggttttttgttgttgattattgtattttttctcagtctgtagcttgccttttcattttcttaatcctgtatttaaggagtagaagttcttcaatttaatgaagtctattacattttgtttatttttaagataagttcccactctctcacccaggctggagtgcagtggtgcaatcatagttcactgtagccccaacctcctgggctcaggtgatcctcctgcctcagcctcctgaatagctaggactacaggtgcatggcaccacatccagctagtttttaaaagttttttatacagacaggttctcactttgttgcccaggctagaagtccattttattcaccttttatggttagtgttttctgtgtcttaagaaatcttccatatcccaaggtcgtgaagatattttcctgtttttttctagaagtatgattgctttaactatcacatttaagtctttgatccatcacaaattcatttttgtgcatggtgagagatagtgggtgaagatctacttttttccatatgcatatccagttgatgcagcaccatttattgaaaaatatcatccttaccccactgaattgcagtacaatctttgttgtaaatcacttggctgtataagtggggataagtttctggactctcttttttaatcctgtttctctatttttatatcaataccacaccctttttattactgtactttataataagtcttgctatccagtagagtaattaaaatctggctttgttcttctccagtatagccttggctattttgggtgctttgcgttttcctttaaattttagaaacagcttgtcaatttacacacatgtgcatgtgcacacacacacacacacacaactgctggcaagtttattgggtttgtattgaatccataaatgaatttggagagaaatgatatcataacaatattgagacttccatatcataaacacagcatattgctccactcatttaggtcttttaaaatttctctcattaacgatttgtacttttcagtacacagctcttgtacattttcattagatttattcctaagtatttgatgtttttgatcctattgcaaatggtatttactctgttttatacttgtttgatgtaaatatatagatagaaaattggatatttatttatttatttatttatttatttattgagacagagtctcactctgttgcccaggcaggagtgcagtggcacaatctcggctcactgcaacctctgcctcccggattcaagtgattcttctgcctcagcctcccaagtagctgggactacaggcgcccgccaccaggcccagctaattttttgtatttttggtagagatggtgtttcaccgtgtttgccaggatggtctcgatctcctgaccttgtgatctgcccgcctcagcctcccaaagtgctgggattacaggcgtgagccactgtgcccagcctaaaatttgattttatatatggaccttgggtccagcaatcttgctaagttcacttatgatttctaatagatactttttggtcttctatatacataattaaatgatctatgactaattatttttttttcttttccaatccctgtatttcttttttgtgtctttttacatcagcttttttaggggacttcttcagtgcaatggtgaatataagtgatgatacaggacattcttaccttattcctgacctcagagggaaatttttcaatatttcaccattaagtacgatgttagctatacgtttttggatatatcctttagcaggttaagagcattctcttttatttctagtctgctgagagtttttatcatgagtttttgtctgctgagaatttttagtatcagatgctttttctgcatcgagatgatcatgtgtttatatttttcttctttaatctgttattttgattttcattgattgattgtttgaatgttaaactagtcttgcattgctggaacaaattccacttggtcatgatgtgttatcctttgtgtatatctctggatttaatttgctaatattttgcatctgatttttgtgtctatttttatgaacaatattggcttgtgattttttcttatagtgtccttgtcaggtttctataacaagattaagctggcctcataaaatgaatcaggaagtattccctcattttctgttctctgaaggagtgataagattagtgttattattatttttttttaatgttaggaaagttttaccagtgaagccatttgagcctggagctttctgtaggagaaagtttttaatttcattaataaatacaggactatctaggtttttttttctttttttttttctttttttaaaaccatttgtcatcatctggcgagtttttttttctaaggaattttttcttgtagagtcaaacatcaagacttgttagcctcagtactacccattcagtaccagaagatgaagacctggtcatttctttactcaaaatgctagaattcatcattccagttttttagtagctttgtgtttggccagatgttttataaagcgtgtttatatgcagtgttttaatctttacttagaatttattaatatgaggattcatgaaattttctctgactttctcatttttaactgagaaccaccttagggtctcattttagaaaatgaggagggagggcatggaggctcatgcctgtaaacccaacactttgggaggctgaggtgggaggattgcttgaggcaggctcagttcaagaccagccctagcaacatagcgagaccctgtctttgcaaaaatcaaataaaaaaaaattagttgggcattgtggcacgtacctgctatgatcacccactgcactctagcctgggtgacagagcgacactgtctcaaaaaaaaaaaaaataaatgaataaataaataaagtggggaatttgtgtgtctgtatccttttctcctttttcttgtgattccctcttttttcttctgagtgtcatatattctcatgtctatttttattttttggcaaataaatgaatactgaaatgagggcctatgataaagggcctcatgatacatagttttttaaaatgtcttgagatttgacttgcctttccttcttatagcttcctaagtaaacagtcagtctgatactgaagtttcaacttataccatgcaagaggccagctgaattcacaataaatgatgaaaaccattttattactatgttctactggaaaatttaatttcctctctggccattaacattgtttactttctcccttatctcctgtagtgcccaatttacagtgatgttccttttggttttagtaaaatcagaaaagcaatgtgatgtagtggaaagggcacaagatttgaaattcagaccaatttgggctagcagattggtccccatttacctcattgtgtagctttaagcaggtcattgacctctctgagcctcagtttccatatctgtgaagtggagatgataaaatacccctttgctgtttcactgccatcatgtgaggaggaaatgagaccatagatgtgaaagccctttgctgtcctccgaagtggttactatactatgatggtgattattatcaaacgagttgctcttttaaatttgtaaagaaaggaccacagctcttccttaaccaccgcagctatctgaagcctctgctgacccacagcgggcctccgctgacaacaacactccctgcctgctgtggacccatcgccaggtgcctcaccagcccccaggcttacgaagtaagttggttttatccaaaactaaattcttcagtaagttaaatttatctgctctgtggatgagtcactggttttattttattttggtttgtttttttgcctttgaggtataaattccatgaaagggaatttaagcatattttgctcaaccagaaaatacactgaaacctataaatataattcacagcctttgaaacagcatttgaaaacagatatagaatcgtgcctcatcttactgtgggtgattttagtaaatagttctatttccctgctggctttcatttctttgcagtatgtgtcctgagctcagcactaaatgtgtatgctttcctccacaaatgagggttgtctcagttacattttgaggattttaaaacaattttgacatccctaaagtgcaacagatggtctattatttcacacctcccaacctttggatgtttgggaaagctatctgcctctgttccacatttctgggacacatgagcatatctagatagaatctgaattccatattttttccttagctaccaaaatgtgattggtaatttgataaatattgctactaagaaaaaaataacagaaatcctagctgacctttgtttttaaatgtgcacgtttttatttttcaagttcttttttaaaaaccttccattctggccaggcgtggtggctcatgcctgtaatcccagcactttgggaggccgaggcggcagatcacctgaggtcaggagttcaagaccagactggtcaacatggcgaaacccagtctctaccaaaattacaaaaattagctgggcacagtggcgtgcacctgtaatcccaactactcgggaggctgaggcaggagaattgcttgaattggggaggtggaggttgtgagcagagatcatgccactgcactccagcctgggtgacagagtgagactctgtatcaaaagaaaaaaaaaagaaaaagaaaaagccttccattctaaacaaacctttcagaaataatctatgacatcatataggctcccctgttaacaaagcccaccagttttgactacttaggtgcaacacgcagaaccttgagaggggaagctgtagtgaagctgtgtagacatgcaccacacacacctccctccccgtgcccccattccctgtgagtgaacctcatgtgaaaccagattgtataagaaatggacaggagagagtaggcagagtaggggtggcatctgggccagggaggagcatcctacggctttgtgttatgtcgtgtcagtgcatgtttctgacagactgtgcctgtgagatggggcacacaccccatgttgcccctcctctcccttccacattgcccaggctcgcctctcaaacattgtctccatttccaccatgccctgttaacccacataactgtgcagagaagtcagccagctctgttggttcaggcagtgaagcttggctcttggattccagagacccactcgctgtcaccaaaagccagaagaggtccacaacaaacctgtgtccttggaatgtagcgaaacacaacaggctccctagagcagctgtaacaaagtaccaaaaccgaatggcttaaacaatagaaacttatcatctcttatttctggaggctaaaatccaaagtcaagttgttggccgggtcagttccttctaggctgtgagggagaatctgctccaggcctctcttctaactcctggtggcttcctggctatcttggaccttccttgacttacagatgcatcactatgtatctctactttcatcttcacatggggttctacctgtgtgcatgcctacttccgtgtccaaatttctcctattcataaggacaccagtcatattgaatcagggcctaccttatttccaaacaagaccctatttccaaacaaggttacattcacaggtgctgggggttaggacttcaacatcttttggtggggggttggggagggacacaatttaacccataacaaccatcacacttaattttttttttttttttagacagagtctcactctgtcacccaggctggagtgcagtggcgcgatcttggctcactgcaacctctacctctcaggttcaagcgattcttatgcctcagcctcccaagtagctgggattacaggtgtgcaccaccacacccagctcatttttctgtattttttagtagagacgaggtttcgccatgtcagccaggctggtcttgaactcctgacctcaagtgatccactcaccttggcctcccaaagtgttgggattacaggcatgagccactgcacctggcccaaacgtaattttttatattatctttgttaactgctttttttagttataacactagcaagctcatggccaaatatccatacagtatggaatgtacaaaatgaaaaatcaaagttgccttcctcctacctgcagtcctcgaggcagtctttattataggctcactgtggatacttcctgatatattttattgcaaataaatatgtgtatatatggctttgttattgttttacacaaatgggattataataggcatattgtcccattacttgctttttttttcaattactgacacatcatggatacctttatatgtgagtatgttagatgtcttaccttctcttttcatggctacgtcctattccatttcatagctgtagcaaaattcatgtattcagtctcttatggatagatgtttcagtcatttccttttttgctattataaacaatacttatagtgaatattcttttacatataaacttacctaactatgtaaaagtatatagaatagattttaaaggtaaaatcactgggtcaaaaggcatgtgcattttaaaatttgatagatattgccccaaacctcaaacttaataaagacactagaaggtgctgaagagcccctgtggacctgtgaaggagccacagagcttgtgagtattgctgaattaagtgatagatactggttagatagacttactgtcctaactagattagacaggaagggatttgggctggttggtggatatgagtttgtttgtttgtttttgagatgggttctggctgtgttgcccaggttggcctcaaacttctgggctcaagcagtcctcctgccttagcctccccagtagctaggacaatagacatgtgccacccatacccagccgtttatttttcagttcacactttttttggtctttgagtatttaggggaatttctagcaacagcagattaaattcctttttagattttgtctaatagtcttctcagtctatttgatggtcttagacaaattcaaaattttcaaacagacatgggatttagaaagctggagaatatacttccctcaaggagcatcaatgacagactgttttatgctagatcaatgtgaatatttagaatgatcctttctctttaaagtcatttagaaaaaatgacttgttctgttttttaaaagtaatatatactcattataataaaatttcagataatacagaaacataaagaagaaaagacttttctatacacacattttttatttgccaatatgggactatgtattcctgattcttttcccttttgtagaaccttatttaagtatactattttggtcgtaatatttccatgagaaccaaagcttatggagctgcagtgagggcttgatatgtttctctgtaccccaaactgtattaggtggttggactacgtagcattcaccctgtgtcttcaccacatgtgaatcggtctgctcctgccacacactagactctaagcctcttgagggcagattgatacacacacagttatagctcaagggtaagtgccactacagggagagggccaagtataggatgccacgaaagcacacaggaaggacagctaacctagtcctagaagctcaaggaagacttcagagcaaaagtgataaaaggatgttagtcatttgaagggaaagaggggtcatgtagaaggacctgaaggtaagagaaagcacgaggagtctgggcagctgtcacacttcagtctggttggcagacaatggggcctttggtgtgggaggggcagattgtagcaggagaggaactaaggatgccaagtcacgctgtattttaagccaaggtatggactttagactttatcctgagggcagtgggctaccacttaagggttttaatgggggatcctcgaaaatactcctattggaaatgtctcttgaacttctcaaaaattcttaaatcttactttatttgcatttagaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaacttaacttatgggttggcaaatttttggtgcttatgtgtaagggtggatgtatttgcttatggtcacaattggactctttaggaaatatgactcaaagctgtcaaattctattacattgatttgtagcctgttagcttagtaatggataatgttataaaaatgctggtatggggaaagagaattctatatccagttaggtgggaaggcagttccaagtatatccagttaggtaggaaggcagttccaagtttggctaaaagcatgatcacacaaatacaaatagtcctccttccaagttaaagacacgtctctctgtgcatgagaagttttataggctagagtctgctgactgcaagtttgtctagtccagcaatggcaccaaccacactgtctgttgtgttttcttgtcatccactccagcttccttgtttatggcccagtgagagacattggtgggggatggtccacacacaacaggctcttttcttgaaggaacccatgttttctaattccctacacaaaaccctacattagatctgagcaggtacagttgttaacctgacccaatgcaggagtataatgagatgagagtccccgacaggacgtacgccacacagatgatgtagtgtgaggcttgaaaataaattggaaatgataataatagttctcatttttgagcccttcttgggtactggtcatgtgtatacaaggcattttaaaatctataatcatgcattgagggcacattctatcatcctcagtatacagatgaaactgaggtgcagagaagtcacacagcgagtaagtggcagagtcaggacccaagtcaagtctgactccaaagcccagatgcttactattttgctggccccaaaggcaggctctgctgattcatcctgattgtaaccagaaggatgaagggaattgcagaattgctttctagcctgctgcccccgacctgcttgtcatcaggccaggctaaggcatgaagtctcagctctgtgcctccacttgctgctgtgttcttggctgtcttgttggcgttccctggttgggagggtcctcgcattcatagcaaagggccctccagtgtcttgttgggcccatgggcgagcagcctgcctagcagcatttcttcatgctctacctcccaacattatcaccaaggggcccggattttatagcagagtttgcagtcctgaacaatggctttgcatccccacagttaagcatagtagaaaaagcccaggctctggagtgacacagacctgggttcaaacccaggctctgctgcttgcttattgtgtaatgttgaccacttacttcactgagccttttagttttctcagctgtaaagttaattcattcaagaaatatctgagtgcttactttgtgccacacacagtagagatagcagcaaataactaaacagttccagctctcatggagagtattctacgggagatgtagcaatctcatggggttcttaggaatcattcatgcaggaaagactgattgccttcttgccttctagcagggggggatatcttgtttttatgttttgttttgtttttggttttttgtttgtttgtttgttttgagatggagtttcgctcgtttcgctcttgttgcccaggctggagtgcaatggtacgttctcggctcactgcaacctctgcctcccaggttcaagtgattctcctggcttcagcctcccgagtagctgggattacagatgtcgccaccatgccgggctaatttttgtatttttagtagagacggggtttcaccatgttggcctggctggtctcaaactcctgacctcaagttatccacccaccttggcctcccaaagtgctgggattaca

SEQ ID NO: 12592 - DNA, 30569 bp, Human
atcctagtactttgggaggccaaggcagaaggatcacttgaacctgggagttggagaccagcctggacaacatagtgagactccatctctatttttttttatatatataaataaaaaaaaatcctgatctcttcaaagtccactggcagttgtggaatggtatgttgagccagtgcctgggtccagtccaggttctactaattcccagctgtgggaccctgggcaagttactgaacctctctcagcccaactctttgcctataatatggagataatacctactgattcagttgtcctgagtttagaaataacagttgtatgggctggaccccaaaaagatagcggtgactccatttggtggatggggaaggagttcagaacatgccaccacaacatatgctgctctggcatattgagtatttgagttaaaggcacttgaaaaatagcagatgcaagaagggcactcttgatcatccttctttttctaaaaaacaggagatgaggccgggcatgatggctcacatcctataatcccagcactttgggtgagaagccaaagtgggtggattgctcgagcctgggaattcaaaaccagcctgggcaacacggcaaaaccccatctctacaaaaaaaatacaataattggccgggcgtggtgactcaggcctctaatcctagcacttcgggaggctgaggcaggtggatcacctgaggtcaagatttcgagaccagcccagccaacatggtgaaacctctctctactaaaaatacaaaaaaaaattagctgggtgtggtggcatgcccctgtagtcccacctactaggggaggctgaggcagaagaatcgcttgaacccaggaggcggaggttgtagcgagccaagatcgcgctactgcactccagcctgggcgacagagggagactccatctcaaaaaaaaaaaaaagtatttagattttgccagttctcagggtcttcatttccttatgagggcttccacgtcatgtaaaacttgtattaaatctgtttttctccccttaatctgtcttatgccaaattaattctcaagcccagccaaagaccctaggagggcagaggtaaagtcctgcttcccttacaatggcatctgcttaaaagctccaaaaaatgtcttggcctttgtcacacttctgtggacacagtcaagtcctttaaatcctctcaagtctcacgtttgtaaccaagccaagtaaatcctgtcctgctccctaaggaacacagaaggtctgagatgccctgcctaggccgcgcccaaaggccagatgggcttcccgaggcctggccgggagggcctcagatgtcagcttgactgaccccctccttctccccagagggacagggcccgggtaagggcttgaccaaggtcgcgacgcgagacggtggcggagcccggccccagctagatccacgcactcacagtcctcgctgccgcccccgccccaggtcaaggggcgccactcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcgaaccgctgatgggagtcggagcccgggcgggcgagcggcggcgcggcggccaccatggggaacaagcagaccatcttcaccgaagagcagctagacaactaccaggtgagctcggcgcgcccggcccccaacacaggccccgccgccccgccgcccctcccttttctcggtcgctggccgaggcctcccgagagccagctctcccaggttcaaaccctgcctctgccttcagctcgacgcgtgaccttgggccggtgacttcccctcgccgtgcctcagtttccccaccggtggaataagagctctttccagttggaagaacctctcaggcgcgcctctctccagctactctcgccctaggcaggacccgaacccctctccagccacccattccagcgcccatctggcccggagagggagtcagtaaactaggctggacggaggaccgccctccccgctccctgccccccagccccaggaaggagcccaggagagcgagtctctgtaaagcagaaatgagagctggcgtcctgtctggtctaggagtggggtgcatcagtccccacatgcagtcttcccttgggactgtcttgtttatcggctggggttcgctccttctgaccccagcatggagataactggagcaagaacgcaagcccggtagcagccttccagggccacctctcccagctcccttaggccctcagtagccacctccttagacctttctaggttttcctgcctccagagccagctttccagatctggaatcccaataccgtcccacccaggtaaaaacttcgctgtggttgcaggatgaagcccaaccccttggcttacccggagccctggccaattgctcagcttatctctgcagcctcagtctccccaggtcccttccctgccctctgcatggcagccgccttaaaaccatttgcagttgctccagctcaccaggctcattcctccctccctctctccctctgcccatgccatttcctgggcctggatgcctttcccccctccagaggatctctttcacccttcaagtcccacatctgatgcctctcccctgactccccaggcggagggggcaggattgtgttgtggcctgtgtaactgggcaggaggaacaccaacagggtctccataggcacttgttgccttcatcagtgcttactttggctgtgaaggaaagcaggtgtgaagtgtgggtcctctgatgtgggtgaaggtaaaacaaaggccccttctcctcctagaagccctagttgtcagtaatggatttctcagctccccaggtgaggccctgggaaggaagaggggagacgcatttatggagcacctgctgtgtaccaggcacagtaattgatgccctctacgcatcaactcacttgatcatcacagtgaggtggattattagcccattttacagacgtgtaaacagaggctgaggagccattcagggctcacacaggatttcgaatcttgactcctaggctcacttctttagttgggagtgggctgggctgggccatgtgtgctttttgttcccaaggcactcagtctcagacactcagagacagactctcacctccagtgtgtggcccttgtgatagaggcaggtggtggagtgtgttctagggaagggcactagtgggcagtgggaggccagcagggaagggggacaaagtccagaaacgatacagcacttgagcaggccttgggaagataggtcgggttttgcccagtggggcccagaggaggcattccaggtggaggggacagcgtggataaaggcttgggagtgggcaggggcaagcaggcaagccatgctcagaagtgaggagtagcttcatgggggtggggagcccaggttcccactccaaccagcctggcattgggttactcatcggagccagtcccagtgttatgttctgattctttgccagagcctagctagaccctgccaggcggggtgggagaaatgagagctgtgaaacctgagagccccacatctcctaccctctggctctccagccagccattgccagcccgggctgagtgggggtgagcctgagttacagcaccctctcccctaagtgacacctagggtttcttgggacctcccagcctggtagtctaacctttcctgggcagggtgcaccctcttggttcccggtgccggtgattcccaacatttaagcttctgtccagaacactcctctgcattgtacggccatcccccagacccctcaaactccaaaacaggggtcacagcctctccaacacccactgctgctcctccagccatttcaactctctgctctccctcagcccatgttttcagttaagaacaaggcctgtgactcagcctcttttgtgggtcacctggaggtcccctcctccatcacgacagccagggccctgggctaggcctgctcagtctcctgcaaactggaggtctgactgctccctcctgcgcccctcctgcccatccccctccagccacccgccctcttagttctctcactcttccttcatctctttctttctcttccttttttttttttttgagacggagtctcgctcgccctgtcacccaggctggagtgcagtggtgtgatctcggctcactgcaacctccgcatcccagctccgcctcccaggttcaagcaattttccctgcctcagcctcccaagtagctgggattacaggcacccaccaccatgcccatctaatttttgtatttttagtaaaaacagggttttgccatgttggccaggctggtctcaaactcctgacctcaggtgatccacctgccttggcctcccagagtgttgggattacaggtgtgagccaccgcgccgggcctccagcctcatttcttactccctttccctttgcacccaaagttttaggcacactgaagggcttctagccaagccctccctcacctctggcccttgttctcctgctgctctccctgctcctttgctaacctagtctggcccatctttctgtccaggccaggcctcacctctttgggacgggctccctgactctctccccaccaatccattcagctgggagtactcagggagcctgacacatatacatccccagtcccttgtgtggccacagaatggtttatactgggcacctcactgtttacactccagcttccttcttgtatggcctctgtccaggcacaaaagagatgtttggaggatgttgtcaaatgaatgaacaaatatttgttaaggcgtggctccaggagagcaaagaactctagacaaagattctgaagccctagattcaagtcagctgggtagttgatgctgtgggccttagcaagccactgttcccttctgggcctaagtgtctccacctctaaaatgggaactactaacccagctgtgctcatgtcacagggttcttgtggggatcaactaagatcactggagactgaccttgagccgtgtgatggtcccctgggcagtgctgaggcctgagctggcagagctggatggagagccatttccattagagctgggagggcccatggctcggctcctgacagctggcacaggcagaccaggcatgtaggagatgggaggcaggtgggttacctggaacaagtcacccttgagttgagctttggagaaagggtttggacaacctggagaaagaggagagggcactccagttggggaatagggtgaatataggctcggaggcagaactcaagccttaactgggaaaacgtctgggcttctactgtaaaagcccagcctgtcctgttttctgctgccaatgttctgagagcccatcactcctgggttaggccccctctctccttccctcccttccactcctcatgacccagacctgacctttgccggaagacctgtccctgtgtccctgtgtactgtcaggaaccaagcagtgatggggcacttgctctccaaaagtgtaagaaagggttccttcagacatagggctgtagctcccagggcagctgagggtgtagtggtgggcagggtgtttggtgactccagagaagggaaagacagcagagctaccgactctggggagatgcctttgggacctgggtggtggatggagctgttgtactctttcctatcagctggggcctatagacttcctgtaccttatctcatttgctcttcacactgtccccttcagagaggcctatttccactttacagatgcagaaactgaggctcagaaaggagaatgacttgcctaagggtctgaagctagactagaatttgaccctgactaccaaaccttttcccctgccacacttctaggccaccctgagccctgagaagcttttaagaacacctgccatattcactacctgtgcactgcctccttggggtgagtcccagggaaacaagtgaacagaagaaaaagtgaaacatcagttgatgagcaggttcatggcagttttgtcagtgatgttaaaaccaagaaataggtgttactaaatgttcagaaagagaagaaagattaagactaggcagggactctgcagccactgaaataacgtaactgctgtggaaggcatagatggaaaagtctggtcactcatcccacaagcctgtattaagcacctgctgtgtataagtataggaatacacagcagacgcaggacatggagtggctggtgtacagtggtcatggctctgtttgtagtcataggcagtggccaagaagcacagaggatcttttcttgcctctgcttccttgccagtgagggccccaaggtctactcccattaaaaagaaaaaaagaaggctatgcgtggtagctcatgcctataatcccggcactttgggaagcctagttgggtgaacacctgaggtcaggagttcgagaccagcctgaccaatatggtgaaaccccatctctatactaagaatacaaaaattagccaggcatggtggcgcatgcctgtaatcccagctacttggaaggctgagacaggagaatcacttgaacccaggaggcggaggttgcagtgagctgagatcatgccactgtactccagcctgggtgacagagcaagactccgtctcaaaaaaaaaaggggggggggcaggggaaagggaagcacagaggcctaagttccattcccagccctcctgggctgtgtgtgcaacttaaggcaagctactcaactttgctgagtctcaagttgcccatctttaagatagagagataatgcccacccccattggctaatgataaggattaagaaaaattggatatttagagccccaggtgccaggtgcatggtacatcatgtactggttgtgatgtggttttcagcctgggttgcacgttgggaccacctgagtggctttgaaaacagccaatgcctggatccatccttggggatttctctacaatttgtctggggtctgctgagggatgggggacacaggtatcctaaacagtcccccaagtgattctgctctagagcagacttcctcacacttcaacatgcatcagcatcattgggagggttttttaaagtgcagatccctggaccccacccacagagtttctgattcaagagatctggagtggagcctaagaatctacattttcaccaagttcccagtgaggctgatgctgctggtccaggagccacagcgtgaggaccattgatgtagggaggtgtaagtaattgtgacagggagcagggttataggggaagtgtttgcatcttttgtcaggagaacccttgaatcaggacctggatagttcctttccaacacatgggataggagagagaagaggggaggggaaggaggacagatcggggggaagagagcaggagttgggacctctccccatttccagttctgctgactgcctcctccaggctaggtgggagagccctggcccttctcactgggcaccttagaccatggaaacggccctggggtggagggaagtccacattctgcaccatgtttctggagtttgctgataaatcagcccactgtgtctccagcctgtctgtgcctgaggcctgctaagtagggagttttctgtctgtgttgggtgaggagcagggggcactgcttccccagcctgagcctttctgggctcctacagaggaaccactgtcaaaagcaaagctgagacccccaggagaacccctcgtgtttccaagaagccagcatggatccttagtctaactcccagggagcagcagcttagaaggacagacttgttgggccaaatggggcctggaaattcccaccagctctccccttttcagctctcccgaaggcacccagtggaaaccccagatgttgtgtgcatcctgcaggcgtcctctctttgggcctcttaacacgcaatccaattgccctgatgtccagcggcttcaggtctcattcagggcaagcctggctgtttgcaggcctgagtttcagccattcactcctcatcagagctggctctggtcagcttatggccccaggaggccctatgggctctgggctctgcagacctaggaggccttcttgcttcatgctgtaacagtggacaaaggcggaggagctaaacagcaggggaggtgcacaaaagccctttacggttgggcattttacaaagtgctgggtcctcttcacctctatacttttcaccaagggctggcatagtggccattgtcactgactcccagtggttgatactcaccttgggcaggccaagctgtggatagaggcagttcatctaaacaaagacaggacccctccgagatgagtttgtcatctggatggccctaggagccaagtgctgccccccacctggagtaatgcttacctggggatccccagcagcccctaccctcacctctaccccagatgctacctggttccccctgcccacgtttctccctcccatatctccctggcctcttcactcccttctctgggtgacctcatccctttctggcttcagacaccaagtatatactgatgcttccccagtctatgtgcctggaactctcagtctctgagcctgggactgcacaacccccctagcaccatgctcagggctacagtgaggatggcaccccatgcagctacacgaggtggccctgtgggtcctcattcggagttgtctcccagccacctccctgtcatcccccagtgtatcccactggcactcaaatcagccacgcatacctgtgagcattcatcttcctcctacatgtgtaccctaaagcatgctacagccccccaccatgcactaagctccttaggcctagcccaggatggataaaggttttgggaggcattttctatacctactagagccagctgtccccagtgggtgagggcaaggtggaaagggatagtagtgactcttctgtccccagtccggagctatcccctgtgagccctgtggcatcgaggcctctgaggaagaaagtctgggagccgcacactgactgtgtgttgtgtgttttccctcaacaggactgcaccttcttcaataagaaggacatcctcaagtaagtgtggcttctcgttcaccctgttgggactgggactggggccggggtgaggctggggcaccccacatgggctggctgtgctcctggggctgaggcagagcatcagcatgtatcaggagccacattcaggtccccactcggccactgggctaggatggagttagagcttcccactcctcccagggcccagatcctcctgctggggaatgaacatctacttactatgagctttcaggtgggtagtttccggcacattcttatttaatcctcattgtgaccttgtaacaagagaatccatttatccccatttgacagatggagcttagcaacttggctaaagtcacagagccagggactcaagacccagcctctgactccaggtcccttgctatttcactgcatcctgggtcctggtatagcagggagtccctgtctgttagaccaggggtccctaagggccctttggctctagctttgatgttcttccactcctaggacgtctaaaagttgagggcatggccaccacccctgagctattcatcagggctctgcttcttcccaggacagcccttctccttggtgttgatgggggtgggggtggacctggatgggaaagataaaggggatcggcagcctcagaaccccaggaccagtgggtgagcaggaatcactgaataccaagaaaactgccccacgggcctcactaggcccctctgcctgggtggcactaaaagccagcaaagtcccaggatcacttgccctggagatcgatggtcaggctgggaccagagcccattgcagcttcccaagagagctgtgctgcagcttgtcactgccctaaccattctgctcattcaggcagtgcctctcggctttcctctctacccaggctgctattccaacctgtcacctgcatgggcaggggataccccacttccaccaccttagagagtctgagcaaggggcaaagcctccaggcctggcatcagtagacctggcatctgtggccttgggcaaccatttgaccttccctgagcctcagttttcttctgtataatagggatagtgaaacctaccctcatagcattgccgagaggcagcaacactggggtatagtgtttgataagtgggatttgccctgtagcttgagagatgtcaggggtgaggtccccatttcgacaggatggctctcggtattggaataacaaagctgtcacccctggcattcttgtggcaccttttacctttcagagttcttggcatggagcctcatttgagcctcacagggagcttcgggttccctacctttgtagatgccaagcccaagctgcctgtcttctgaggcccacggccattttcattctggcaacaaaagccccttgcctcggcctttgcactggctatctccactccctggagtgtccttcgcctctcctctgcccacagcattgctatgcatccttccagacccaactccagaatcatctcctttataagcacccccaacaccctgccaccctagtgctatcccagctgctctaacagcctgttaggggctccttgggttcctggacccaggggcccagctccccaccagacttgtgatcaggcaggactaacagggagcatggcacctgttagccaccagtgaccatatgaagagtgtgtgggtgaaagacaggtaggattggctgagggagaacattccaggctggggagcagcagaggtgagacacaggccagcttctcctgctcccactcccacccccatcctcccgtggtctcattgacagcagcaagattgcctgtgtggggaagaggagagaggagcttgaaggccagtccgggaatccgatccaatatgatgggcctttggtggttgttttagtccattctcatgctgctataaagaactgcctgagactgggtaatttataaaggaaagaggtttaattgattcatggctccacatggctggggaggcctcaggaaacttacaatcatggcagaaggggaggcaaacacatccttcctcacatggcggcaggaaagagaagtgctgggcaaagggggagaagccccttataaaaccatcagatctcgtgagaactcactatcatgagaacagcctcggggtaactgcccccatgattcaattacctcccaccaggtccctcccatgacacgtagggattatgggaactacaattcaagatgagatttgggtagggacacagccaaaccatatcaggggtatccctggccccttggaaaatgaggggctccaggcaggtgagagggcttgaggagaggcgtcctggctccccacagccctggcctgcacccctctgcacgcatcaggaccctaggctctgtaattcaacaccagagcaaaacccaagcctgaggccccgtctgcagcatggggatgacattgcttgcaggagctgttttctcacaggcccctgtgtctgggagggctgggtgatggtgttattaaacatgaaaagagctacctggagtttgctgcccacctgtccaccctcagggaagggtagttaagacaagacagattcgggattgcctgtccctagagggaacaggcatggccatgatggctcaattccagtttcaccccccttcgcttttctccagccttctctgtggagaggccagcatgactgactgcccctccaggagagccctctccactgttcacatctcaggtccgggtgacaaaactgaggcctggagcccagagagggcaaagtcagctgcagagccaggctatccagccccaggccatgctcatcttccctgctcccaagggcctttcagggatgctactccccacccccaccaggatggttttcttggtaagctgctccctgcgtactgaccagatggctaggaggaaacttgagcaggaggtttttctttgcaggttggggcccagctctgtggcaactttggggcagtgataccgagtcacagatagcccgcctccaattctccttccctctgccctgcccccacccaggtagatccgattgctccccaggacacagctcctgcattcccacattgaggccgagtgggcagcccaccctattcagtcaccttgctttttataggtaagagcttagcacttcaacttcccttgtgccctaattaggctgtgctctttaatcagcgggacagtagtccttgtccccttggtacacagagaggcccacccagccagcactccaaggtatttgcctacttgttattttattgtttattttctcaaccttttaaaaactttgtgtaacctattttaattacttactacacatatacataatgattgtagaaaaattagaaaatgaagccagtcaagagaagacaaaaaaaattacctgtaagcctatgacccagaaataaggctgttaatcttttggtatatattatgccagtgtttttcttttgtatgtgtttatcaaaaagtcagattgtggtcgggtacgttggctcacacctgtaatcctagcactttgagaggccgaggccggtggattacatgaactcaggggtttgtgaccagtctggccaacatggtgagacccctgtctctaaaaaaaaaatacagaaattagccaggtctggtggtgtgtgcctgtagtcccagctccttgggaggctgaggtgggagaagtgctggagcccaggaggttgagaccgcagtgagttgagattgcaccactgcacaccagcctgggcaacagagcaagactctgactcaaaaaaaaaaaaaggcagatggtattgttttgtaatatgcttaaaattggccaggcgcagtggctcactcctttaatctcagcactttgggaggctgaggcgggtggatcatgaggtcaggagttcaagaccagcctggccaacatggtgaaaccccaactctactgaaaatacaaaaattagctgggcatggtggtgtgttcctgtagtcccagctactcaggaggctgaggcaggagaattgcttgaaccgggacccaggaggcggaggttgcagtgagccgagatcatgccacttcactccagcctgggctacaaagcgagactccatctcaaaaaaaaaaaagtatatatatgcttaaaattgcttttccttaggcaaattgtaaaagtagataagaaagctaaagaaaacagtatgatggatcctcaaacacttacaaataaaatcaccacatgatccagcaattctacttctgggtatatacccaaaagaattgaaagcagagtcttgagatgtttgtacacccacaatcatagcagcattattcacaaaaggtggaagcaatccatcagcaaatgaatagatgaaccaaacacggtatagacagacaataaaacactattcaacctgcaaaaggaaggagagtctgacccatgctacaacatggatggaccttaaggacattatgcacagtgaaataagcagtcacaaaatgacatatacgattccacttacatgaggtacctagagtagtcaaattcttttttttttttttttaaagtctgtgtctcgctgcaatctctgcctcccaggttcaagcaattctcctgcctcagccacccaattagctgggattacaggcgtgtaccaacacgctcggctaatttttgtatttttagtagagatggggttcaccttgttggccaagctgatctcgaactcctgacctcaaatgatccacccgcttctgcctcccaaagtgctaggattacaggcatgagccaccaggcctagccaagtagtcaaattcttagaaacagaaagtagaatagtggttgccaggggctgggaggagggggaatgggaacttattgattagtacagagtttcagttttggaagatggagagagttctggaggtggatcagtggtggtgatggttgcataataatgtgaacatatttaatatgccactgaactgtacccatcaaaatggttaagatggtacactttatggcatgtgcattttaccacaatttagaaaaactaataattaagatggtaaattttctgttattttatcacaatttttttttttttttttttgagacggagtctggctctgtcacccaggctggagtgcaatggcgcgatctcggctcactgcaacctctgcctcctgggttcaagcaattctcctgcctcagcctcctgagtagctggggttataggcacgcgccaccaggccaggctgttttttgtattttagtagagacgggtttcaccatgttggtcaggctggtctcaaactcctgacctcatgatctgcccgccttgggcttccaaagtgctgggattacaggcgtgagccactgcccagccatttatcacaatttttaaagttaaaaaaagataagaaaaaagatcttactgtccccctactacccaagataatcactaacattttagtgaccagccttcctcttagtctttctttttgtgagtatataaatatatacaagcttttttaaaaaaaatgggattatactgtaccttctgcttttttcatttaacatcttgcgaacaactttcaatatcattagatattctgatacaatattttaaatggctgcatttaatggatatttcttaatttgtatagttgaacatttagatttccagcttttcacgattttaatttgtacttcagtgaatattcttgtggtaccattcacataactgcacatatatgggtatttccaacaaatttcctgatcaaagataatggatatttttaagacttttgctttttcctcccactgctgttatatgctttttgtcttctgaccccagatcattcagtgaataacccaagagtctgaagctcagctgcctgtcaggggggccagcatgcactgtaaataaatgaagctgtctagtcgggtgggaactctttagaacggacacctgcagaaatagctgctccttagccccagctagttgttgccttgggggaattcagaccatcttgattaagaaacccaggtttatagtgtaagatctttcaatctgtatatggtggcagcaaaattctaaatttattatttcgacgtaatttaattattttaaaatgctatatggaaactaggcatgaatggtggattgctggtttgtgactttcagaggaattaatcttttccccactgatttcaaatgctgtgtcatgggctcattctcatttacattgggatctaccacttctactagtctgccttgtaaatgccaatgtctgtttcatacattgtccttattatagctttaaactgttttaatacctgatagggaaaaatgtttccccagtttctcttttttttcagggttcccctgcaacactcctacatttattcttctaaacaaactttttttttttttttttttttttttttttgccagtagcttgaagaaacacttaaccaaacacacttttgaattgggctggctagatcccaaatagatcatttgcaggttttgattagggtcatattcattttatagaaaaatgaacagatcatcgtcatcattacagcattaagtctttccgatcaggaatgcacaatagttatctaagtacctaaaatatttttatatcttttgttaaactttcatggtttttttgatacttcaaaattagtacattttataccaattttatacttagttgtgtttttttttttggttcttttaaattgtgaattcattttttttaattaaaaaaaattatagaaacagtctcactgtgttgcccaggctggtctcaaactcctggcctcaagcaatcctttccccttggcctcccaaagcactgggattacaggcatgagccactgcactcagccaaatcctacttttgaaaaggctaatgttaatacataatagaaaaactattgtgtagaaaggcttctgaactctttctatttcaaatagtctttaagctaattatttttggttttccagtaaatggtaacttgcctcctctccagtatttaagtgtactattttactgtcttaactaattacattcctctctcagtatctgtgggggataggttctaggacctcccaaggataccaaaaactgcaaatgcttaagtccctatataaaatggcatattatttgcatataaccttatccactttgcacatccttctgtataatttttttttttttttgtcaggcaggatctctgtcgcccagtctggagtgcagtggtgcgatcatggctcactgcagcctcaaactcctgggctcaagtggtcctcccacctctgcctcccaagtagctgggactataggcacataccaccatgcctgactaatttatatatatatattttttgtagagacaagggtgacactgttttgcccacgctggtctcaaaactcctaggctcaagtgattggctcgcctcggcctcccaaagtgctgagattgcaggtgtaagccaccgtgcccagcccctcctatatactttaaatcggcacctcctgtatactttaaatcattactacattacttataacacctaatacaatgtaaatgctgtgtaaagagttgctatactgtattgtttaaggaataatgacaagaaaaaaaatctatacatgtttagcgtagatgcaattttttttttccaaatattttctgtcttcagttgactcacatatgcagaactcatggacctggatggcgaatagtacattgattagtgctcctggggagaaatgttatataataatggtgattataggcatcccacattgatgggtatatccccagtatatacaaaaattagccgggtgtggtggcgggcgcctgtagtcccagctactcaggaggttgaggcaggaaaattgcttgaacccaggaggcggaggctgcagtgagctgagattgagccactgcactccagcctgggtgacagtgcaagactcaaaaaaaaaaaaaaaaaaaaaaaaagagaaggagatacccttttgtttctgctcctaagcagaaactccttttgtttctgttttactaagaattttaagtttttttaattgacaaaacaacatatactttaaaatacttttgaccaggtgcggtggctcatgcttgtaatctcagcactttgagaggatgatgtggtggatcacttgaggtcaggagttcgagaccagcctggccagcatgacgaaaccccatctctactaaaaatataaaaaaatcagccgagtgtggtcgcatgcccctgtaattccagctacttgggaggccgaggcatgagaaaatcacttgaaccctggaggcagaggttgcagtgagccaagattgcgccactgcactccagcctgggcgaaagagcgagactctgtctcaaaaaataaataaataaataaataattacttctaaaatttcaaataattgagaagtaggtgaaataacaagtaaaagttagcctccttcttttcacatttctctactcccacctcccagggactatcagtgtaaacatgtagtatataacttctcagatatttttctgtattcacatatacagtcataaatgcatctatcaaattggtcaaaatgttttttgcttaatatgatttgtagccacagatttccaaatattgaactatctttgcattctggaataaatcctacatgatcctaacatattattcttttaaagtcttagatttgatttaccagtatgctatttttttctttctttacttatcttttttttttttagagacagggtctcactctgttgcccaggctagagatcctcctactttagcctcctgagtagctaggactactgatgcatatcaccacatccacctaatttttaattttttttttttttttgtagagacatggtctcactacattgctcaggctggtctcaagctcctggcctcatgcaattctctcactttggcctcccaaagcacatttagattacagtcatgagccactgtgcctggcccccagtatgttattttataagactttttcatctatctatgcaagtgccattggtccattctggatgctacatattaggttcttgtatcagggttcttgttaactttgtaaaataaagtgagagttttcacatttcttgcctcatactcgggggcagttcaagtagcgtaagtatggtttctggtcctggatgttacagtaggactaatatataactcttcttgaattcagtgccctttattgggggagaggtgacagagatgtggttctttgacaatgcttagagtttctttcacagtgatttgggttttcaaattctccttggatttttctttaaagaaaaattccaatgtgattttagttactgttttagaacagatctgtgtcccagggtagaagctggccttcccaccccagaggatacctcctcaaccctgccaagcacccatagcctctctccctagtccaccccttccagggagcctctgacgtggcaggcagcatgctaaaagctgccagttgaaggccagtggttttatgaacatccaggggtgagaacagtagaatagcccctgctttactgatagagaaacttatccttcagtggattaacccacttacccacactgctaatgagaggtgtaggcagggctccaacctcagcctgacttcatgctcctgctgcagccatcccacaaaacttcagaggtgtaggccaacccctagaaacactccaacatcacactgccacatatgaggtggggtcaaggtcaagtgggaaatgtagcagttggaagcacaatggatatgtcaaagtaccagatgcatgaattatgaaagaagatgccttgtaatcccagcactttgggaggccgaggtgggcggatcatgaggtcaggagattgagaccatcctggctaacacggtgaaaccccatctctactaaaagtacaaaaaatgtgccgggcattgtggcaggcgcctgtagtcccagctactcaggaggctgaggcaggagaatggcctgaacccgggaggcggagcttgcagtgagccgagatcgcgccactgtactctagcctgggcgacagagcgagactccgtctcaaaaaaaaaaagaaagaaagaaagaaagaagatgcatgaattttgaaacaagtggttgttccttatttggggacagtgtaaaaaaaaaaaagtagttttcctctatgcaagaaataggagcaaagaaagtccttgagtgccctcttgtggagagtctcagcttgatcccaccgccctggcatttgctgagcctcctcccacccaaagtacaagtttaggggttttcccctcctgctctgtctccaagtcatggcacatccttgtaatttcagacccttttataggaatgtgcgactggcaaagtgggcatgtggcattttactgttcatttgccctggacaggctctgaaccagcagatgatgtgcttaccagggcttgacttgcagggaggagccaagtggttggtgtccagaggtcctgggttcaagtcctgttcccactgctcattggctgtgtaggatggggaagacacttgattcttgagcctcagttttccctacctgaaaatgggagactaatatctacctctcagggtgatttggggattaaaataagtaaagcaatccacagagaagattagttcagggcctggcacagagtaagcacttgctaaacgatagctggtgttattatctgtttgagctgggtaagtagtcaggtgccttgctaaggacagtaggcagcaggaccacaagaactggtagaacccaaggaaggttgggtggctgtgctgaatggcttgataaaggtgggcctggggtgtgtcacagggtcaagccacttaaaaggagacctgggctgatctggctttgggggtggcagggccggcccaagcctgggagatacagggtcatacctaatccattcaccagcagcctaggacatcactttaggcaggttacctacctcagcccacagtcaatgccccttacacttgtcccacccatggcagcacttaatggacacaatttttgtttttagaggcagggtctcgctctgttgcccaggctggaatgcagtggggcaatcatagctcactgcagcctccaactcctgggctcaagctcaagtgatcctccagcctcagcctcccaagtagctatgactgagccacgatatccagctaatttttttttcatttttgtagagacagggtcttgctgtgttgcctaggctggtctcaaactctgggcctcaagtggtcctcccacctcagcctcccaaaacactgggtttacaggcataggccaccacatgcagctcacaatgtcatctaaatacaatttgtacctgtcttgggatggggggctattctctgggatgacagggacctggacaagtggacatagggcaaagaaagactgaataatgggcagggggcggggaggaagggagcttccaagtgagacagtgccaggatgccttacacctttgagggtccatgcagcttgttgaggtgggcttgatttcctggaggctgggacaggagctagggacctgacccatcagtgaggagggagggccaggcccaccagggtagcagcctgggtcccgatggcccccagttagagaggttatgggtgacccattcataggggcttcctgagggtgtgaggactgctgagagctctcccagagagacccaaccctcagggcttaagttggggtggtggggccacgaagtgggcccaggctttgatggaccctcaggagtgtaagggggaagagtggctaagagtttctgcttggatttcccatcttgggctcaacccatggcccttgatgctccctagttatgtggccttagacaaatcactcttaacctcttcagccctgtttgctgagcagtaagctggggtcaggatgcatctgtctgcacagtgatgtggaggaggattaaattaggtgatgtgttaagtgcttagcacagtatcctgagcatagaaaacccttatgagagcccaaaggagaaaaaattaaaagatttggacccaggcccaaggagtgatggtggtggtgctgatggggtgggtgtggtggaaatagggaggcctggacacaacctggttatcagcacagaggtctgggcagaactcacctccctcccaacttcacaccctgtgggcagagcagagagcctcccattggccccttacctggtcctggctgaggatgttctgcagaggcagaggcctaggcaggacagcaccgggctgctggggcttagggatggcaccccctccagcgctttttctctgctttcctccaaggctgcattcgcgattctatgagctggcccccaacctcgtcccaatggactacaggaagagccccatcgtccacgtgcccatgagcctcatcatccagatgccagagctccgggtatgtgcaggacctcttgctggcgagcaggggatctgtgcctctggaccagcagcagaggcccccaggtctaggctgaacccagctccaccctttgtgtctgcgtggctctgagcagatcacagaacctctctgtgcctcagtttcctcatctgtactctgaataaataagctatgtgggctctgtaagggtgctgtacatcagtggccacccaactgcaggccatgggcttgtgctcatttgcttgtccctttgttaagtggccccaagcctgctgtagttggcagacctgtgtctgctttgttagataacttttctgtctcccccttgtctggctgtggcttctcactgaggtcagcatggtggtcatccatagcatcatttctcagactttaacgtacctgttaaaatttaattttaaactccccagggatcttgtccaaatgccaattcaggctcagtacatgtggagtagagtcaggattctgcttttcgagcaagctcccaggtgagactgatgctgctgatcctcagaccatatatatctgaatgtttcgtttcatgagttccttatccataatatgtaaagtgcattcagcattaagaaggcatttggggcacaactccccattgcagtgggacttcgtcagtagccccttgccaggcctgggatgtgtggcttgaaggtggagtcagagtgctatatggcatccacttggggcctgcactctggttgtgacctcagtcctgagagacaatgggccccaggctcagccctggaccagcaccccgtctggcccagcaaggggctcaagagcaagctcagagggttgctggagcaggtgagacactcatgggtaggacccaagtggtctgtctctgagcctcccgcactggcctgggctgggcacggaatggcgctagccaagcgctagctcagttgggatggaagggctgcaggatgagtgatttggggatctaggaaggcatccgtgtacagctccctgggagaggcagcatccaaggtggtctaggggagaattcacaggagcagagtgacagcagacctgggcctgaactggctgtatggctcttgctgcttgactggtccagttatctgaccccacatccacctcccacgatcctggcctgacacggcctgagctgagggccaccagtgccctgggctgtcatcttcttctgctggggacagagccctacacatccaggcagagcctctgtgtgcttttctgggtaacaggacgaatctgtgcttctgcttctgcttcagatgaggcagtgcctccagtgataacacactggctgtgctcagcatttttttttttttttttttttggagacatggtcttgctctgtcgcccaggctggagtgcagtgggacgatcatggctcactgaagcctcaaactcctgggctcaagtgattcctccacctcagtctcccaaatagcgggactacaggcgtgcaccactgtccctggctgtgcccatcttaatgatgtgacatgacccagtagaatgcttcctgagctcttacatgtgccgggcctggtaccaacaccttacatactttagctcatttaatcccatcacaacccaattaagaaggtgttattattattccctttttacagatggggaaaccgaggctcagagggatttggtcactcctccagggtcacacaggctgtccacagtctggctccggggccctcctgcttatcctgcacccacagtgattgctgtgtgtgttttcttcaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatggtaaccagggctagaggagggggcctgaatatgcggggggggaacatgtggggcccttaggctgtctggttactactggctcctgccctagggacaccaagaacagtgaagctgatctgtcctctgaagagtgcctgtccagtggggtggccaagggagacgatcagtccctgagagacatctgtgagggtcctgagaacgaaggagggagggactcacccatcccaggtcgggtggttagtgtgagaggggtcccaggcatgacctttaagcagggactagcagaggcttggactggagaagagggggctggcagacctgacagagggcgcagcccatgcagacacagggaagcgcagagcttgataaggagatgggaggaacttggaaggtggtgggacagggggcggtatgagtctggagagaatctggggccaggctgtgggagccagccacagagtttggacctagtgatccagacaccagggccactgcaaggtttccagtgaggaagggcagctctgttttctagaaggatcactcagcagctttgaggtgtaaaatggaggagccagagaggctgcctaggccatggtggtaaggccaggcctgcaggggggcctctggagcccccccgaatactgcctgaggtagggccacctggattcaccccgcccagctctgccctcaggctggctgtctcaccagccaccagagggcggcgggcactcatgagccaaggactcatgcttctcccacagccacagggagaaaacttcatacccacgagctcaccccctctgctggcctgacagacccatggggactggtgtcaaatcctcagatagacctcagttgagatgcctaaggcctaggaaggggctgggacccaacttggacctgaagagtcaaggtcaaagctcctgtcctcagcacgtttgatcagacactggatcccaaaggcagcagggcctatcaggggctgacattttgctttcttttttcttttcttttctttttttttttttttttgagacagagtcccactgtcgcccaggctggagtgcaatcgtgtgatctcggctcactgcaacctctgcctcccgggttcaagcgattctcttgcctcagcctcccaagttcaaacgattctcctgcctcagcctcctgagtagctgagattacaggtgcccgccactacacctggctaatttttgtaattttagtagagatggggtttcaccatgttggtcaggctggtctcgaactcccgacctcaggtgatctgcctgccttggcctcccaaagtgctgtgattacaggtgtgagccaccacgcccagactgacgtttcactttctagttatcatgtttatttcagaggactttggtttctgtctgtgcacccacgttttgcttgcatattagaaagaaaatacctgccagtctgccctccacaaactatgcccacatggctcatgtaaaaagcttctcagattccacccaacatccgcccggtcttggaccccatagcattgctcctgggacgggctgctgtctgcccaagacaggggcgtgcagatcgcatggaccgggtgggcacaggaatacatggaagaactgtggcttccttgctgctctaggctgggggtggagtggggagaggcagccagggccctcctagtctggcgctggggaggcctggggcctcatttgcaacaatgatcatctcacttctgagcctcagtttactcaggttaaatggccacaggaattcagccagccagccagcaaatctttccagagatttgctatgtcccatgccatgggcagagatgaatactccctgacgcataccctagagttgtgcccaggcctctgcagagatagacagggcagagtcaccccaagagcttgggctctagggtccaacaatgaccgggatgtgacctcaggcaggtacctctccttttcacctccctgtttctttttttatttttgagatagagtctcgctctgtcaccgaggctggagtgcagtggtgcgatctcagctcactgcaagctccgcctcctgggttcacgccattctcctgcttcagcctcctgagtagctgggactacaggcgtccaccaccacgcccggctaatttttttttttttgtatttttagtagagacggggtttcaccgtgttagccaggatggtctcaatctcctggcctcgtgatccacccacctcggactcgcaaagtgctgggattacaggcgtgaaccaccgcgcctggccacctctctgtttcttcatgtgtatagtggagattcaattgtgcctgcctcatagttttgttttgaaaattaaatgagaaagagcatataatgctcacatgatgggtctttgtcactaccattaatgtcagagtttgccaatgggcaacagaagctcatttgcggggaagaggacccttatcgctagaaagccccgccactgggaggtgatgtgtgagccaaaatttgaaggatgaccaggagtttgctgggaagggaccccaggcagaagaaacagcacatgcgcagatctggtagttgggctcaaaatgtaagaagagagagttcactttgatgtggccaggcatggctcggtcctctgaaccattttgctgtgctttggggcagtggtagtgccttttgctgggtagaatcaaaccatgttccctgctctgtgtgcacaaaggccaggcacaggcccctctctaagggtcttttgattttgagtctcctgacccaccgtgtcttctggtcacacaccactgaggcaacggggtgcagtttagaaaacatgggtcttagagtcccataggccccagtcagaatccctgctccatctccgagtggctctcccaccttgattcaatcgcatggcctttttgggccttagtttccttagctctagaagtctaaagggaacactgggtccactgtgggctaaggccaggaagggctatctggcctaagcctgaagttctcaggaaacctcagatttggacttttgacctgcttcaggatgtggtttagtcattgtggggttgttgttggtggtggatgtgggtgtttaagcgatgcctggtgggtaagccctcttgggggcagggatccagtatcccaagagtgtgcatggagatgctctggggacatcagaagctggtggaggtagtggggccagctaggaggaagagctatagtgtaggggtccctgggtgcacgcagcctggacttgaacatgtccaacccctgccctacagacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcaggtgctgccactacaggggccgggcttgggcagggcagagcagggcaggccgggatgttggggctgaggcccctatcactcgctatttgtgagcagtggtgtgcggccaggaagcaggaggtcacgttcaagccacccttgccctagacgtgtgactggcctttgtcccctgcagggggaaggttgaagacctgggggccccttcagtgataagtgggggcagaactccctgggcaccgctgttcctccgtcttcccccagtgttgattacctgcatccactatgcagggttccctaatgaggcactgtccagcatggggctggggcctgctgtgcttttccctgaggagcctttacctgcccgacccagggcctctcaccctctcttgccctttctctctttctagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggtacctttgcttctgatccttgaaatcccaccattggtgtctcacctctcggcattaggcagtgcctcctgctttaggcactaactttgatttcagtgcgtgtgccatcgggaggaaaacacattcatgccccgaaccttccgtgaattccctgacagtatctctggttaacatttgggagtgctaaccactcaggcacagggacagttgcttcagtctcaatccttaaacccccaaggagggagggactcttacaggcctatatttcaggaaaagctgcatagccaagtggtcactaagagtagatttcccacaaatgcaacctgagcccgctctgcccagggtcagggcagggaggaggggcacgtatggtgttctctctggagatgatcagtcctgttttctgcatcccaggcctgggggttgttgggagtggggtagcaagccagctgtccacccttatagagaaggggacatgtggataggaagggaagtgacacacaaaacaggaagtttcctgagggacagagttccaggaagagccagcctgacctgagggtacagctggagcgaagaggcctgaagcagaggatgtggcttctggccctcccctccttttcgctgatggggccgcaaggaggggaactggttttgttctcggtagcaattgcatgatgtcacttggccagttagaaaggtgtctgtgctagcacacagcctgccacacattcggtaagtgctcagtagtgggaggcaggttcagtcagtctgcctgggcctcagcatgcttatctgggaaatgggggtggtgacccctgcctttggccaatctcattcctctccagtccctcctgtgcatggatgggaggcacaaggaaagcaggacatagccaggagctgcaggcacctgcaaggtcctcttccacctgctctcaggcaggcacctcggctgtctcggagcctagttctgtagcaggctggatgagtctcaagatccaaagggtgccttcaagtgagctgaggcctttgcgataacccctggcatggcctgggtaccaggaaacccactggtgggctgccggatgccaggccctcagaatttgtgcttcctgtacgtgaagaagagcctccgaagcttgtcaggctgcaaggaaggaggagatactggggcctggggtcgctggacagggagggaaagacccaggctccgaggacccctcattgaccttgggttgggggcccaagcctaggacatgaggccaggttggaattctgatagttgattccacaagcctctcccagtgcccgaaatcccacctttagctccccaatttcagatgcagggttcaccctcttctggctaaggagagaaggggaagaaggagggtagaaagggtggcgagcctcaccttacctccctggagtgccctggtctcccctgacccacagctgggggcctcaggatgcactggtgtccgaggtagggtggggtgaagctgtacccaggcccacagagatgggagaggacatggggcagccgcagggaaagagcagacatgggatgtggcttctgagggtctccactgccaggtctgtggtccccagagagtgaggatctcaaaggctgctatccatggggtgtgtgggcacagccctgccctgagggaggagccgtcagcacttcccaggaagatctttccaccaggagcccaggcaggaagatccgcgtgtgcctgactgagatcagaggacttgcccatggggaagggactctcaggttttattgtctctgggtataggcagagtgtagttgggaccgagggctccagagagttcatctgcctccctgagaaccctgaaccagccccactcctggccaccgctctccacactcctggtcccctctcttccttacttatcagacccctgcagaaactgagagggaggggaaaggacccc

SEQ ID NO: 12593 - DNA, 5805 bp, Human
atccttttatatctcttgttaccctttttgatttaaaatctctattgtatgatattaatgtagccattcttactcttttttgcttgctatttgcatggaatatctttttgtaggctgtcactttcacctcatttacatctttggatctaaagcaaatctcttgtagacatcataaagttggatcatgggttgtttttattttaacccattctgccaatctttgtcttttggcagagtttaagctaaaagttgggagcatttaaggcatttacgtttaaggtaatcactgataaggaagggcagacttctatcattttgctctttgttttccccatgtcttatagccttatagcttttttgatcctaatttcctgcattactgcttcttttgtgtttggctcacttttttttttttttttttttagtgaaacttcccttgtcatttcctttatgtacttttttttttttttttttttaatggtgtctcactctgttgcccaggctggagtgcagtggggcgatctcggctcactgcaacctctgcctcccataatcaagcgattatcctgcctcagcctcctgagtaatccctcctgggattacaaacgcacaccaccacacccagctaatttttgtatttttagtagagacagggtttcaccatgttggccatactggtcccaaactcctgacctcagttgatccacccacctcagcctcccaaagtgctgagattacaggtgtgagccaccacgcccagttctttgtatacttcatgtagctctttttttaaaatagttaccatggggattacatttaacatcctaaagttacaacactctaacttgaatttatacaaacttaacttctttaactttccttgttcttttttgtgccgtgttgttctgggccagtgttagttgctcacatgtcctgtctttcccttaggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggtctgtgtttaaattgcaccaggaacctgtcctgtttgacttgtcttgatgccattgccagagacacttcacttcgaccttcccctcttcactcttaacagtttacaaacttgttatttctactacttgtcatttttattttgacttctagctaacgctaatcctcacctctctggactccttatcctacctgttcttttcactgttccctctgtagtgttctttaatattattttgtcctgaagtgtgcatatctcccttaatagtccctgaacaccagttactgttccagtgagattttcctgggcctgggcatacacttcacagcatcacttgtcaccagcagatgtgatcccactaaaagctattatcagaagaattaattgtataacatgcctcttagtcctgggccataccttagccttgtgcactgtacctgggagggcctaccctattccgtaaccttagggacaagtaatgcacaacagctgcttcctcaacctgaccccccaactcacttttcctaaaaacaggcccatatactggttctttgctgtaactgatgtgcatttgcaattgcattgtctcctcctaataaaggtaacatgtacttcaccatgatctctttacttttaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacactgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttggcatttgattcactctttgaggtggttcaaaaacagaatcgggccctgccagctttacagagtaaacacctttggagggagagggaggtgtcatatgcctcagtgacaacagtataatggaaaaatacaactgtctttccagctttggcctaatctgaatttgaattattgcccaaggccttctaggaaatactgcaggatattatggtcttaattcgtggactggatgcaaggattttttgtgggctcaaaggacaccctgaggaagtgggaaattgtgacaaattccattgcttctgggaacaagatgaattttgttgttattcacaagggttattacatactgcccagcactgttgaggcagtctacccccagtgctgccaaggagccaagtgccccaatacaatttagtaggctactgtcactgtaaaatgatgggggaaccataattggtgtggaaacactgggttactagggagtgaaggagactgcagcaaactagatggaatgtgctccttgtaatatgttctagtaattgtgcaggatcagtgtgtacagacattcttagaatttccaggcatgtgtattttttgtagctgaggtgactgtcaaaaaataataaacaacctaaaggttttgtgtattccaatagcctttctgggatgtgcacctcaagaacattgctgcataggccaggaaaacaagcatagaaagaaggggcgggggatgtccttccaggaatgtgactttgtaacctaccatcatcctgtgtttaaatgaattcaaatcagtttcattgattaccagtatttgctgcccactgaggcaaggtgtccctccaaggtcatcaggaaagagagttaatgtagggttaccaaacctagtcaaaaacacattataccatcattataattattacaatgaacatatcagtcacctcggatttacctcaggcctttttctaagctctccctcccctctctggccctcaaggcaaccattgatttataccttcatttataataggtttgtttgtattttctataatatatgattttattaataaaatgtctttttttccagtttcattcatgatgcataattattttgagattcttcaatggagcttatatgtggtggtcattctttttattgctgagtggtatattttttatggatatactatttgttatccatttgtttataagcatttaggttttatctagttttggctattacaaataaagctgctagaaatgtacaattcttcatatgtgcatttttttcacttctcttgtgcaatgcctgagacacaggataaatgaatgtttaacttattaagaaatggccaaaaatgggctgggtgcggtggctcacgcctatactcccagcactttgggaggccgaggcaggcagatcacgaggtcaacagatcgaaaccatcttggccaacatggtgaaaccccatctgtactaaaaatacaaaacttagctgggcgtggtggtgcgtgcctgtagtcccagctgcttgggaggctgaggcaggagaataacttgaacccagaaggcggaggttgcagtgagccgaggtcacaccactgcactccagcctggcaacaaagtgagactctatctcaaaaaaaaaaaaaagaaaagataaatggccaaattgatctaaaatggctgtttgctcttgcttacctactgggaatgtgtgagaattccagctgtttcacatccttgccaatacttggcatggtctatcttttagaatgtacccttttaataagtgtgcagtagttttaattgcatttccctaaggattcatgatgttgaacattttttcatgtgtttatttgccaaatgtatatcttcttttttacacttttttttttttcttttagacggagtcttgctctgtcacccaggctggagtgcagtggcgtgatctcggctcactgcaagctccgcctcccaggttcacacca

SEQ ID NO: 12594 - DNA, 69263 bp, Human
  misc_feature (1)...(69263): n = A,T,C or G
agtgttcataagactctggagtgctaagtttatattttattttgaaattgatgagaaatcaaggaagagacatagtaatattaacttttcagaaactttcttctgatgatagtgtgaataatggattaaagaggggcaatactggaagcaattagacatgttaaattcactgtgaagcacttttgcatccaactgagggggaagctttcaagccaccaagttttcagccacatgttttctactctctcaattgaactcagttaattgacccaatctatcttaattatctgctcctgaaaagatcacagcccctcagctgtgttttgcccacatcatcatctttattaaatgtaattagaaccctctcttctgggttaacctcaggaagaaccagctccttgatattttcatgccattgaaattgtggcgccagatatggccacagtggatagaaacagtataacttttctgcttacctttcactacatttttgagaaggtctgaaaatttttcataaaactctcagggatgtagttttcagtttctgtgacctttgtctttctgaaatgggagaggttcccttgtccccctcacagggcgtgcattgggggtgtggctcgcttcttcagtgccccgctgctcagacctctagagaagcatacagaccggcaggctgtggggctccgaccccttgacagagtctgggggtgaatgtttacagctcctgaagccccagtgggtgtgtgttacaggatgctctttcagtttgcctttagggggcttgtgttaaccagctcaattagaccctctaccttgtcgcacagacagcgagctttctgtatcctgggttcttgccttggtgtaccagaagaattggatcacacgtgggcttggagaatgagtgcaaagttttattgagtggaagtagccctcagcagatgagggacccagaagggaaatggttttcctctggagttaggccgcttggcggcccgggctcttttccgactgcccaggccaacctccgcatcgttctgcccgtgaatggcctgcggatgtgccagcgagctcctcttcttccacccttatgctcctctggacgtctggctgcctgtgtacctgcctgctagggtctggggttttcataggcacagtatgggggagtggcaggccagggtggtcttgggaaatgcaacatttgggctggaaggcaggagtgtcagtcctcacctaggtcggtgggcgtggagccctagcaagggaccacacactcctctacccagcacttcacttcgcccatccctatcatttaaagggaccacgctcttcccttcccagcactcccctatcatttctacactgtaaattttttttgtttatatttgtctcatctatcaggttgtgaattccttcacattaacttgcatggaattcatcttgttataatgtggtacctaaaaatcctagtactctggttcaaaaatatatgtttaacaaatgttcagtgaaagcgaatgaatgaatgaacgatgactcccacacacggaggaaccctgtcctcctgtaaggtacatgatttgaaggtcccaacaagtctatcttggaacaggcccagttgcgatgcccatacagttctcggactaacaaaaagtgtcacaccatccagatatgcttaatttggaagcagctgtaagcagactcccggccagctcaagtttcctcacctgggaagaggcgggaggctgtttaccgtacggaagcatagcggccgcctgcctgagttcgggagcgcgggttcctttccgggaaagaagcctaggccgttttccgtacagcagcatggcggccgccgacgggaggcggtcatagcatcacgcccgggggaagaggccgccgtaaaggaagctctgcttcctcttcttccttctcccgcctcccaccggctgtcgtaaaacggtgaatggagagcgagttgtgggggggaaaaagggaggacagggggcgcggagtcagagtggcgcagcaagtggccgcaggtggcgacggtggcggggggtggggtgtgaggtaatccagaggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccaggtgaggagagggtcttcggcgaccctcttccgccgaaggggcgcccctgccggctggccgggctccctctccccggcgcccctcgtcctcacccccaccgggctggggctgacgcctcacggctggtcccgctctccgaccccgctgccccccggtccagtggagcagagctcccaggatctttgccgaacagctcgcgcacctgttggccacctttgcaccttttcgtgtcgtctcccttctccagggcagtttgttctgcctacttggtccgcaagaagcagtttttgcaacctgtgctagtgttttcagggtgtgatttattttccttaagtgcgcggacttggggagcaggtgggaattttacttacagttcaaatctgagttcagcttttttccaaacccagccctttttaggtgttgctgtggagcacgctgcccaccgcctcctcctgtcgggttggcaggactgttttgacaccgattggccgagttttgcggagcgctgggcagtgctgttgggagagtgctctgggaagaataggcagttttcatggtgatactgctttatctaagacacatcaaagtaagatgtgttggagaaatttcttatgaatgctaaaatgtgtaagacttctttcttttctccgtctcctgttcttcctaattagccttgacgtctttccagcgttacccccacacttcaaaattttaatgatcccaaactccagcttatttcttcttccctaccggtacttaagaatcacagacctcttactaaaaagtagggattaagagctaccactgggatggagcaacagctgttttaggttgtgatgacttgtaaaatgtaaatattccaaaatcagctgttctcaaagcgttgcccaggacctggagcttcagcatcacctgagaacttacaaattatgcaaattacggggcttcagtccagacttaacgaatcagaaactgtgggggtgggaccagttgtattttaactagctcccccaggtgattctgtgcctcccgaagtgtgactgaagtgtgactgtcctaagtaaatgtttctgttggaattgactttaaaaagctgcgtgttgggaatctttgaaagggattattttaataggaaacctaggtggagtttggagtaggtataaatgcaggattccccagagataaaagggagagtgaagacactgccaatggagaggaggttgggttgaactaatgcccaaagataatgcactggtgcctgaaaaagaaatggactgtcacttagaatagggggaagttaaagtcagtacctgtcccaggctttgcagagtaaaagtactgtatgttggctggctggaagaatagtaatccaggggttagttaggaagaacaaagcaggagctgaatttgcagtctactaatatgaacaggggagttggcctgtttatgacccccttctcacaatgaggccaggtgttcctttgatatcaggttacacttccctgcccttcacctaaccttcatttctttctgattcatcagtatataagtacagttgatgttatagaagtggaaaaagtatatgagaaagcctgcagaactaggagacatttaagacccaatcctattttttttcccatggtatttcagacaaaagcaggcacgttcagggtggtatggccgtagactcttgatggtagttcaatccaaatccattccatcatcactctgccctgccccatagtgtcccacctcatcacagaccgtggtttccccagcaatttctaaaggtagcttattgctataccactcatttagcatttataatttatataaagcatagtgaaatgctttaaggttttttgaatcggctgtaaatagaacaaaatataatgtcacctaacagtgtagtaaaacatgcttatgatgatgggttttgcctgcttgtcctttgccaccactgtaacatccgactttgttggataaatgagtgggtaaatcaccataagtggttatggtccacctcttcgactttagtctaggtctcccctcagcaagtatgttctgcatagggaatgggagcagcttctgcggtatactgatggatctgtcaattgccgtttagaaaaataagcagcttctgcaccacagcctatattccaatggataaattctcatttggagctatatatttttttcaggccagcatttttctgttactagtgagtagttttctgactgctatttgtgatattgtttctgtgggaaaatgtatttgtagttttatctcaggatattgagcgaaccctatacatcttcctcattttctatagaccagaagtcccattagaggcagcatagaggaataggaatgggtaggtaccttgcttaagtaattcatccagaaaggtgtcctcttttaataaattatccttcacatgggctcggtagggaaataagtttttactttgattgccaagcttttgaatctctgctttccatgcatgtgtacatgcaattttcattaccctttattaagataatttgtttatgtaaatagcacagaaatatttattaagttactatgttgcagatattggtataagagtttgtttccatggagctggggatacaggcaagtaactaatataatttcaggtcataagtgctgtggagagtaaagcccgagcaagagtgttgggatgtatagccattctctgaagaatggcattgagtagagagttggatgttgtgaaggaatgggccaggcaaagagcagagagaggaacaacggttcagaaaaggccctcaacttggcgtgctggaggactgagagggaatatcggttcagaaaaggccctcaacttggcatgctggaggactagaaaggttaatgcagcggagcagtgagtcagaggatgggaggagacatcagttttttgctttatgagttctcataaatgcagaatttagttaagcaaactgcgtatttgcagaaaacttcacagatacaaaatatcctcaggaaatcattgagaaattagtcttatttattttttagaaactcgaagcctgaagaggcacaaagaaattgagtaactatttctgagtaaagtagtatgaaaatatatctgactatatctctgaatgttttagctggccaagttaatatagaatgaatcaatgctgaaagaagacaaggtttctgaaattttttaaaatggcaaacagttgcaaaaagaggagtttcaaaatctgtacaatggcaacagtgttgacataaaagtctctgcaataggtatattactttcaaataagtagcatttatttaagtgtaaaggttattttgtatgtgtggaataagatttttaaacaaataacggaagtcagtttttttatgattagaataaactatatagatgttttaatctttgattcatgacaagatctttcagtatttacaaagataaacatgagttataatacatatgtagaaggtgaaggctgggtgaatctgtgttaattttgcctcctatcaacggttgttagaacaaatctgttttcttaaaaactgctttgaaattctgatggtttcaattatggataaaaaagaatttacatgccacagatttgtgatctgaagactacacaggatgaaaggaagaaaattataattcaaaattttgtgaaggatatagaaagattgggaaagcacaatgttcttggatgaaaaagattaatatttttaaaatgccagttgtgtccaaattaattttttaatcaaacacttaccttcatagatgtgattttaatttaaaaaaatgaataatatgcccaaacctagctgtgtattgaaagggatgcccccacagatccaggctctgaggagaggggtgagctgaacagactctctgggtcattgtctggtttggcctcactggaatttgagtcttttcaaatgaatgtcagtggacaaaggcatatgtggactctggaatgtgacaggactgtaatatagtccaggtactgtacatctggatataacgtgatcagaaggagtggatgctctgtatttttttgctttgaaggtccccatcgccaaactcaggagcagatcatagtagagcacacctgtggggtgaagtgacccaggccacagggcagagcaggagcttcatccccacaggctcacttaggcattaagtgtaaaagatagtacagcagtagagggcagctggtgatgacagtgtgctcaaccccatctcgtgagtcacactgttccaatctggactggcttctctccattgctcacgctcaactttgtaacattatcttctctgttttgctctgttgggtctcctatttcctgtagcctttgtttttttgttttctgtttgtcaaaaataccataaacaaaattgaagcacaaataatctaggaagaaatacttgccatgtataggtcaaataaaagattgagattttaaattcataaatagctcttagaatttattaagaataaagcaaatactccatttacaaaaggataaagggagtaaggaatttgtagaaaaaacagccaacaaagaggaaaacacccaacctccttagtaatagagaaaatgcaatttaaaacattaataaaattttaaagtttcaaaggaatgatgatacctgtattagatagatggacactaccatatgctgctgttgggagtgtaaattggtatactacttctggagaccattctgacaatatgttaaaaaaaatcataaaaatgttcacattcttttattcatcagtttctgctcaggaaatttttttgacttgaagtattttagtaatcttcattttgccttgaagggtttgtctcagtttaaaagtttttcttttatttggacagtaatgtattcagtaaccggtgctaacttataagctactcacttatattgccctattttataaaacatttctttgtaatttcagtcctacaagattatcaattttgcccccagtttacttcggattatagtctctgaccatgtggaattcccagtacgacaggcaggtgagttggttttttatcctttataaatttatttataggtgagagtagaatgggagttttattttaattttacatatctgtaatttattgaaaaattcagaagcactagcactcatgaagtatttccagtgacttcaaaactcactttctttttccccagaaatttagaggtagatactgagctctcaaatatcttctagctcttttttttcctcctctcccttttacccaccaattccttgcctctgtaactttgcccttatttttctcaattttaatagctgatctctctaacgttttatgatttctggtagcctagcctctgggcccatagattaagaccatgaatttatatatgtgaattcgagctctgttacgtggcaaatcatggaggtaatgtgttgcacagatgttcctaacccaggtgactgcggagcaggactatgttttaaacatgaaacttacttttaagtctgtgggatcttacgttgtttcatgatgttgtacatcgttcttttatcttgtttttttatggactggtcattagagcccagaaggttaaaaattagagccttagagtatcatgaattttcaaaagataataatcaaaagctaaaggaggtaaacgacaatagctaattaaaaataagtatttaaaaagacttgttatgtaagtgacatatacatgtaagtaatttggacaatttagaagaatacaaagaaggaagtaaaactacccaacattcatcactcagaaatggccatcattactcatcattaacgttaggtgaacattagcctttccatgtgttcacgtagaaggatagatgaacagtttcagagaaatgggtcataatctacatgctgatgaaagtatttaatttgatttgaacatagaataaaaagataaagaaatattaagctttgggaagatttataacactatatatgatttcctgaaagatcactttgtggttaagataaaaaagaaaatcctatggaaaaacactgatgttggaattattttttgcttttataaggtttacaagacttctgtgtaaatttttgaaaccacaattggcacttgtttcatctttgttttataaaatagggctgttctggaataacattttgttgaatggaacctattttaaaaacctaagtgtttatagggccattgtaaagttcctatgaagcatttaagaaataacattttaaaagatcttaaaacaagtttttacattaatgtcttcctttaatgacatggaaacattagaaaaacacagtttataacttacattgttcttaatacacccaaagatgactgccatcagctttgatgcgtggctctccaattcttttttttatattacacatgctattttacagtttcctttttttcatttaaccatgtacccttgaagattgctccaagtcagtgcatatagatacttcattctttataacagctgtgcagtatttctttatataagaattaccatggtttacttaaacgatttgatattgatggacatttcgcttattgtctttttttcattgttgatagaagcaatgctaaatgagtgtcatttgatatgtatctaggtacttgtgggagtgtttttatagaataagttataacaaggggaaatgcttggctaatggatatttatgacatttagaatttagaatcttctcactaagttgcttttgcttacattttctaccaacagtgcattagaatgctaggttccccaaatcctcaccaactctgtacaacttaatgaagttttgatgtaaaatgtaaacagcattgaaaggcatttttttcttcataatttgttttttcataatttagatttcaaatcctaaatttaagtggtatttataaattttctgttctgtttaatctattattaaaatacaaggatgctccaagacacctagaaagataatttatctttagcatgacacttaaaaaagaatgttgtgatttttgctttaaaagaaagcctgtataaagctgtaaaaaaaaagttatgctaatgttaagtggaaatacatctgcaaaatactttttctcttttgcttgtgggcaatctaaagtgttcttgctaccatcaagcgtgctcactggtgaatgtgctttcttaccttactgtgagttttcaagaaacaggaaaaaattaagtattttgatgttgccaagcaaaacaaaaaaatttgaatgtttggtctgctgcttttcttttgaggtgttgataagcataatagcattattaatattatcatgtgcggtgaaggaagcctatcttaaatttaggatagttatgatctggaatttcaaatcacttttgtttctaattttttacttcttacatctgaagagactctttagtaaaatttctctaatatatgtaaatttaggctcagaaatgtacttttttcagtgcattttggagttgctacgagaaggagagagtagtttggatttaaaagtggtggttgagaggtattagacctgaagaggtcatcagtggtgacagatgtgggactgtcatttaaaaaaatagcatggtttttgatttctataagtttgcctgctccttgttgtttctttttgtttgtatttccaaaggatggacagggagaagatataacaattcattctgtggttatttgtttagaggttatttgttaagattgacgtcagcattgcagagtgcagaacctagaaataaacagaaagatgcctctgatcagtccagaagcactttaagaagcttttattaacattcatgcattttatttgtagaaagctttgtggcttgtgctcagaatctatttaatattgttttgatagaattgacacatttgttgtctaatctagcctttcacagagtaataagggagagaaggggtacaaaattacaatgaaaaacagcaagacttagaaacatcaactcaaaagcatgacattctgcccaccgagataacagtactttctccactttgaggttatgaaacccaattgattctgtagttgtgtctctgggtccagagcttaagtgatgattcattgtgctgaaggagaaaagtgtgtgtgtgtttttagaaagttaatttcaacttatgatgcttaaaatggtgagtggattttgtaggaaaactgtcttagagcagccatttttatcatagaatctgaaatacatttataaaattctacattataactatcctaaatttaagtgccatttgtagattttctgctctatttaatctattattaaaatacaaggatgctctaagacacccagacagatacagtaaatttaatatttcctttatgaattggattaacatgatattagtcctttgtttcttagttctggcaaatggtttgtatttaggcacttgaattaaatgattaaagggaagttttcagattattggttgatatggtaacagttatctttggtatttttcctttatccttagtaatccataattatccatcatagtaattaaaattttctttttaatatattttcaattttattttacctcattgtacatttatttaggcatatacaaattagtcagtgtgccttttttaaaggctgtctcgtttgatgcaccataatttttaaattataacttttcatttataaaattaatattaatagtatttaatgactaaatcataaataagtccatgattttaccgtgtctgtatttttactgtctaaaggttgcttttctttgttttcaagactagttctatagggatcaaaatgattttgtgactaatatagttgatttttctttttgcaaagattgatcctgtgaaatcaggctgggtgttcatgcctgtaatcccagcactttgggaggctgaggtgggtggatcacttgagcccaggagttcaagaccagcctgggcagtatggcgaaaccctgtctctacaaaaatacaaaaaaattaactggcgtggtggtgcacgcctgtattcccaactacttgagagactgaggtgggaggatcacctaagccctggaggtggaggctgcagtgagctgtgattgtgcccctggactccagcctgggcgatagagtgagaccctgtctcaaaaaaacccctaaatcctgtgaaatcagtctgaactgctgacaggttggttcatatccttagatcattcattcattattttttgaatagtctatacatttttatggaatgtgtactctttgccagtcactgttacataatataatgactatacccgataaaacatggtacctagtctagagcttgtgtggtctgaattaaaaacaagtaagggaaaaaagaaaactctaacacacatccccctttatataatttttgttttcacccaaatgaattgaaatcatagatggaacagtttttcagaactttagctactcaaaactaatgaaagaggagcttaccagatgtcaagttcataatttcactaaatttcttttaagttttagctaatgtagaatgtattggtgtattctttatggtatagtgctttgactacccaatttagttttttttttttttttttttgacagagtcttgctctgttgccctggctgcagtgctgtggcatgatctcagctcactgcaacctccgcctcctgggttcaaggaatttgctggaattacaggtacctgccaccatgcttggctaattttggtatttttagtagagacggggtttcaccatgttggccagggtggtctcgaactcctgacctcaggtgatccgcccgcctcggcctcccaaagtgctgggattacaggtgtgagtcactgctccgggtcatgaatttagttatatgttaaaagttgggtgaagaaagagttgggtggggaaagaagagaagcttaagggaagaaagttatgctgctttgcaaatcacgtatctgtattctttacacacacacacacacacacacacacacaacattataagtatttacttacattcactgttcaactgggatggttagaaagctttacattctggccaggtgcagtggctcacacctgtaatcctagcactttgggaggccgaggcaggcagatcacctgaggtcaggtgttcgagaccaacctggccaacatggtgaaatcttgtctaactaaaaatacaaaaattagctgggtgtggtggcacatgcctgtaatcccaggtatttgggaggctgaggcaggataatcgtttgaacccgggagacagaggttgcagtgagccaagatcttgccactgcactctagcctggatgacagagaaagattccgtctcaaaaaaaaaaaaaagaaaagaaaagcttcacattctttcttaaaatgctgtagcaatatgtcagcctgtttctttcagaagccttttgttaaaggttgaagacgattaaaaagaacagaacaaaatcagattatgtattttgatagatgtgaacatataaaaattttctgagcttttttccaaaaatttttgatggctgatgttcatttccctattatatttacaagtagtacatatttcaaaaaggttggatgaaaattaccaatactataaaaagaagagataccccaaaatgctagtgtttgacagtagccagtgggaaaacaaaaaacaaaaaaagccatcttcatgaaggaaagtagaactttacctgttgtcacctcagaattaggcattgcgaaaagtatgattttatgatctcaaagtatgtttactatgcattatttctagataattttcctgtcctgtaagctctgggtcttgacttaatgaaatgttttctgcttagactagctgaagtgaaacctttaaattcttatccactttcccttcctgatttggctgtttatacctgtaagagtatccatttttgctgggtttcatgtttaacattgaagggtttggactttcatgctctgtaaggctgaattaaagccatcctttttggtactgctacattagcattttttctcaaactcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgaggtatgtggtgctatatatttgtgattactagaaagcatgaaatggttagatctgagggtgggtgctgttggatctaatccttggcctcatgtttcattttctaaagaggtaaagtaataaagagggacactcaaagaatattattttacttagtggtctttgcatttgtaattctttgcctcaagatattttggaaaagattttgttgtcgtatgttgccacaaaaagaggtaagatttaaaaaaaatgatacttaaccaaaacaattgtgtaagtcttgctacttaaatgacctttattcttagtaatgatctcttgagtttttttactacctgcttttcttttctttgatacagagagactgattctgggaatttttacctactacctgtcttaatctttccctgtatttttattcacatttatgaattgagcatgttttccttcagagaagacaggatagagtaggtataaactagaagaactgtctccagttttttacagtcatagattagatgctgtagagcagtagtgtccctcagaactttctgcagtgacagtgttctgtgtcagtgctatctaatattagccacaaggcatcaatgactgttgagcacttgaaatgttgctagttgtaactgaggaactgaatttttaattctatttacttttgattcatttaaagtgtgcatatttaactagcagctgctctattggacagagcagctgtaaagtcataaaaattttgcaatcttaaaataggagaaacaaattcttttcaacatacaagatagtaattaggtatcttttgaaaatgggagggacaaataggtgaaaacagaggtagaggaatgaaattttttaatatcaagaggttgaatataacgttagcccttagtatctaatagccatcatgacataagcagtggaaaaggaaggaagtacgacgggtaacaggaaggagaacaaacattgaactcttagagcaattaatttgttaagaggagaaaataggtgtactggttaaaaagaaaaaatcactattattcttattggttgcccaaatgccagtcatgggactgatacccctgtggtaccatcatgtatccatttattttcaaaatcttaaattttcagatctcccttaatcttcgagtggttctacacagtaatgcatgaaggatggcctttcataaccatcctttgcttggaatgagaaaggactgggagaatcaacctgaagatgaaattttaaaaaatgaaaagcttcagttttattttttacaaatatgacatttattgtttaaaggagcagctactactggcactaaaggagatcttttatctttattacgggacggttctctgtggctttgctccttttatgtccttaaggcttaattataatcattgttgaaatttcttccacctattctcaaagtttaagagtattacaaagggatttttcaaatagatttgataacgtgaagaaaaggcatcattttgtttaattttaccagtttaagtgaatctgagttactggttgttcaactgaaaatgctttattttttttttagttgccctgtggaatcctaattttgccaagtttgttttctaaccatttgaaaatgtcatgtaaggtcatatttggtgataacattgaattgatagtttatagaaaagaaatttttccccctattttcttttcagttccagttaaagttgaaatctcattgaggaaatgattacttatctatgttatcagataacttattttagcatttaactttgtggttttattaaaggaatattttctttttctgttttatgtctcttctgttgcctttttcatttatttctttggaaatagctcttagctctcctcttcaggaattgcctcgctaataatacatgtttctttcttatacttggggtacaaaaattagtatctcagactgctttggatagattcaacatacgatgttgggttttaattgataatggatgagttcaaggttttggcccatagagaagcttcccaccattatgtaggccttctttgtacttacttgtaccatctttagactaggtttatctgtttgaagtgttattttttcccccattcaggatatggtaaccaaaatatgagatataataagctggaaattttacagagtggaggtagattcattggagttttttgaaaattttaaactatttaaaacaatttttttaaactgtatttaggataagatagtttgaaaggtttcattcattttagaaactcacccattctgtttattttcaacaagttgagccactgaggatgttttttagatatgtctttttcccctaccccacatatgtaagtatataatacacgtaaatagaagataacaaacttttatgtaaaatattagaggtctttgaaacacagtatttataattacttagattttggacttttcttccctactttgtagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgagtaagttggtttccattggctgaagaaagcagccttgtgtaacttagaaataatgaagttgcaaagagtggtctgttgtggatgttctgcacaggttatcagattagtttgggaaatgttgggttaaacatgcttaaatgtgtttatttgctgcagttattgaaagaaactttaatgtgctgatggatattgctaacctctgagacagtgatataatatgaagcacttctcaaacttgttagttgcacagtaccatttattaacagctttccttggaaactctgatatagagatacctttatatttgtcttctagggagtatattaagtaaaccaaaacatttacttttttggatgcaagatagaaaatgttaacgtttctttgctaatgacattcttttccataaaagtagcttgggtaggtagaggactaatatcacacttaatagtattgctttctggtttctaggaagattgctacatgtgtatatgaagtcctgtagttctccttttaaactgactagttcctactctgcttatgaaatttatagaacatattttagatttatggcaattaaagcaatctaagagcacctaaattttaaactattttaactactcaattcagggagaaatataataagaaaattccccccatattatttgttatatagtctatttaaaatagcatagcaacttatattttatagtaagaattttggctggatgaaaattaatttaaatactagaaacattcatgtaggaaaactgcaaaatggtctcggattgttttaaactagtctaaatctttccagaaagattttaggtgttgtgcctaaaacaggatgtgttattttaaatttcttttcaacttaattctagcaattcaaacaaactagaagccaatgttaatgactttgttttgttagttttatgtatttaaaaaatattttataatttattgttgatggttctttgggtgggaaaaattacttttctgtttttgtctttgctcatgtagatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcaggtaggtttctattgcagaaaacaaacatggagtcctgtatttctgcctgacacatggaaagtgctcaataagtgtcacttattattaaaaattattttgtattatcccatatatttctttaaaaaatgcttatgaggaacaggttcacagaaattaattacccaagatcgtctcaatggcatatctgcccctatgtgcttttcactccagtgtctgaaatcatgggtaaagcagaaccagggtaggtaaacctacctgctctaaaacctgattactcgcaactatctgttctgtagcattcctgcctatagattagttatgattacaagagaagaagaaggaaaagaagaaggaaaagaagaaggaaaagaagaagggagtccctcttctattgggaaatcatattgatggtagtttctttgcatttgactcaaagctaacagaggatttagggttcattttccttggtttaaaatactgcctaaaaaaaaaaaatctgaatgctataagggataccaacatgggaatccggaaagaaatgagaagatagagatggaatatgtttgaaatataaaaatatttaacatcaaatccttgaaagatttgggtaaattatttaggtctgattggaggaagcataattgttttcagtcttaactgtttgatgaatgaattaaactctattacatgctttctagttgaatttgtcgtgagaagaggatggttttgttgagctcaaaaaccatgatagtttggatccatccttggctttttattgacttagatacttaaactatttcaaaatattttactttaataaagatttatatttttattaaagcttccccttttaaacttttaatagggatagtctgaggcagatattttttttttcccccagagcagcctttttgcagggaaagagaagagggaaggaggcaaatgtgagaagagaagaaactagaatactaggaaaatatgttctctcacttgttttgaaataatattcagaggccagacttcctttttctattggcagaaacagctagaaattgggaagtaagacaaaggctaatgaaataatttttctaaagcctctacctctaattggtttgctaagacgacagaatcttcatatttttctcagtctatacttgctaaaaacctggaaaacctcaacatttttaaccattttggtaatctgttatgtactaatacattaatattctcctctgggaagtagaaatttagaaggcattaggagccactattacaatgctgacataagtaaaaagcgataatatgagaaggagcagacaattttgtttttaaaagtatgagcagccgggtgcagtgggtcaggtctgtaatcccagcacgttgggaggccaaggtgggtgggtcacctgaggtctggagttcaagaccagcctggccaacatggtgaaaccccatctctagaaaaatacaaaaattagccagaaatgatggcgggtgcctctaattccagctattccagaggctgaggtgagagaattgctcaaacccaggaggcggaggttgcagtgatctgagattgcaccattgcactgcagcctgggtgacagagcgagactccgcctcaaataaaataaaagtatgatacaacagatcttgtctaagtagcataatatttgtacaggacacttggatattctatacataagctcagcctaaccctcagcctacttctcctctgttccctatatcaaatccaaatggcttccaaatgcacttagaataaagtgcatttgaaacttcttaatatagcccataaagcccttcatctcctcaccttcttctcttattcctacctttgtacatgtacagtcatgtgttacttaactttggggatgcattctgagaaaatgcattgttaagtaatttttgtccctctgtgaacattgtagagtgtacttacacaaacctagatgctatagcctactacatacctaggctgtgtgttgctccctggctgcaaacctgtacatgttactgtaccaaatactgaaagcagctgtaactcaatggtaagtaatagaaaagatatgctaaaaatgcagtataagatattttttaaaaagcactcctgtatagggtacttaccatgaatggaacttgcaggactggaagttgctgtgggtgaggtagtggtgagtgaatgtgaaggcctaggacgttagtctatgcttataaatgttgaacatttaggctacactaaatttataaaatttatctgcaataataaattaaccctagcttagcttactgtaacttttttacttcataaactttaaatttttttttttttttttttgagatggagtctccctctgtcacctgggctggagtgcagtggcacaatctcggctcactgccacctccgcctcccgggttcaagcagttctcctgcctcagcctcgatttacaggcgcctgccaccatgcctggctaattttttgtattcttagtagagacggggtttcactgttttggccaggctggtctcaaactcctgacctcatgttccgcctgccttggcctcccaaagtgctgagattacaggcgtgagccaccacgcctggccaaactttaaaatttttaactttttgactctgttgtactaacacttagtttaaaatattaacatgttgtacaactgtacaataatattttctttatatccatattttaaaaggttttatattttagaattttattttttttcaaactttttcattaaaaactaagacacacacacattagcctaggcctatgcagggtcaggatcatcaatatcactgtcttccacttctgtattctgtcctgctggagtgtcttcatttcaggggcaataacatgcatggagctgtcatctatgataacaatgccttctggaatactcctgaaagacctaccagaggctgttttagataacttaaaaaaaaaagtagaaggagtacactctaatgatgaaaagtattgtgtagtaaaaatataaactagtagcatagttgtcattaccagttacgtactgtataaaattgctatactttatacagctggcaattcagtaggtttgtttgcaccagcatcaccacaaatatttgagtaatgcattgtgctgtgactttaagatggttactatgtcactaggcgataagaatctttcagctgtgttctaatcttatgggaccattgttgtatatgcagtctgtcactgaccgaaacatttgttatgtggtgcatgactttatatacattttttccagttagagtgtaagcttcgtgagggcaaagattgtctatcttattatgtctgtagcatgtagcatgttttgtactgaatggatgtggaggcaatatccgtcttctgcaactcacagtacagcagaggtgagccatatatctgtttagtacaaagtggactgtagttattatgctacagtgtagaggaaagtaatttaaaaaaatgtttcatgagtgtttaatgaaataaatattttcatcaaggtggttaaaatggaaagtttgaccctcaaaggggtaagtcataaaaatcactcacttagaatctcatgctgaataaatgagacctcagtggtattcatttgtttttccttttaaaaagtagacccaagaaacaactcatggcaggtagtcttctaaatttaaaaatttaagttctatatggtcgtatgaatctgttttaagttaggttgaaccatacaagattgctattttcattctcaaatgttagccctttcatatattttagccttacaatatagataaaattgctgatttttttggatgggaggaattactgttcatgttgttcttctcttttccagtatgcattgcctcttcagctagtgaataaccaaaccatgacaacatggatggagatcttccgaactattatcgacaggaccgttcctcctgtaagaaaaagcttttcccaagaaaaataggggaaacgggtttggaatgtttgcggtagactgatgcattatccctgactgctctttgaaaaaatttactactttaataaaataaattaataaaataattcataataccatttttagaaagcttagataagcaatttaaatcctaccaaaaatgaaaactgtttttaaaactttatttctttagtctttttttcctctgcatctatatacaacatatttaatttataaaagtagtatacgttggctgggcatggtgtctcacacatgtaatcctagcactttgggaggccaagctgggaggatcacttgaggccaggagttcaagaccaatctatgcaacatagtgggaccttgactctacaaaatgtaaagaaaaaagaaaaatagctagatgtggtagcatgtgccagctacttgggaagctgaggtggggggatcactggtagtttgaggctgcagcaaactatgcttgggggacagagcaagaccctatctcaaaaaagaaaaaaaacgtattgataatattttgaaattcagttttcacttaaaacttacaaatatttttatgattatgaatgcttttatactgtctttttttcttttcttttccttttttttttttttgagacagagtctccttctgtcacccaggctggagtgcagtggcatgatcttggctcactgcaagctccgcctcccgggttcacaccatcctcctgcctcagcctcctgagtagctgggactacaggtgctcgccaccacgcccggctaattttttttttgttttttttgtttttttttttagtagagacagggtttcacggtgttggccaggatggtctcgatctcctgacctcgtgatccacccacctcggcctcccaaagtgctgggattacaggcgtgagccaccgcgcctggcctatactgtcatttttgttgaatgttttacttgctggatgtttaggctttaattttttagtgttttaactcttaagaatgtacttaaatttttgtgcacatatatgattattttctttggataaactagaaacatggaaggcttttcactaatcttgcagagtgctctgcaataaagtgtgccctcggttacactttaataagcagtgactgagaatgcctgttatgggtacacacttaattctaagtttgtccatttgatagggaaaagatgtgtttcattttgatctgcaataatactatctttaatttatcacattagttcttgtatctattaaaattttagtttgtcttaaaatgtgcagtattatttctcttgtccatattgtgagacaaagtattttgacatttagcttacatacataaatgcacagaacttaatgactagttcagtgaattttgacatacacttgtgttatcacccagataaaaatgtagaaccctttcatcatctcagagtgtcctgaaggaaccatggtgttttgtattttgtcctctacttatttaggccttttgaagacaggaggtaaatgtgaacagcagcattgtttagttgaaatttactttgcttatttaattcctgcctagcaatctataaagaattttcatttgtatagcaatctaacttcacatttaatatgacttaacctatatcaagatttatcttgcctttgttattcacataaatccttttattatgcagaactttaatctgggtaattttgtcctgttaggagactctgcacattgatgaggatgatagaccagaactggtatggtggaagtgtaagaagtgggcactgcatattgtagctcggctctttgaacggtaattatctgtttattacattgatgatcatacagccagtatctcagtatcagatatgattatctgtctttagagccaccgagagccaagagtcactctgtttaaagtagcttaattttaatcattggctttgagatcataatgaagtgggtggtcttctctggatcttttctattcttctgtgaaaaacttggaaaaataacattgttcagcccattggtaatatctaagaattatgcaagaagttgcatggtcactcaactccgtaataatgtcaaatttaattttaaaagcatttattgaaaaaaatctatgtcagttgtaacattttaatttccaatattcaccctttaggagctcttggtttagcaagtgaaagcttctgtctgaaactttacagtatggcccatagtctaagtacaggttatcttgatttcattttgtggcttgtgggaaaaaaaggcagtgttagttttctgtcccagtagaatccatctttgaataagggactatatttaaattattagcaagcatgctgtttgtaaaattcacggtatttgtacattttctctttgtattttaagatatggaagcccaggaaatgtcacaaaagaatactttgaattttctgaattctttttgaaaacctatgcagtgggcattcagcaggtaataaacttatgcttttaaaatagaataatggttactactgaaagtaaaggcatttctgtctactggaagtaggttacaaacatactaattcattacatatttatagaggatggaaggacagttctgggaatgtattacagtgcaattagttttaaaaccaagtttccagtgcaattagttttagaaccaaatgtcccgagacagccaccaccagaactgaatcctagactctggactcaaaccttttaagttgatagtggtgtagcagtcaccagtattagattgggttcttctattaattctctgacctcttatgagttttttgatctttatttcttcacctctttgttgtaagtttttattttagaagacttatataatatgaattggtctgtatgaagagtagttgagcttactagacgtcaagactcttagctgagaacttaaacatttctatggaagtttggggaccattctatatagtgaaaattagttcctgaaacaatccaagttgacataatgtttaaaaattttaaaagctacaaaggacaagtggtccatgaaaattggttgatcagtgttgccgtttaaatcatatttttatgtttcaataaaatttattaattattgaccactggctgtgtcaggaccatattgaggaagcaaagactaattagacatagggaaaagctttactgacatagaaggtgtttctagattttttttttgagatggagtctcactctgttgcccaggctggagtgcagtggcacaatctcggctcactgcaacctctgcctcctgggttcaagcaattctcctgcctcagcctcccaagtagctgagattaaaggcacacatcaccacacctggctaattttttatatttttgggtagaggtggggtttcaccatgttggccaggctgatcttgaactcgtgatctcaagtgatccacccaacttggattcccaaagtgctgggattacaggtgtgaatcaccgtgcccggctctagattttttttttttaaatagctctttattgtcagcattataatgttaagtacttagaacctgttgtcttgagatggaatacttccgtttatgtgttatcattttgcctagtagaatgctttctaaaaagtacaatgcaacagttcaggaaagttgtagttatatagttgaatttctcacaagttattttgttggctggtgagacaatctatagggaaaattagtgaataaaaccaggacaatcaggaagctggtcatctgtcttctgccccttccagtgctgtccactaatgttaaactccttaaagtatcttaaagttaattcccacttgaagtgtggtgagtcaatttttttttcagtgtcataaacatgtatgtgtgtgtatacatgtatacacatataaaaatgccattatatccgtgttataaactcttggtaccatggttatttaaggatatattcctgatacttaaaaatggttttcttatcagggactcttctctcccccactgttgtgtagggagagaatctcccatttcccatctcccatcacccctactttgtatgagccacatctgtattagaaagaatcatgttcagtatcatccatttctagcttgcatcacagaaggggtttctacatgatgacaggacttccgacaaatttggtaaacctgagttttaggaaacttgaataaaatccatattctgaatttataatttctgtacctattttgaaagaatgctttttatttattcagcaactcacttataagcttgatatggtgaagagctctggagaccaggaattggaaggcaacttgctgtagtgaagaaagttgcctaaaggtccttgagccagttcagaggtgctttggcatggctttttccttataaataattttttaaatcagtttttaaaaaatcagtttttaaaaaataacttctcagttgtgttgtgtttacaaataccttcttttataatctgagattataaaagaaaattctcccatgttttctttaaggaatcctgtgctatcattttttgtcagtgttaaaatagttccccatctgaagtttattttggtgtgaagttgagggagttaatttaaattttttcagggggctaatcagttatgccaatactattttttgaacaacttttctaatttgaaggagtctttatgaaataaagaaacatctttgtgctgtctcttgttgtatggaagtttttaatgtttctttagtcagatctgttattgtaatttttttttttttttttttttttcttgaggcagagtctcgctctatcacccagggctggagtgcagtggcgcgatctcggctcactgcaagctccgcctccggggttcacgccattctcctgcctcagcctccccagtagctgggactacaggcacccgccaccacgcccggctaatttttttgtgttttcagtagagacggggtttcaccgtgttagccaggatgctctcgttctcctgacctcgtgatccgcccgcctcggcctcccaaagtgctgggattacaggcttgagccaccgtgcccggctcctgttattgtaattttttaaacaggagttttaacttactttgaagagctagcagtggaatagaaatttagactttgcctggaagttacaatgagacaccgtttagttcaatataacatggacctgtctaataattaaagctgtttatctgagctttcttacaaaacattgatttttctcccaaatctgtttatttttctatggattctgaattttaggtcatgccaaaaatggcacctcccccttttaaccttataattgtttatgttagtctgtattttctgttttcttataggtgctactaaaaattttagatcaatatagacagaaagaatatgtagctccccgtgttctccagcaagcattcaactatctcaaccaaggggtggttcattctataacctggaagcagatgaagccacacatacaggttagtgtcagagagcagctctccaaaattattctctggttaaattaggttttctagacaaagttagtattactaatcctatattttacattttatatatatacattttaccattaataatttctaatgagtgaagtcctatgtcagatataaagggcttagaaatttaagcatttgagaaaagtgaagccttcaagttttatgagtcgggagacctggattcacttgatcttgcttaatctcattaagcctcattttctcctctattaaggcacatagtgtttttctattcttatctaaaagttgctaggattaaatgaggtattttgtgagaaagtattttgaaaacttaccagggctctactaaggtagtgttattttgcaggaattgaagactgatatgtgaccgttttattttgtaggtatgagcaaggtttttatttattttcttggattgttaagttcaatagcatcattgtttctatatcgtttgcctaaaggtagaattcagtattgttatttagctaaagaacaaatgggaatggaaaattataggccactaataaataaatacttccttgtatacaaataattggataatttgacagtcttaggaactgaatacctactctctcccaaactgtgaattcttaaattttataaatgatatctgaaaagaaaaatctttcactttgctgtttgctgtccaggatagaattttagtgttattacccgtcttaccaacagatatcttttctttgatttatgtagatatcttaataactatttgcctaatcactttgatcaaatagtgataatttctttgcaattaattaataaagatactgatttcatttgctgtgttcctgtaaagtaagggtgagttgtgataacatttcttctctacttcatacctttggctttatttttacatagctgtaaagtaggaataagaaaacgctgatccttaggctgaattttttcacttagaattatttaatttggaattaagtggtaagagatgatcctgtttttatataaattgttgttagagcctaaaagggcttaataggacattagtagcagtgcacagagaggctagtagataggacttttctctaactgaaacatttgtggagtaggaaattagtttttttgggaatagaagtaaagaaaattccaattttttttttttttggagctggagtctcactctgttgcacaggctggactgcagtggcatgatcatggctcactgcagccctgagctcctaggctcaagagaccctccaagatggacgccaccatgcttggctacgtttttatgtatttttttggagatggggtctcgctacagtccccaggctggtcttgaactcctgtcctcaagcgatccttctgcccttgggcttccaaagaggtaggattacagacatgagtcaccatgcctggccctttaatattgttaatacatggacatttacgactaaaatggaaatgttaaaaaaaatttcaaaataagaactataatagtaaatataacctcgacttgacattttacacacacacagagtttggaaaactaacatcataaaggctgtcaacaagtacattattagtattcctcaaacttgaatagcctatacccatttgttacgtttttttttttttctcattttagaatatctctgaagatgtgattttttctgtgatgtgttataaagatgaggatgaagagctgtggcaagaagatccatatgagtatataaggatgaaatttggtaattgagatggttttatttctcatcagttcctggatatgtaaagtaatataactaaatttatatttttaagcaaatgttattactttattaaatctcccaggttctgttttgcatgacataatctgaaactttgagagtttgatgttattttgttgaactagagaactggagattgtcggatgtgggagatgaaaagccacctcattcatctctcttacgggtgctcaagttgagccatctgttacttatgctgttgcgatgctgatctgcagggaccatccgtttttgtgccttttgggagactcatttatagattgggttgttctcatgtgggaaatagtttggatttctgcatattttaggggtaccccaatttggtttgcttgcttgtctgagagactaagtgttccacaagggaaataaatttcgtatgggggccctactgtgtgtggtccaattctttgggtgtccttttaacttggatcttcctggaaactgttgaattgtgtaggtggcctgatttattcccttttattcccagtttgtattaattgcttcatggaacactcaagcacttaacatagcaaaatattaatttgcatacctatctcccacaacttagaagctttctgaggacaggaattttaccttatttgcttaattttgcattttctctctcttctacacctctgcattcctccactagtgcttggcctccagtatgccttcaatacatgttgaaagaaatgattgctaaatctagcgctgcgtgctgaaagtgctgtaatgaagcagtgctttccccttagttgagccaggtgtgtctagctacgtaagctaaacctactggtacagatgctagttttttgggctgtgtttttacagagctttgtgtttatattatttgattcagtaagtgaggatcctgttttctcttggagacaaagtatcagaaaagcaaatcaatgagaaacatttatcatctgcttgatttgttatttttcttttgaaaatcattattcatatgtgtaacttattatttcccctttcttatgcctttgtttttctagtttgctttgagtgattagccaaccattcttctctctctctctctctctcttttttttgttccagtgactctcccacctcagcctccaagtagttggggccacaggcatgtgccaccacacctggctaattattttttgcagagacagggtctccctgtatttcccaggctggtttcgaactcctggcttaagtgatcctcttgccttgcaaggcattcttttagtgtttacttctttcataatacctatgtgtttttgtgatgtacagagtatttgtttagctttcagaaagttaccattatttatatattcttcatatctgataagataggtatacataccctagtttttagaaaataagaactctatgtctgttgattaacagtgggaatttacattttattgtttaaaagcggatatgggtaactcaagactgactagctgaattgagttttctttaatcgtttccttctgtagactggaatgcagtggcttttatttgatatgtgtattttacttttgggtaaccatagggaagaacaattactgcattttctttttatatgtttggcacttgcaattatttacgtgaaacaaagcattcctatctaaatgtattgactgattaataataatgttttagttttttctttttatctactctttaaccaacatctcctcacttcccccaataatgttttttgatttggtaagaactaacaagagctcaggctttgatgttaagatagcgtgggtgtgaatgctggtttggtcacttacctgctgtgtgactgtggacaggttacttaacctctctaaaattcagtgctttcagctgtcaaacgggtgatgataatagtgctgggaggattaaatgggataatacacatgaactaactgcttagcatagaatacaagatgcttctaaaactgtagcatactgcttggcacagagtaagtacagtactccaaaaatgttcttattatgtttgtattttatattttgaggtagacttagatttggttttatcttttgtatttaaacaaggacttatcagatacctctcaagacttcagtttcttatgtaaaactgcctattctgaaacttgtgaaaatgttcatggtattaagtgatatgttaagttttagataggtatatattcaacgaaacctgctgaacttacgtatcgacagagccaggcatggtcctagcagtccttcaaggcttttatacttgctgtttcacctgcttggagtactttatccatggattgctttctccctcatttcattcaatttctgcttaaatgttaccttaacagagttggagaggcttttgctaacaccctatttaaactagcaccccatactctgtcactctgtctctttaccctattttacatttgttcttagcctgacttattatgtgtgtatatatgtataatctgtttctttgtttcacgacataagctccgtgagaacctttttgtttgatctttgtatccccagggtctagaatggtacctggcacatagtaagagctgagtgaatttttgttgttttttgatagaaataaagcactttttctgttctcagtgaaacagatgtgtaaatgcattgttttcttcaatataatagtttgaaaggacagcctgtagagtttgaggaacattgttttgtgcaggagacagcaatgttgtggtgccactgtatatccttacctttttagtactgtcaagcagtgtcatatgtggatggttttatttttttggtttggaatagcggtcagtcaggtttaaaatctagaataagtaattatattttcactaacatggttttaaccttttaaaatcttagatatttttgaagattatgcttctcccaccacagcagcccagactctcttatatactgctgcaaagaaaagaaaagaggtatttcatttttctttttaaatccaaaactgaaaggtggcctgtgttgagttgatactctagtatatccctagtatttgagaaattatgttgttattcgttataatttgtcaccttaaggattttttttttcctctcctggtgaggggaaagggggtatcatggttatttcgttttcttaataaattatacttttcttattgagcttatagttgcttgataaaacataataaaatggctttatttttaaaaatttgtgcatcatagttaatactatagtaagacaatgaaagttcatgtagactaaatggattcttctgtttctttaggtgttgccaaaaatgatggcattctgttatcaaatcctgacagacccgaactttgaccctaggaagaaagatggagccctgcatgtgattggttccctagctgagattttactgaaggttaagataatcaaaatttaatttacttaataacattgtaaagtacaggcaaatgagagaatatgaaagttatggctaatttaaagctggtgactacctctggataattgagttcacaactatcctcctttctgtcatctatttctttaattaaaaagaaaatttgactgtttaaagttttcagtatgaaactattgatatgtgaaagggatacaaagtatcttatgtctacaaaatcaatcaatatcaaactgatataaggtaatatttgtcttgttttaaaacatgcaatatataggtcaaataattttacaaaattagaagtatattaaatgcaagtcatagtaaacacacttgattaggaagtgattcttacgtatgaaaaagaaattgataagttgaaatttgtttcctaatagaagagtttattcaaggaccaaatggagctgtttctacaaaatcatgtatttccattattattgtctaacctgggatatcttcgagctagagtaagtttttcatatttctgttatgtatcttaaatcttcataagataattattcaaataaatgttttttggacaaattgaccttttgccacatattgagatgaaatagagtcaattagaatgtctgcctatggtcacatcagctgaataaaggacagactattaaagaaaaagatttataggctgggcgcagtggctcatgcctgtaatcccagcactttgggaggctgaggtgggcggatcacttgagatcgggagtttgagaccagcctggccaacatggtgaaaccctgtctctacaaaaatacagaaaattagctgggcttcatggcaggcgcctgttatcccagctactagggaggctgagccaggagaattgcttgaacccgggaggcggaggttgcggtgagctgagatcgtgccactgcactccagcctggacaacagtgagaccctgtcttaaaaaaaaaaggaaaatatttatggattttatttcctgctggttttatttcatttgtcaccctagcctcacttgctgcatatgtaaaacatgaaatgagaaaggtgattttatagcagtgatacaatttaaattcacaaatggatttattttgtgtataaaatgacatgaaattccagattggctaagaacttgaatttgattttcagtatattaggtagatttgccttagtaaaatggagagattaataatccatgtgaaattgtgctctatgtgtatattcttttagaatcaatatattttatggagaaatagaaacaggacttttattcaagagcctagcatttctctttataaatatatcaacacaaaaatgtcttgctaaaaacaacatatattaacaatgccttgtacactagaaagcattttataaaataatagttactagcgcaatatctgggcaaatgtggactagggacgctgagggcacatgagcatttttacagtggggctcctacctttgagaagttatatgaattgtgattctcttgctaaaagtctttagtaactagaattaatttctgttgattgtgtttgatgcacacagagagtaaaatataataatgattctgtggtctaatagttaaaatgtgatcatctataccaggtttaaaatttttggtacctatgagagtgaaaaaaaggaagcttactaaaccagttagtgtaagggaaaataatgttttacctaagtgtgacaaatgaatttcagatactggtttggagttgcttttacatataacaaattaattatgagttataatatttattaaaagcgtaaatagatttttgtcaaagacatatttggcttctttttctctttcctatgaaaaatgttattgcatatgggtaatttagaagtaatgaaaatgccttacttgtaaaaagggggatgtagaagttagaaactaaggctactgtgttaccccaaaagcaaacatttcttcatagaattgatattttactaagaagttcttatatctgtgatattattacagaatgctataatcctaatagctccctacttaccttttttaataatacagtcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaaggtaaagccaaaataccttttagacatcttctcaaataatttcatttactttcttccctaatgaagatgcatctccatgtctgagggttcagggtttggaattctgaggttttgccctctcagaattttgtaggaatttattcttgtcctttttaggtgttcctattgactgtagttttcagaattttaggttaggaaacatgttaatcattgtggggccctaggataggctgggcataaagagacctgggcccagttttgattttgctcctaacttgccatggaaacctgggcaaggtgtgtgatctgtcaaggctcaggtttccacatatttaagtttaggggagttggactgaatgacttcatgattcctttcacctctgggattctgattcccctagttttgaaagtagcaagtagtatttctagtgagtgataacagacgtctcatttgttcagagtgttctgatcaaagttcaaataaacctttgaaagtaagttcagctttatgaagaacatgaacgtagtttgcctctattcagcaatgtttcagtgggaggattggatattgtacacatggcaagggagggtggtagagatggcctggggcagggaaggggccccatcagtattcgggatagtcttcacatacatgattttttataacttgtcatgagaactgattcatgttttccaagtcattctgatgaccaagtgtatgtataattagaatttctcagtgggggctattagtattttgggatagtttctgcacaggacagttctctcctgtgcaggacttcttatccttatattactcttgggaaactgatatattggtgaacattatttaggtacagctttgtaacttaccacagagcaagtgtgtatctagaacctgatttaggtattaccctgggtcacttgaccttgtgaccaagttaattccttttatcatctgggcatggtaatttttattacttttgtttgttttattgaattagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggtaagaccgggcagttttatgttaatttggtttagaaaccttgagtaatctaaataaactccaaaatatggagttcagttttatttgtacagtcatgtgctgcataacaacatttcagtcaatgacagattgcatatacgatggtgcactcctaagattataataccgtatttttactgtaccttttgtatgtttagatacaaataattccattgtgtcatgattgcctaagtattcactacattagcaaactgtataggtttgtggccttggagcaataggctatgccatctagatttgcctaagtacattcaatgatgttcaagcaaggatgaaattgcctaacgacacatttctcaaaatatatccatgttaagcgatgcatgactgtaactggaatattgataaaaaaattattctgatattactatagttcattagactttaatcacatttaggataatttctttcatctagaatattctgaaattttataatatgtgctttctaaagttttaatttctgggctttgaatcaggaagctcatttccttcagtttggggcaatttattgttttacttttttgataaatttctccttactatttttttttctgtttgtatttcctgatatggagaatcacatctggactgtgtctcttaatttttttaaaaacttttcctcctgttttccatgtctgtttttttttttttgtttgtttcattttctaagtgattcctcgacttctcaatcttctattgcatttttctttttactattacttgatttcacttgtcctagattgtgattttacttgcttagtgacaaccagaagttaaatattagctctctggatataatagttaatgtaaatagctatatttaaaacatgacaagttctgttattttaagaagagagatgattcagtcagcaaagtgcagacttcaaagtttgagcaatgcagacttcagatgtgtgacactgccattttgctaacttttgtaaagcggggacgtaacagtactactaattgcggaatactttaatgttattttcataggctgagatatttggcaaagttcttcaaagtgatgaatatgaagaagttgaagacaaaacagtaatggctatgggaattttacataccattgatactatcttaacagttgtagaagatcataaagaggtgagatttctttgtggtttatgatagtagcatttaactgaaatttatgtgatcagtggccatgaattttgaagtctccacttttaaattgctacttagttatgttgctaggctttaaaaattgccctcacattttatggaaacatattaaaatgactgagtaacattataaagtatattatattataaatatatattatatttatataatattataaagtatatagtatatccctttatattaacttgagttcagttaatcatatctgctatgtgccaggctaggttcttggggaataccaaattgaataagaaatgagcccagctttctgggaaccaacaatctagaattcttggtagagagtgacagacagcagttcaatcacagtggcaagtgttaggtaatggaacagaattctgatataacaagtactgtaaaaatggaaaggaataaatgaaagagctgaaaagcatatttactcaactgaattccaaagtgttattgggataagactttatacagctatttatctagtgctttcacatccatcagctgatgtgatcttactggtgccaccatgacatagctagcacaggtaatggtagtctgttttgcagaagcagaaaacaaagttcaggtggatttaagaaacttgctcatggtcccagagctagtaagttgtacatttgggtttgtagtcacatcattttgataatgtatcagtttatccccatttaaaacctacagctgcttcccaagtatcccatggcctctccttaactcaaattagatttttgttcattgcttctgtgagtgcaagttgacttgtttggcactgatggcaattattgttttacaaggtgagcacttaggaagcaggtgctagtactacttttatttgtttatttaattttttgagacagtctcactctgtcacccaggctggcgtgcagtggcatgatcttggttcactgcaacctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttccaaattaaattacaagtaaatttaagggatagttcttttgtcttatacttaggacttgtattttaaatttgaagagaccttagtaaatcaccttatccagttttcacaagtgtgtgtggggcgtagtagcaatgagctgcaggggtagtttaaaaacaaaacagcatcttttctgtttttattttttctcttgatattaaatttattttgaattccaaataatgttaaagggacaggtgaacttattgtgattatcaagagaggcatgggtgaaaattgagacacactaatatagcatccttacctaaagacaaaaaaaacctaaagccttcagctaaatggctttaccaaggccatgaataactacaggcaaaaccaaccggaatcttcgtctcttgaccaagattttgagctttaacttattaaaagcaaactttgaaaacaatatttccttaaaaggaaaaaccacatttatgaaacactgacaaatagtgtatgaaacacaaaattgtgaatctaaaataggtgcttaagcatatgcatttttgtttaatggttttaagcatattgacagttttttaaagtgggaaattttggatcatttgaaccttaagacagtagtttaagttgaatattagaatatacttgatggttgaaataggacatttacacgaaaaatgtaacccgtcataggttttaacttattttaaaatatttgataccaacatatgttgaaaaattcaaaagatgtgaaaagaaaattcagtgaaattttaccttctcactcaactccccagctatctaattctcctctctggaagcagctatttttttccttttttttaaaccaggtttttgggtccttctagagatttttctattaacatataagcaaaaagtgaatgtgtatatttttcttttacgaaaatgatagcatgctatacacagtttttatttgccatttttaacttaatatatcttgatgatccttccatgtcaatcaataaagttatatatttttaatggttgcttaatattcccttgtatgatgtgtcaaatttatttcaccagtcccggtttagtggatataatttaactgtctcttgtttaaatgggcatttgattgctagtaatcacaaacattgctgaaatgaatgaatggccttttatgtgtcattttgcacacataatatgtgtgaagggtaaatcccttgaagtggaattgctggtttgcatcgtgatttgtatgggtaagtttgaaggatgttgccaacttgtccttcattgtgtataccatttacactccagaaatcaatatacaacagggtctttcttcccagccccataattgtgatcatttccagtcttaataggtgaaaattgttaatgttgcacttggaatttgtactcttaccatgtattataacgaacatctttttataaacacaggcaaagattataaaaaaagaaacacatttgttttctattgtatttcaatttttaaaaattcactaattttatgtaaggggaatttgatctttgtgataccatttgaaaatatttcactcatttttttttacttccccatgccccatgcaaaattctttaattttttagtcagatgatttcattcttttcatttcttatttctgggctttgagtcactttcccttttcaggattatacaataattctttttattctatttttttatggtttatttcttcacactgaaatcttttatctattaggaatttattttggtataaaatatatggtaaggaactaatataaattgttatggattttacccccatttctgtcagtctatttttcaaaattttctgattattcttgcatgtttagtttttcacatgaagtttagaattgtcaagttaccgtctcaaaaatgtcctcttgatatttttattggcacaatattaaatttatgtattaattatgataattttaagcttaatatttaacatttatctttagattacccagcagttagagaatatctgtctacggatcattgatcttgttctgcagaaacatgtaattggtaagttcaaaggttaaataaaaagataaattgaaaaaattttaaaaatttgaactcaaagtataattttagcccttcagatttaacaagatggacaattttgagaaagagaagcataatcactttaatttttggatgtcctttctagtgttaaatatctgtattttcattcagagattaaaaattatacatccaacgaataatttttgattttagaattttaaaggacagtaattttaaattgtacattgctagaaatgaactgggatgaggtttaggtgaggttaccttaatctgggattgaaaaatgtttaataggcattttttaaaatcagaaatgtgaaatggctgggcaccgtggctcacacctgtaatctcagtagtttgggaggctgaggtgggtgaattgcttgagtccagaagttcaagaccagccagtgcaacatggtgaaacactgtctctacaaaaaataaaaaaaattagctgagtgtggtggcatgtgtctgtggtgccagctactctgtaggctgaagtgggaggatcacatgagcctggcaggtagaggctgccatgaattgtgattgtgccactgcactccccctgggcaacagagtgagatcctgtctcaaagtatgaattaattgtcctattatctattatggtacctgacttctgagtagaatcagtaactaatgctagatgttacaagctgatgggaattttgtagaggaggtgagtcttccatcgtattcaagcattttgaagatgctagccccacgtcatgtgggtgtgacacagatgcaagctgtgtagtactcagatagaaggatgcaggaaaagcctgtctctgattaagagcagttgtctccaggctttttattgttcactctgttagtaaaaagttgagcatgcactgctaatatatgtgaataatatttgaagagtacttgaatataacatggtagatataaacagtgggatactattcagccttaaaaaggaaatcctgtcatttgtgacaacatgggtgaacctggagtacattatgctaagtgaaataagccaggcacagaaagacagataccacaagatctcaaactcatagaaagaacagaatttagttagcaggaagtggagggaggggagatgttggtcaaaatggtgaccatagttagtaaccatgtattatatacttgaaaattgctaagagtagattttaagtggtgtcaccacaaaaaggtatgtgaagtaatggatgccagatttagtcattccacaaaatacatatatttcaaaacggtgtataaatcatagatacaatttttatttgtcaattaaaaaataaatatttttaaaaagtacatctttcagtaaaaagaccagtggttgccagggcttggggatgggagagagggaaggatgaagaggtagagcacagaagttttatgcagtgaaactactctgtatgatacaataatgatgaatacgtcactatacatttgtcaaaacccttagaatgaacaatgcagagtgaaccttaatgtaaactgtggcctttaattaataataaaagaatttctgaaagttctgttttggcctatttcacttaacatagtgtgtccatctctgttgttacaaataataggattttcttttttttttaaggtggactagtactccatcatgtatatataccacattttctttatctgttcatctgtcagtggacacttaggtattttcatatcttggttattgtgaaacatgcttcagtgaacataggagggcacattatctcttcaagatcctgattttaattcctttggatatatacccagtactaggatgacttgatcatatgatagttctatctttaattttttgaggaaccttcatactgctttccacagtggctgtttttactctctcaccaagagtatacaacagtttcctttttctctacatcccctccagcatttaactttcgtctttttgataatagacattctcgtagatatgatgtggttttgatttgcatttccctgatgattagtgatttaaaatatttttttgtatacttgttggccatttttatataatcttttgagaaatatccattcagttcctttgcccatttttaagttgggttattttctttctactgaatggtttgagttccttatatattttggatattaaatcttcatttgatatagattataaatattttctctcattttggaggttgtctgttctgtgaattgttttctttgctatgcaaaagccttttagtttgatgtaatcctattttgtctgtttttgcttttgttgtgtgtgctttggggtcatatcctcatataaaaaaaaaaaaaatcattccctggaccagtgttccaagtttccgtgaagcttttcccctgtgtttttttctagtagttttatcatgtcagatcttagagcttaagtatttaattaatttcaagtagatttttgtatgtggtgtaagatgagggtctaatttgattttctgcaaatggatatttagttttcccagtgccatttattgaagagactgtcctttctccattgtgtgtttttagcatctttgttgaaaattaattgaccctaaatgggtagatttacttttgggctttgtaatcggttccattggtctgtgtgtctgtttttatcccagtgccatgctagaacttttagaaattccatatttagataatttatttttcaaattattttcttacataaattatttatcaatatttgtaatttccattttattttgctagcttttgaatatattaagttttaagtaatgttagagaaaccttaatcaagtttccagggtgaccactagtttttataagaggaaaaacctttcaagttagacttctttgctcagtggtatggtaggaactatttgaaatttttgttgagatttgtgtttcctggctgtacgtgtagatataatttacttttgactgaggataatgatatttgtgagtataagaacatttcctttgaactcttctactttatagtgggtcttattgtcttgattaacttgaagaatactgtacgttttacaagttttgtaaattgacaaaatactgcccagtatatagttgttagtaaaagtataaatttgagataggtagatactttagtctgatataattaagctctccaaagaatattattaattatttgtacattttaaatcctcgacataaatgaggaatgataatctattccttcttgtatctatttctaatacagttttataaatatagattataaaatagaaaaaaactttattttttcaatagtataagaaagtttagtgaaaacaaatttttgccttgccttattgaacagaggggcagatcttggtaagaaatggaaggaggcagatacatagccgaagatacaaatactgagaaagggaggcttatgagtacattggatagaggaggactctgtgtgcgtaggtagtctaaaccctcctctgtgtggtctttgttttaacttttgctatttcctagcattctaactagagattttctttcttctagaattctatgaagaaattctttccctggcatacagtttaacctgccacagtatttcccctcaaatgtggcagcttctaggtatactatatgaagtgtttcagcaggattgctttgaatactttacaggtatggctttgaccatataaaatttttgcttttctgtgtctagatacttcttcctgttgacacctgaaataaaaacacatatgattccaatattgatcagaaaatgtttttatttcccggtcacataaaagctggggctattgtagcagtgtttttcagccctaggtatataggcagaggaggtaggctgtatttcttattgagtcttaagttagtttatgaccagagcatatatccatatattaatttaataagtattttatggacaccaactatattccaagccctattctaatctcagcaatccagcagtgagcaaaataaacaggctttgcccttttgaagcttacattctaatggggatgatgggagggtagggaatcacgcagacaaatgagcaagaaaatataaagtatgtcagatagggatgagtgtgcagtggagaaagggaaaaaattcagcacaattacttcataaatgatgagcatcttagtctttctgctccacattttccccatctataaatacacatcagacttattactttcatttctagccttttgtggttgcatgggaagatactaatgtgtgggtgctacagaaatatggtttcagtgggaataatttatttctatttctgtcactcaagtctcattgggattttgattttttttcagacatgatgcctctcctgcataattatgtgacaatagatacagataccttactatcaaatgcaaaacatttagaaattctttttacaatgtgtaggaaggtaagcatgacctaatctattgtttcagtggttcttaactaatgtttgcctgttttgcttcaggatactttttcagtttgtttcttacacatttagttctgcattatcttcatcaacatatattttttcatttgtattttcaaaaggatctttgggatttgaaagtttcatattgtgtgtcgtgcttatgaatgtttgccacttctatatctgtactttttactttttgttttttcttttggacatgaattttctacttgattgaagtgctaggaaaattaaccacacgttttgttaatcagtgacaaatggaatgatcttttttattttttaatttaatgtatatattggaagtcactagatgtaggtaatttgagcataaacaacataagataaaaattttaatagttggaaaagcatcatttaacaagataatctataatctacaatctacataatggctactgttatccttatacacaaacatgattgtctgccatattgtctttgccacaagataggtttggcccactattggttatcttttgggatctttggctaaataacggttttcttctcctttaggtaaataaataagtaaatatatacatacacacacacacacacataaatatgaaactgaaactatattgcataaagctggcaggcagattttataaagctcaaataaccagaaaccaaaacgtttggccgtagagctgggagtgaaatagctagtgtacaaccctcccaacacacttttgttttccttaccagaaggggtgtacccaaaatctggtaagagctctgcactgataatcagtagatctggtttaggtctaggtctcagttcagttctaaagagtcagggaaattttgggaagtcagtaagctgcttcaggtgtaaagtgaaggggctgaactgtgagttgtaatgattcatttacctctgtggataacccatgttgttaaatcataatcaccgggcagtcttcagttttccctgttagagaggtagctgatagagaaagagggaaagaaacaagtaaaacagttctgtgtattccattagtaattcacagcttcccctgtgtatttgcagatatagtaaaattgatgttcacaatgatttccttatgcttatcaagtagttaaaatatatttcatattcttttatgaatatgaaatactagttttaatactagctaatatttgtcgaattcttattgtataccagccattttctaagcactttctataatattaacctttatgacagtatgaggaaggtatcacatttgtatcaaaaggaaactaagacatagtttcttgcactatgctgaggttaggaaatagttgcaatcacatagctactatgtgttggagccagatttgaacctaatctgactccagagcctatttaaaaaattacaagatacatttttgttttctttccttttggcaaaccaaaacaaatggtccccaagtaaatgcaattttgagaaaagggagtaattatttttctttttgtatcatacgaccccatgaagtaggttcttttattcccattttatagatggggacagtaaaagaggttaagtaacgtttctaaaaacacagctaataagtggaagagctgcggtttgaacctaagcagcctggttccagagtccattcacatttagaagctagactgtggtatactgtcctagagatagcattttaaatttatgtaaatacagttgactcttggctttgcctgatatctgcttatcattcagctcactattttccagcttccaaaatgtgtattgctgttctctctacttttttctgtctttgtatatgtacatctttaaaatttctctgttgtcattttgatagcattttgggagagaatgaaattaaatgggaatgttaaatctgtcagaattatctggaatttcttaattaatttttcttaaattttatttttctagaaaatcatctaatctgagtttttaaatgtaaagaatatagtgttctttatagtattatttctaatctgtcttttgtctgtatttgtctctttcctaatatttttaatgttttgcttttttttcttcttaaaaataacttatataaaaagcttcttacttcgttaagtcttttttttcaatgaatttgcttttagttctctctgttacctctttttgtctatattttaaatttctggcccacccttatttctttaagtctattctttttcttatgtcttatatttgaatcattaatttattctttttaccttaaacaatttttaatataagcatgctctaggaacattattgggaatcttattataaggcagtcatattccacattgtatgtatgaacatgtgcattgtggaattgtttataatagtgaaaatacagaattaataataggggaactgtctgataactttgttatattcacctactgtcatattgtatagttataaatggttacaatgtccatgaaaaatattcctaattattaagttcatgttggagaattgaaaggtatgtaatatgaaattatggtggttatgaaaaaaatgggttcatatggaccaggattcaaaaggaacagaaaaatagtttcattgtttaataagaagattattttgttttggttttgatttcattttgtagttttgttgcctttaaagggaagcttcatttatgtggaaaattagctcatatagtctactttattaatccaaggtcaaataagtgaattattgctccttataagaaatgagatgatggatggaatttattttgaccattcttctttgggttggtgaggtaaacttgcacagcaagcaaagctgtggttcctatggctgaatttatatgggacatttgtgcatgtggacttgattaacctctatgcagtgccacttactgctgagctaaattgtaattactgcaggtactatgtggagatgcaggagaagatgcagagtgtcatgcagctaaacttctggaagtcatcattcttcagtgcaaaggaaggggaattgatcaggtaatatatgtctggaaagtgccttacttgagggttacatttgaagtttacatgcctgcttgacttttcatttatattatgatgaaaaatggaaaggacagcctatagattgtgctttctggtgcaaattctgtttaaatgacaaaaagagccaggtagtttggaaaccgtaccttgcattgtagctgaaaaaggtatgcacagaaaaatatgtaataatataaggggctatcaaaaaaataatgaaggaaacgtataaattctactcagttggagtctcagagatttcatgttccctttgttttgtgtatcctatttaaatactcctaggtaccttttctaaccagaaattaaggtactatagaaaaaaatatttcttgaccattttaaaaggctaaattttatactttatatttttcatgttataaatttttaatcttttttcaacaagattaatgcaatttttgatactattgtggtatgttcaataactaagaaaaatgttgaaatattccagtaaaattgaatttttcttttctgtaagttttgctttatgtatttcttataatagttttgagatctaattcacgttccatacatttcatccatttaaagtgtatacatacatggtttttagtgtattcaaagaattgtgcaactgttacacaattttagaacatgtcattacccctctcccaaaaaactcattaacagtcactcgccccaagctctgggcaaccactatgactttgtctctatagatttgcgtattctgggcatttgatgtaaatgtaatcatcttatatgtggtccttcgtgactggcttctttcacttgtcataggttttcaaggttcatctgtgtggtagtgtgtattggtactttatttcttttaatgccaaataatatttcattgtatagttaaatcacattttatccattcatcagttgttggtcatttgggttatttttactttttggctattatgaataatgctgttaggaacttttgtgtacaagtttttgtgtgaatatgttttcatttcctaggagtggaatatggtcattctgtgtttaatcatttgagggactgtcaaactgtttttaaagcagctgcaccattttccattcctacagcaatgatagagggttccaatttctttgtgtttttgccagcacttatttcatttgtgaagtagtgtctcattgtggtttttatttgcatttttatgatggctaatgatcttgagcatgtttcatgtactgattagccttttgtatatctttttttggagaaatgtctaatcggatcatttgctcatttgtaattatttgtctatttattgagttgttggagttcattatatattctacattgaagcctgttatcgggtatcatttgcaaaattttctcccaatttgtcttgatggtgtcctttaaagcacaaatgtttttaattttgatgatgtccattaatttttttttatgattattgcttgtggttggtgtcttttttttttttttttttttttggagacggtctcattctatcacctgggctggagtgcagtggcacaatcttggctcactgcagccttgacctccaaatcctcccacctcagcctcctgagtagctgggactgcaggcacgtgctactacacctggctaatttttgtagaaaagtcctgggactacaggtatgagccactgtacccggccgttgtcatatttaagaaacattgctagctccagtgtcatgaagatttatcctcttttgttctaagagttttatagtttttttctcatatttaggtcttgatctattttgagttaatttttgtacataatgtgaggagggggtctgcattttaattcttttgcatgtagttatgaagttgtttgagcaccatttgtggaaaagactattttttccccattgaattgtcttggcattcttgtcaaatcagttgactataatgtgagggttttttctggactcagtctatttgatttatgtacttatctgttgttattccagtactgcattgtctttattactttagctttgtagtaagttttgaggtcaggaggtttgagtcctgtaactgcattcttttgtgagattgttttggctagacagggtccgttaaattttcatacgagttttaggatccgtttgtcaatttcagtaaattagccagctgggattgtgacaggcattgtgctgaatctgtagattagtttgagaagtatttctgttttaaaaatagtctttcaatccctgaacgtggggtgactttcttttatttaggttttctttaatttctttcaacaatgtttggttgttatcagagtataagtttttcaattctattcctaaaatatttttatatattttctttttgacgctattgtaaatggagttgttttattttcaggtttgttgccagtgtatagaaatataattgtttttgcatgtttatcttgtatcctgcaaccttgctgaactgatttattagttttaatggtggtttagtggattttttagaattttctgtaaacaggatcatattatctacaaataagagttttacctttccagtttgggtgcctcttatttttcttgactaattgccctggctagaagctggagtgcaatgttgaatagctatgatgaaaagagacatctcatcttgttcctggtcttaggagggaacacattcagtctttcaccattaagtctgatgttacctgtgggcttttcatatatgcccttttgtcaggttcagttcttgactgttgctaacttgttgcttttatcatgaaagggtgttgaatgttgctgaatgcttttttctgcatctattgagatgatcatgtagtttttgtccttttagaatagagatgtattacattaattgattttcagattttaaatcaaacttgcattcctggtataaatcacacttatcaaatatgatctctgtatgtatttctagattaaatttcctggtagtttttaaaaagtatttttgtgtctatgtgcataatatatattgatctctaactttcttttcttgtgatgttttttgtctggctttggtatcagagtattgttggactcattgaatgagttgggaagcgttcatcctttctctttgttcaaagagttgtgaagaattgctcttcttttttaaatgtttggtagaatttagcagtgaaactatctgggcctatttttgtctgtgttttgttttgttttgttttcggtgggtagttttaaatggccaattcagtctctttatttgttatagatttattcgtagtttacatttctttttaaattcatttcagtagtttgcatcttggaatttttcaacgtaatttatctaattcattgcacgtggttcatagtatttccttatgtctttttgtatctgtaggttccatagtaatgaccctgttttgttcctgggtttagtaattagagtcttctctctttttttcttagttgactaaaagtttatcaattttgattttttcaaagagctaacttttggttttgttctctatttttgttttccatttcattagtttccactctaatccttattttttcccgtctgcttgctttttgtttagttgttctttttccaatgttttaaagtaacaggttagattattgatttgagatgtttgcttacacttcttaagtccacaatttatatttggttctctctctgtctctttttttttttttttgagatgaagtcttgctgtgttacccaggctggagtgcagtggcgcaatcttggcttactgcaacctccgcctcctgggttcaagtgattcttgagcttcaacctcccaagtagctggtattacaggcgtgcgccatcacacccagctaatttttgtttttttagtagagatggggtttcgccatgttggccaggctgatctcgaactcctgacctcaggtgatcaccagcctcagccccccaaagtgctgggattacaggcgtgagccaccgcacctggcctggttctcttttacaatgcctgtatctttactgtaattttatctttgagatattgtctcatagctttctttaacagtagtttattttattctttaagcattatgatggccgatttgccattttcaaagttcatctttgtggcggggcgcagtggcttacgcctgtaatcccagcactttgggaggctgaggcgggtggatcacctgaggttaggagtttgaaaccagcctggccaacatggtgaaaccctgtctctactaaaaatacaaaaatcacctgggcatgatgccatgcgcctgtaatcccagctacttgggaggctgagtcaggagaatcacttgaacccagaggcggaggttgcagtgagccaagattgcgccattgcactccagcctgggtgatgagcaaaattcctctgtctccaaaaaaaaaaaaaaacaaaaaaaaaaaacaccaaaaagcaaagtacatctttgaggtttgtttggacctgagggagcttgctttgcctgtctccttccttggccatctctggtgaactgctggcccatctttttgctctcaatggagctttacttaccaccaaaatcttcattatttttgagaatgacttctgcctacccccaagctttattggggtattagtgacaaaaaaattatgacctttctaaaaaatcataaagttttactgatatttatttaaaaaccttttttttttttaatggagattggatctctcttttgcctaggctggagtgcaatggtgcagtcgtatctcatggtaacctcaaattcctgggcccaggtgatcctcccatcttacctcctgagtagctgggactgactacaggcatatgccaccatgcccagctcattttcaaattttttgtaaagatgaggtctcactatgtggttttggccgctctctaactcctggcttcaagtgatcctcctgcctcagcttcccaaagttgtgggattacaggtgtgaactaccacctgtccccaacaggtatctttgaaggctcttttctccctttgttattatgtactttttaggtgacatagtggaggtgaaaataaattatgatgttaacaaaataagaaggtagtaaagcacaagacatgagtggggctaaagaagtatttagttctgttgactggattttggagggttctgagctgtaggctttaataatggaaacataggttggggagaggttcagaagactatagaataaatccatgccaaagactttagaatccattctgtacgccagaagctggcaagctatggcctgtgctgtaccacaacgtggtggaaggtcaaaggggaagtggatgtatgcgaaggggcaaaacccaggggtgtccttgctttataacaacctactctcatgggaactagttcattcccacaaaaagtaattcagttgtgccagaatgatagtgagaagtcgctcattacatcacaacaggagaatggccccaaggcattcataaggggtcgaccactaccatgactcaaacacttcccactaggccccacctcccaaaacctgccacactggggatcaaatttcaacatgagtttcaggaggacaaaccatatcgagaccatagtagtattcaagaatttgtgtatcagaaagttaaggacacaaggtgatctctactgttagtgaggttaccattacaatgcactcaagtacagctgaaggactgtattgattggcattccattcctctaaatttcctgtaaattagtgattacatttagtgttgtcttggattcaggtttgactcaccaggctagagtgcaaatggcatgatctcggctcatgcacttcatgggtgatggtgtgtaattttactaggaggcacagtatgtctggtggtctctcatgatgttagtgttgctgatggtgatcttctaattctgtcatttcttctttattaggtgaaatattcctgtaaagagaaatgttttctcataaattatcaggctactttgagaaacagcttgagtatttccctttatttaccattattcaagataagtttcttacctagcattctccaaagatgatcagcaaaatgttttattatgttgtttggttttaaaaatttttagtatccttatgaatgtatagatccaaatttactctatgtgtttcagtgtattttaagtatacatagtttcatttttgtcccatgggagcctcttgaatttgtcttatgagcccttttaacctgattctaatagtctttggtagtttccttgctgtcttggtacgactagatattccaggcttatcttatagatgtctcgtcctagcctgggaaatggtattcaagactacaagctgggcacaggggatattcattgctatacatatatatctaaaacatatatatgtatagtatatatgtgtgtatatatataatatgtactatttatatatcgtattaataaattgataattagctacatatatactaatgcatattaatgtatataactaatatgtcgctatatatatatattcattgatattggattggtcattgtttctacaaaatagagccaagaaatatgttgtttggctttttttagtcaataaaacattaatgtacacagataattctttttttaattttagatttgggggatacatgtgcaggtttgttacatggatatattgtgtgatgctgaggtttgggtttctattgaacctgttgtccagatagtgaacacggtacccaacagatcatttttcaacccttgccccattctctcctttacctcttttggagtccccgtacctattatttccatctttatgtctctaatactctaataagcacagatttttttttctgtttttttgagatgaagtctcgctcttgtaccccaggctggagtggagtgcaaatggcttgatctcggctcactgcaacctccatctcctgggttcaagtgattctcctgcctcagcctcccgagtagctgggattacaggcaactgccaccacgcccggctaatttttgtatttttagtagagatgggggtttcaccatgttggccaggcaggtctcaaactcctgaccttgggtgatcctcctgtctcagcctcccaaagtactgggattacaggcttgaaccactgtgcctggccacacacaggtatttctaattcagattcatgactacattctttatccttaacctactcgattctgttctatatctcccacaccaaaaattctggttctcatcttaattacttgcttgctttatcccattaatggatacatttagtctcagactaattataccaacattattaccaagaaatggttactactgtttgttttttttagtagctctttttatctctaagatatgttcatccactagcaatatacagtgaaaatacagtcaaataattaaattttaaagttattaaaataatcctcatttggttgattcacttacttcaatttatcttaatttttagaaatagcttaatttgcactctagcctgggtgacagagcaagactctgtctccaaaaaagaaaaaaaaaaaaaaaaaagaaatagcttaattttttggtaacggatatgggaaccatagacacagttctaaggtctaatttataagacaaggtatattcagagaagtccagcttccaccctatccctctacccttcttcttcttctccatttcttcccctagttttagttcatcctttcattaaaaaacaaaacaaaaacaaaaaatagatattctctccttgccttcttaggtaaacggtagcatactatacattttctctgttgccttctacgctaagtaacatatcctgcagatcacctgatagtagcatgtggagatattctgcattccttctgcagctgcacagtgctctaattgtgcatttacgtagtagtccaaccagcttccataatcgattttgttttaatataatggaattcttttagttttactagttctaaaacttcacaattcctttatgttcttatggctttgtgtgtaatagtaaatacttgttaaaatgaaactttattttctatttatttaagctgacataattgtatgtttatagaatacatagtgatgttttgatacaatgtgtagtgatctgatcagggtaattagcatatccattgtctcaaacatttatggcttctttgtgttgagaacattcaatgtcctcctcctagctatttgaaactatgtattactgttaactatagtcatcccatagtgctatagaacaccagaacttatttctcccatctagctgtaattttgaaactttagttttaaaacatctcaaaaagagcttttcaaacttaatttatattttcttgtggctgcgtttatccacaactaattatttgaccatggtaataatttttaacatagcttatatgtgttatctcaaattagaacacagaatatgttgtatcagcataagtagacgtagagttaaactagttatctcatctttgtagagagctttatggtcttaaaagtatgtgtagtcatgtattttgatttaatatgttatcctaaaccagactaatagtctgctgacccaaatatatatccaatttggcctactaaaaagaaaataataaatataactcaactttctacacaaaaccttgatttttttaaaagtttaatttaaaaaggggcttatagtaagacctcagattttattttatagaaatcatttcagctcatcccctttaactgaaaataactattgggaaatagttctagtaaaattagttcatcaatattgcaccttagaattggagtcagattttattttaatgttcaggctccaccattttttctttagcctttttcatcttatattaacaggaattttctttctcaaaaacaatctgattacatcataattattttcagtcccatttatttatttccaatttaatttgtcaaagaaaatgacatgcagtgatttcaccttagatgtgcaagtggctgtgtccacatagggattattgacactgtttgagcgtggactcttacaggacaatcttcagctgactttaatttacttaagaaggaaggagattttctggcactgctataggacttgtttttgtctatttagtctctctaggttgttataataatataaatcttttaaatacctctaaaatgatttagtcaaaagtctcattgccattaagactgtcttatttattgagaatgctctgccaatattcagcttctataaaagttacttgggctgtctgtgtggttgactttcttttgcttgtcttctagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggtatgtgtcttttggattttacactgcttttctgtttctggaaagtttgctttttaatatttgtgtataatagcatgtacaaagataattttcatgtcttaggaattatttttagtgtattgttaatatttaatttttagaggattaagaatgcatttcagcagggtaatctagtggaaagaatgcagcctctgaaaatttgatgtagccctttcccgcttttattttttttatttattttttttaaacacaagtgtatcattgtatctctaggcaacaagaattagttgtctgtctgggttccatgattaagtgtcagtgggtaaaaacattctaaatggagttggatttctaaggatggtacccctctggcaaagataaaatgtaatgtcacagaatgtttaactctttgcagatctcagggatgcctgttctcaaaagtggagtcagaaggcttgttatttgtagcccaggtgctgccccagtaggagaatttggttttatgtgaagcactcttcctagttttcaaaaataggaagagtgaggccgggcgcggtggctcccatctgtaatcccagcactttgggaggccgaggcgggtggatcacgaggtcaggagatcgagaccattctggctaacacggtgaaaccccatctctactaaaaaagcacacaaaaaagctagcagggcgtggtggtgggcacctgtagtcccagctactcgggaggctgaggcaggagaatggcatgaacctgggaggcggagcttgcagtgagctgagatcgtgccactgcactccagcctgggcgacagagtgagactccatctcaaaaaaataggaagagtgagattccaactagtgttatgtgcccacctcaggtcacccaacacagattagtgattgtgttatgctagaaattgagctagctgtctaatttgttttaaaacactatctaatatgtaactggaaattaatagtattcttcttaagttttgtgagagatcatttagaaaaatttcctgagaggaacagactccccacagtggttaagacactgctgccacaggcaggagaagatggaggcctggattagggtggggcgttaggaatgggggaacatatttacaagctgctatgcgtgttctaatttttctacttgcaggacactggaattaatccctgattgagatttgttattaaaaccttgaagggaagaacatactatcaaagaaattgttgttaaagttatctctgagaaagatttagggagtagagatttggtaatttaaagttaagcggttggttctcttatgtgtttattagcactggaagcagtctccctgctattgtgtagactgggagtccttgggttgtgcttccttggattctttcgagctctgcttgataatcctcttttctgctgtgatccgtgtggcatgtatttaggggttgcatggatgagaaggtcctcaggtcaagtacagttctgttatagcgtactagttgggcattagtgacttgaatcaatcaaggaatgcaaataatgaagaataacagaagcctgtagaatattcattattggatttgttatattattcgcactttaaacacattgaatcgctgcaagtgaattttttattcacacaattttaagaatgttttgccaatgtaatcttttagttcttaattttttagttttaagcaacttagaggaagcatttagtagaaaaatgtctaatgtttactggtcaaactttttttctttctgaataaaattttccttgtccttatatttttcttatgctattttatagcacaggagtttagtagactgcttaaattaagttcagcttactatcttactagatgctgagtttttgaaacatctttcacctcttagggtttgggtagattatgtgtgctgagaaaccttgtagatcaatctaatgttggaagagtctaagaaactcttcattccccccaaccattgtataggacttttatgctgtcaaatataggtatttctgctttattaaaactccttatgccgaggcccatatataacatttatattaatcataaattgatattacagcaagattcaccatgttaattgcagactcccaataggtctttgaaaataattggtttacaaaatttgatttacatagcatttcatacagtacaaaacagggaatgtctctgtatgataccaacagatgaaccttagagtatgccttggacatttctttttgtagtttctccagaatttgttctttattccacttctcatgtctacattttttttttcttcaaaatttgcaggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatggtaaagtcttctaattgaaattaatgttacaattgattttgatttgtgtatgcattttatatgaatactagtctatatggagacattaaacagatttacattcttcggcctgctacacatataacaaatattttgggcttggttgacttgctattaattgtatcatgctatataaatttagatttatgcaccttctgacacctaatatactcagcggttttttttatggagcctaatagatgctgttacacattaggaaacacatttataacaatcaaatggtcttgactgtaagttagcaatctagtatctaactttcttgtttgtgctaacagcctcatcaaggcagtagccatgagttaaatgaatcattacattaagagctgaagtgttagtaccacagattagtagagagtgtcttttttttctttttctggaatggttcttaggtgactcattagcaaaaattacatttgagagacgtccatatttgtgatttaaatataaattaaggtaaagtacataaatgaagtggatatacttgagaatcagaataagattgttagagttgaatattagacctttgttttgtttaatgatgagattgcggagctacttgctagagactaggaagtagcattctcctattccaggtggattttttcctctcctggttaaaaacagatactttgttagctgagaaaaatcagaactcttcctggtaaacatacagctctatttttgatgctaaattctgtgattttagcatggatagatttaaaacacttttaactggcatcatcccagtttgttcatataccagagattataaactaccctttttctcccctccacagcacaaaatacagcttctaatttgtttttctgaaatctgtgtaggtcttttgaagaaatgcttctttattagaagtgttgcatgtgtgatttttgttttgttttgttttgtttttagctaactgtgtgtcaacagttgtagaattcttttattttttccagtatgttatgatctctaatttcttgttttggcaactctttattggcttatactgtatggcttgagggaaaattttctggtaatatcccacactttcttgtacttcctactaaagtatggaatgattaactagtggaggtatttctcagtctttttgtattaatagttataatttgccatgcattttttcgtgtatttggtccaaactctggttaagtgccttattcctaaaactacctagttcaatctacctgcttcaatatggtgtgtctaatagaactagttttaggttaatattacctggtttgggtttactccaggatttctctcttatcttgatttttgttctgcatttactgccttcctgttccagtatttcagttacaatctaactgctaggaacagattgacactgaaaatagatacagaatccatggtgatacataatgtagttcaagtttttaacttttcaagcgacatgtagctatttttctttacatttttgctatttctttttattataaattagcaaattatatatttatggagtacaaagtgatgttatgatttgtgaatataatgcggaatgattaaatcaaactaatatatccatcaccttaaataccctttttaatggtgggaacatttgaaatttacaatcttgccaattttgaaatgtacatatactattaactgtattcaccatgctgtacaatagataccaaaacaaaacaaaacaaaacaaaaacctaattcttcctgagactttgtacccttttaccaacattcccatattcccaccacctctagcctctggtaaccaccattctattctctacttctatgagtttgattgttttagattctatgtataagtgagaacaggcagtatgtgtctttctgtgcctggcttatttcgcttatcataatgtccaagttcatcagtgttgttggaattgacagaattacctttttaaaagctgaatagtgtttcattttaaagaatccacattttctttattcatccgttgttgatggacacttaggttgattctgtaacttggctattgtgaataatgctgcgatgaacacagggctgctgacatctgttctacgtattgatttaaaatattttagatatatatcctgaagtgggatggctggatctgtatttttactgtttctactagcagaaatgatctcatttgggcatttctaagcactttataatcaactcagttaattaagaggactgaattctcaataggaagtcattgtttaaaacacatgcactgaccgtacagtcactttttttttaaacaaaggtaattttgaaatctgcaattgaataatattcttgtattaatgaacttgcatagcctaacagtagtaatgttcatctggataacaggtttagggaacttgttttcagtgaggaggataaggacattctcaacttagcaaactctacagtaaagataaggtttatttattttattttttatttttattttttgactctcctctttagaccagggataagatttatttttattaaaattttgtggaagattttttcctttccagagtgtagttttatagtctttggtttttgtcgtgaagttttatattttgtccttatgtgttttgattccttttaaataattaatgggttcacagaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataagtatgtctttacttccccacatcttctgatatttttttttctaaactctttcttcatttcttcctgttttgatatttgcccaagattggtctaggttcttttaaaaatttttttgtttattccttatgatagaaatccccaaacatacatacatgaaatgatagaaattaaaataatgaaacacctatcacccaatcctagcagctttcatcattgagaagtagcagggtgagcctgtatgttatccttgcaaaagtaatatgtggagtatctgtgtatattgttcatcctttaggcataaatgggcaagcatttttatagcaaagaatgaagtgtttcaggcatacattgcttaaaaattgtggctaacaacctactagttattcacaatccctagaatgaaattgctgccgtaagagggtgactttttactttgtaagtaatttggcaattttatacaacaaagaacagtataattacagttacaggactcataaatgattcggggggagaaaatatttgccacatatgcataataggcataatgtacacagtgtacagaggccatcctcagatacataagaccagtaacctagtagaaaatggaaatggaaaatttacagaataaaaacaagccaatgaggatatttagaaaattattaatcaaataaattattttaaatctcattaatatagattatttgttttatggttagatagtatttccatagttacattgtaatttagttccactgtgggacatttaagattgtttccaatgtttttaccattatgagggttattaaaatgaacatccttacatgtaaatgtttttactaataaggcaatattagcttaatatattggtattttttagtgttgctacaaataacattaatgaagaaaaaactacctagacgttcttattgaaattcagaggaattggaggcagagaacacaggaaactatattccaaagcatgggaaacgtaacagcataaacgtggagatggaaatatggaggatgtggcctagtgtagttccagacatgggtgtgtcataatcaccaaggaggcttttaggtcttgagtaggatctcaggagatgtatttttaaagatgcttctcaagtgacaagcaactttaaaccagcatgtaggggccactgcttaaagactgtgaaggaatgcagttgggctgggctatagtggccttgaattctggactgaggtggtccatcccattgcccattggaatagtgttgaaagttgtgttctgaggcggtgaccttttagatgtggtaattcacttcaggggagttacccggtgatggatgatgtgcagaaaaaactggaaaggactagatgtgggagccaagtgttagaggttcactttattaatttagatgtatagagacctggaatggggagggtgacatttgatggaaagcagcatacagatgaaagacattaagaaagaagcagagctttgggtgtggagagggcatgctcagggatgttaaggatgcacagtagtggactgggagactaatagaactggtgagataaatggagagatagaaggtttgggaggaaattgttaaatttggttttagttgtgttgagtttgagatgagctattcaaatggaacagtccaggaggcttaggggaaggtttttcctagaggtacagatttgaatccttggggtggtagcaatactaaagctgcaggtagtatgaaaattccagaggaaaatggtaacaagtgagtactggtgttctggattttagagaacatccatagaagacagcaaaggagacagagaactaggcagactagagatttgcaatgtcctaaccttcctttgatttcccacatagctgggtactaagtgggtactcagaaataatcctttgttggcgtaagtttcattaccttgtgtgtgttgtagtactgtactctttgtctcttactgtctgggataatttctttgtaatttgatcatgttactacttgttctgtaaattaatagtcgctgtaccctcctgtcttttcctcccaaaatgcaacagctgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttctgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctctggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtgaaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgcccctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagaggtattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggattctgaactcttgtgtgtgaaatgttttctgaaatgtggaggtgctttaagcagttgataataacccatcagtatgttttcctgacacctggggacctgaagcaaggtggactgtaggtctgggagggtgaccagggcttatcaggaacagctaatacatggggagaagtaggaagtgaaagcccatc

SEQ ID NO: 12595 - DNA, 6572 bp, Human
aacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtcaaaatcttataaggccatatgtcctgaaaggcaaaactctgtgtatgtgcgatttaccagggagatagtaggacagtttttatgagggtttcaaaggagttcatggcccaaatgaagcttgtggccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttcattcaaagctcccctgaacctccatagtgcctccaagatgtgctgtccctgccaactcctgcaccagcttgactggtggtggaagaggccaggaagagcggggggaagacatgtgctaaccacttcttagcaatgaggctggtaaggttactgtccccttgtgcctggtcactagtaacttttttgtagacatgaaggtagatgccctgcaggtcctatcagcaaaggacccaactcctaacagcattggtgctccctcatgaaatttgacagtgtcttttgccaacctcctgctggcagacacttctctgcagtgaataccactatcccatgctgcactagtccctaccaagtcttcaaccctcaatttgatcttccatgagtgtctcaaaaagttcccctcagaagtttcagccaagggaataaaatctaacctctcctccctcaacggagtgtcagggaggggaagaatctgttttccaaacaccacaatctcccaaaaggggatttcaccctcccttggtcatctttatacagggcaattgtgctgctgctgctgaggtggccactttcagcaagccctgtgtgcaggggcctagctgcatttagaaaccaagcatagctatcaaaaagtaatctccaaatagttgaattgcatttcttgagtatctggagaggatgtgcagaccacaggaatacctaatgccttttttctcttcctgtctttgtccctcacactacagcaggcccctcccttccctcttcaacctcatcctccctccccacaggcccagagaaccagttgggctttgttctcctgcaggctatggttcatcatgcaaatagctcctgtgtcagaaatgctttttggcttcaaataacagaaaagctaacaccagctttatcaataataatatcggtggtttacttaaggtgtccagagatggtggagaacaggattggtttcctcctcaatgtcaaggactcaaagactctttctgtggtagggccacatcctaaaccctgtatcctgtgattatttacctgacagggcaaaagagattttgcagatgcaattaaggttaaggaccttgacgtgggaagattgtgattatttacctgacagggcaaaagagattttgcagatgcaattaaggttaaggaccttgacgtgggaagattattctggattatctaggtgggcgcaatttgatcacatgggtccccagaagtggagaacctttcccacctgtagaaagccagagagctggcacctgagaaggacagaactgtcattgcaggatttgaagatgaaggggcccatgagccaaggaatgccagtgacctatagaggctaaaaaacagcaaggaaatggactctccccagagcctccagaggaatgcagccctgttgatcacatgatcaccagatggctgccccagagccaaatgtcgcttcctgagcaccatactcaaaggcaggggaagtggatggagggcaggagctccattcttgtttgccactctccttttgtcaattgggaaaaaattccagaaactctgggagccctccccttacatttcctgggtcatggggccagccctagctgctggagggactgagaacagctgttgagcagtttacctgacggcatctgccatggcttggcaggaactctggctttgggagagagcagcagcaaggtattcaagcaccacctccacccagcccctcccacatttcactcaggactgagtaaaggagacactcagatgctactcagatgctggcttcagctaagtattttgcaaagcctctcgtgttcttacaagtttgtggctatcatgacaaaatggagcagcctactatatctacatatacaactatgggggacctagttttatctcatttaccacaatgttttcaatcattttttggatgacataatttttagcctcttctctaaatgcttcctcaagctttccttgccttccagccactgcaaatgacttgcagtttcccctacatggcacctgacccttgtgcctccctccctctgcccatggcccagaaagccctttcctgtgccctctggcttcctgataaactcctatcatcttcaagagccagttcccatgccagctctccccaagtgctccactgaggcttccgtaacacctctgttcccacatcgggttgactgtctttgttttgtcattgcttgctctggctgtgtctccctcattagactgggatgccttcaaggtagggaccctatctgggtcagcttggcaccccaaagcgtaccacagcacctgattctgaggaggctctcagtagatatctgttgagtaaccagaatgtagggtggtcctgatggtttctgacattgaatagaaaacagctccctatttgatcttaaaataatcactataacctggacatactgtactagatgctgtttttgtctgacttctactctgtcaatctctttgcacctccatttgttcatctgtgaaatgaagaaaatgctcatggagttcagtgaagattaaatgaatgaatataggtagactgcctaatctggcacttgccacgcagctgacttcaatatagtagctctaatattatggtccttgaggatcttactgtcttatggcccagaactgcatttgattaaagaaggctcccctaaaaaaagagtcatacatattccatttgtcctttcagaaggccgtgaagcatttacactctttaagacaaattcccatccaaaaatagttaagatttctaaaatattttgatgctgaaagaggtgtgcttcagttgggtggcaaatttgcttctatggaagatttttaatacaggttgtttctattttactttttctggctgaaaggattttacatttattcaaagtcaaaagggaaaagaaatccaagaactacagaagagcagttgaagtgatttatgcttgatttctaaatgcaacttatgtttatacataatttaaaactcaaagaaagcatgcttatacaatcatgtgcaactttaaactttaagaactctggatgaatacatggtggcaacagtccatgacacctgaaaacatcatttgtggagtggcgtagagttcagtgttcgcagtcgcatattacaaccatgtttcacacagccctgctcggtttgattttctccacgtggttgataattgtcttcagttgctgctaagtgattttgcaaatttcatttataatcctcgccctacaattacctaagtactgtttctgcaggttaacctgtatgctacgctcagtcatatacctttcaaagttactaatgcaactgccaaagagggacagtgtcaatatcattgtcttcattagaaggacggctgccccacactgtgagaacactgctgttcctaacagtagtttacttttagagggatgtgagaattagtttgaccttaattccagatgtgcatgcctcaaaagaaaaatcccattctccttccttttggggagcacttttggtggcaccaaggctggtgtggggtagtggagagagcactgagcttagagtcacaaccagatgaaactgctctggtcttcactagctgtgtgacttgggcaagcagcttgcagtctctgagcctctgagatccctgatggacgaggagaacaatgaccccctccccaggctgtgctgagagagggaattgatcttggatatgaaaatgctgccctggcacagaggtaggagctgagcaacactgctggatgaataaacacatgtaatgcagggtgaacagaacatttcatctgcaacagctgaaggcacagcttacctatgcccatggaaagaactgcgtggaaaattcatttgttgcatttttgccaggttgatgtttgcaaagcagggcactcttctccacatttccccaaaaccaatcagagggagactccacattgtttccatctcctcccctcaaacaattatcaaagccatgtagaacaaacggctgtctgccaactggtagaggcaaagcagccaataatctggacaggggtggcaaactgctcctgcagtttaaccctgcctgactctcccaagcaccagactgtgaagcctggagaacagcctgggggagctgaacaaatgcacaacacctcatgctgtcaagccagaggggaaacttactgggaagaagatgtaggaagaagcctggtcagcccacgcctaaagcacacacctggggaaataaattagctatttctattgcacatctacccacagcctggtccagatctaaatctcttcccctcccagcagtgcagcggcggcagccgcaggctcccccagcgccatctcttcagtcaggctcctctccaggtcctccagctcctggcgcacctcctccatgaagctgccaacttcatactcatcggggacctctctgggcagcaggatctccccatcttggtcacggctccccacgaaggtcggcttgcacacatacaccaggctgtggctggggagagatgggacaaagccaggctctaaacgtgggagcctgcccaggccgaaagctaaggcgccctgactctgtggggctcccagcctcaccttcatgccccctcctctcctgtctcttcaacagagacacttcacttcccgtcaacatctatcttaaaatgatggctgagggaggctcactttgggagaatgtgctggtggggggcagcttcccctcctccagcgcaggcctgacctcctgtgactctcaggccccgcagcccaggggcaggacctgagtgctatgtagcagcaccacagcccctcaaagactgtggcccattcgggcctccaggcaggagtcagcctgactctggggtgtagtctagccacatgcagggagccatggacctctgtgggaatagggaggaagaattcctttttttaaaaaaaattaatgtgtttggtagagacgggatctccctatgttgcccaggctggtcttgaactcttggcctcaagcaatcctcctgcattggcctcccaaagctctgggattacaggtgtgagccactgcacagagccgtggggaatgggagttctgcctgtctgcccagcagccctggattctgttgggagagaagactgagtagaggctgcggggaggacagggagatgtgccctgagaagctggccaggcttgagcctcatgcctcatggagtctcagca

SEQ ID NO: 12596 - DNA, 9226 bp, Human
aatgtttcataatttttaataaaaggcaagacaatataaattggtagttatttaagtcattctacttttcctgaggcccagtgcaggaaaacaaagttcctatccttgttccaactagaccattttgataagctgcaaaaagaaaagactttgatgctatttcttagccagtttgcaacagctgagaggtgagcatggaagctcttgcatatattcagttcagagaatgggtgcttagtttatgtccagagtttgtcccagatttcactatgacgtcagctctccggggagaagtatataaaataaaaagttaaaatccctctcagtcctttacccaatcctattccccagaggtaatctctattgacagtacccctccagatattttccctatgtatatacaaatacacagatacacactgaaagttaattttggccaggtgcagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaaccaatcatcttctgagatttatacagattgctcataattctctcctattttttaaaaacatgctgcagtgaactgctttacactcattttatgactacttctgagaccaagatcccggattatgtaattgttatttacttaaaattctggtaaaatgtagccattatactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacgggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttaacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttctgggtgtaggaagcagagattaccaagcatggttccatagcctagaggagtccagtgtggcctgtgtgtgtttggagacagccaggtagtatcccgtgagatacacactaatatatggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtacttttagtacagatggggtttcgccatgttggccaggctggtcttgaatccctgacctcaagtgatccgcccgcctcggcctcccaaagtgctgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcgcatgtagactggggttaataatagtagctattgcattaagccactggggaaaggcacaaagataataatgtatgtaaagcccattgcccaggttataataagcactgaatcgacattggctatgattatttttgattaatgaaggggagggggttatggcactggaagattttaagtaggaaaaggacatgatctcatccctgggtcaggtggaggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagttgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctggggcttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagaccccaagttcttctctcaaagccccactccttccccgtcacaaccctaactccttcttctcaaagaccccaatttcttttctcaaagcaccaagcaccactccgtcccccttcccccaccatcatggcctttaactcctttctctcctagtcccccaccccaccccccttttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctggccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgatcctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccactttgcaaaatttctggaaaagtaacctatacccatttcttctgcttccttatttctcactcattcttttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactctaagatcaccagtaacctctaattgtcaaaccgtcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggcttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcaggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattcttttttttttttaattctaaaaaaaaaaaaaaaaaaaaaaaagagtatgtgttttgtcatcagacttaagttttacttctttgaactagaaatttaacttcttcaagtctcagttttgtttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctag

SEQ ID NO: 12597 - DNA, 18197 bp, Human
tgtctggggaggcaacagggtcaccgtgtgctgccctggcactgttcctgccagccctggcaggagtcttccggctcagagtcagcctcttttcctctgtcacgtcccggctgtctggtgttcacccttgagagcctcagttttccctctgtaaaatggggatgcctttgctactatggaaagtgtgtgctgagcacctgctatgtgccagacattggcctgagtgctggtcgcacatggtgcacaaaacagatgaggccccacgggctccattccggggggaggagaggagggagaggtgtccaacacacacacagtcacctaggggtgcaggaagatggtggccaccctggaaaggtcggtgggctgggaggtaaaggacaagaagggggctggcatgtaaagcccctggacaggcctgatggttgtgaggactggattccacagccagggtacaacctgctcgggacctgggtgcacagagcctccagctgaaggtgctgtgaagccccactcctccaggaagtccacctgggaccccagcccacacccccgcatcccccagctcccggcagcggcactcctgtctgcagggtgcacccacctcatctgccctggaagatgaaaaccccgcagccatcagcagccacctctcagcctctcagaggcacagcagtgcagctctcagacctcccggctgcggggtgtgcagttccggctccaagcgtggaaagaggtcaagccaggccctccaagctgattccagatgaagcccatatggatctggaaggagactgggctggaaaatgctctcctgggtttcgctgtaagatgcctacaggcctaaggcaaaaggatgtgtctccactttcaagaaaagctgggaccgcctgggcaggggctgctgagcccaggcagcgagaccccacgtccttcaggaccgcagttccccattcatttgaagagcagtttctgtatttgtcattctctcagtacagtttggggggtggttacaatgttcagggaaatgttttaacagctcaactctgcatctgaaaaaagaggggccgtgctcccctgctgacccgttagagcgcagggcggccagcactcccgcaactgcagcaaacccaagagtccctatgaggagggaccccaggaaactgcttttcaatctccatctgctccctgaggtgggacgccgggtgggggccgggccaggtgactgctgcccttgtcccagctgcaccttgccctgccacgctggccgtgctgccaagcggatgtgaacgccgccacctgacacccacctcgcctgcccccggagcgtccctggtgacaaggctacttctggcacccagggtggggcaacccagccccgcccagacacacgccccagttggcctgcgcgcccccacgagtctccccgcaggggaccgagaacaccctaagagccaggctttctgccaggtggccactggtcactcgggggcggttccggcggccctttgcgtggccaccggcctggcacgggcgcatccccgctggttttacgcccttggggagctgtggttctgcgcgcgggagcctgtggctgccccggcagcggggggagggggcaccgggcggggcaggaggcccagaccatggggggcagcgccagagcccgagccaccggcaagccatgatgggggggtcccctgggaccgggagggtgggagcagagcgccagagcctcggtaacctggcagaaggctgtggggagggagcgtggaggggaggtccgggccgggtgacccagggcgggaagggggggccgtgtcggggcggggttggggacagtggcggggcggggcctggtgaggggaccgtgtcggggcgttgtggggacagtgtcggggcggggcgccgcacctagcccttccctgccgcgcgctcctcccccacgccgcgccccgccccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgaggcaaggccgggggccgccgggaggggccggggaaccgccgcgccgcttccgcttccctaactttcttctgggcttccctccttcctgccccgcccgtcccgccccgctccggggctccggggagagcgcgcctgggccggcggcaggcacaggagggggtcccggagtcagggggtcccggagtcacggggtcaaggagccggcgtcacagtgcccagcaccccaccccccgccctggccccgggcgtctacaccggtttcggcctccgccgcgtccctgcagcccggcgtggggttccgggggtggagcagctttcggagagaaagggggccggtccgcgctgggagaggctcagccctgcttcctgagcggggaaaccgaggccggggcggcggggacttgccccagggctattgatcagggcgcacgacggcgtgggggcacccctcggcctccctccgaccccctcctgactgtccgcccggtgatgggcgcacctgtggggcgggttcccctttctctccctttcctcttcgcagggaggtgggggacccggaggggacctgcttccgtgctggggagcgcgcccctggcctacagctccgggggcccagcttccaagcgaagggaaggaagagttaggactagggttcggcggggctgaaattttcccctggacgccttccagaaggtgggagcttggttttgccaggctggggttgggggccagaggtcagactgggctgccaaagacggcgggggctgcctgctcctgggcggggtggctgctggagaaggctcttgcctgccccctctccctgttagccgtccccaggctgttgctacatttctccctgccctgtttggactgcccagccagtggcttttgcaatggcctggggtgggggcattgtggccccagaggcccccttccccgtggttccaggggcagtgggtgagggtttgctagctccctgcactcgctgtccttgccagccctgggagggcactgaggctgctggaacgggcctacagtcatggcttccaacggagccccagaagctccaggaatatgaaggaggaccctgggcctgatggtgagcatggagagtccgagaagggcctgctggctgctcagccagacgtgtgtgaccagtggtgatgtgggccaggtggcccaggccggggtcccggggagcgcacactccagggctggcccaggtggtgactggcgctgacgtccccagtggagcacccttcagcgaggaaggcagtttgcagaaacagggagttcctgggggctgggctctgggcacctgtgctggaatctgtgaaggcctcacctgtggttctggccctgggatcccctgtaggcaggggtctctgtgaggggcccccctcagcccctggggtgcttcagagtaggggcgagggtgcggctttcccagctgaggaggggccagtctgtgggttccttggggtgccccccaccccgaggaaatggcttgtgtggttctgatgcctgcagggcatcctgtgctgggcgtgtcctggggtgtggacaggggacggggtcctgttcttttggcagaaatgatggggcacctgacttaggagaccctggagcagaccccactactgagccaggccacaggccacgggcctcttcatcggcggcctcctcgtgtgagaaagcctggcttgttctgcaggggcctctgcctggacttcctagctgttttccagggaccaaatcacagttcacctgctgccctttctatggacctggcaggctgggttggctggcactggccctgctgccccactgggccctgtccccatctcagcttggagattctggctaacctgggtgtcctcgggacctggggcctctgatggtgcttggatgggaccctcctgccgccctcacctctccagggcagcacccaggctcaggcctgtggagtagtgccttccgggacactggctactaacagcaggtgctttgttcctgctttggtccctgaagagaagggagggccagagggcagggcagtctggaggagaggcctggggctccatggctaccttcccccacacctctgcacgtgctccccaggccccagggtccctgatgacttccaagactcccagcaatggctaagagtggggctgttgcgaacgtgcgttccctccgtgggggccgtcgggaggggtgagaaaggcagatgaagagcaggcgctttgtcactccagggaagggacccggggggctggaagggaaggaggggatactcggcctctgttcctgctgtacgccacgggtgcctccagcctcaggaacagggattcgcgtgtgctctgtgttacaaataaggacactgaggctgagataagcaacttgaaactggggcagggtccccaagccaggatggggtggaactggggttcgaacccactgacagtgactccagagtacctgcttttccctttcccttgttcccagcccagcgcttggggctggtgaggcagccctgcggcaggcctgagctctgggaggggcgctccatcttgcccctgagcaatggctgccctggctgaggcccagcccctccccacggggttccaggcggcacccaagagacccccaccgtctacaccgtagttctgagcgtgtgagggacagtgatgggactagaacctctgaggcagccttcgttcccaccgggcttggggctgagaccatggaccccttccaggcagggggtgtcccctgagcccttccctgtgtgcgcagttacggtggagctgcaggggacgtttcctcaccaggggccgatgccctggtacatccattcgacagaggaaagcaaagcccagagcggctccgtgtcctacagctgggttcagctacaggatcagaaaaccctcaagacagcagcttaatccacagagaagtttactttttcatacagcaaaggagaccagatgggcagcctagggaaacagcagttagtttccggctcctttgacctctattcccaccattttcagggtcccagacagaaaaggggtgctcttcctcttaaggatgctccccgaattgaaccccacgctctgctggtatctggaggccgggacctagtggttgtggcagctcctggctgcagggcaggctcctgtccccatggagcacgtgcccacaccacacgcccagtgtggggagaacgcacaggggacttgggatgtcgggcaaggtttgacccagatttgccggccagtgcatggtcccgggtcctctgacagatgtccggtgatgacagatgccatcgggggccctgtgtcaccacagcactggggtcttagtcccaagggagaccgtgaccttggtcctccagagcgctccaggtgtctctgtgcaggcccagaaattggagctgtcctgactgagggatgggagggcttctctggccccacctccttcccgcccgccacacctgcactcctacacatccgctttgaggagtcacggggaccccccacatccgggtgtttgtgtgggctggaccccgcacccctatggacccatcccgccttgtgctgcagcttggatgacacttgtcggaaaacaccagattcctcactggggtccctgtccccggtggccccagcgagccccagcagagggggagggggctgccctgaatgagctcacgcagctgaagatgggcaagtcctggctcagagagctgctgggtctcctgggagtgtcccagcccaggaccaaggcaagggtcagcgagtggccttccacgaggacagcctggccagtggcctgggccctgacctagaaccgcctcccagctgcctgagccaggtgctggtgggattgggggcttaggcacattgaggggccttttgcttcgatttactttggatttttttttttattttttgagacaaggtctcgctctgttgcccaggttggtcttaaacccctgagctcaagtgatccgtctgcctcagcctcccaaagtgctggggtcacaggcatgagccaccgtgcccggccccacccattttggattcttccccccctcccccccaccccctagtcatccccatcacagccactgttggtggaggtcctgccctggcccgatggtgccccgggtgtctccgcctcatagaatgtaagcctgcacacccttccacaagagcctgggaggtcaaatgcattgcccgaggccatagctgggaagaagggaaatgggatccaaatccccgtcaggcccagagcctgagtgtgggagcagcccaggtgcctgggggctgagctcaggcggtctgaggaggctgggttcctgcagaccccagaggggtctcttacggggcttcgctcgaggccagtggactccagtctgagggctcctgaaaaagactgaggcagcacctgggctttccctcagcaggagcccactgctccgatgccaccagaagggcccagtctgggctcagcctcacttagttttgggcgctgggctgctccctgggcctcctgccttgctgggcaaagctggcacaagtcacccgcctggcagtggccagcagggctccctgagctccaggcttccggcaaccttggctttgcccctgctccccggggaggcaaggagtccaggacctggatttggggtccgtgtgactgtgtcctggtctggcacagcgacacctgccccaggctttgaggaaaggacagggcagcccctcgtccgcctgtggttggtgggaggggagtttgagtgaggcagggtgtttggcacaggacagggactgggctgggcaagctggtgggggaagcctggggacagtggctgctctgagcttcctgctgggggaggccggagcaagctcccagccctgctgaggggttgaggggactgcggagcccgggggagggagggagcctcaggatgagctcctagagtcctactgggggcccgcgccgccccagcacgactctgccagctccgaagcagggttccgaggggggctcaggcctgttctggcttccctgctgtgtggccttggggaagtcacttaactttgctgaaccttgaacctcgcattcctcatctgaagaggggggttatgatcgtacctaccctggggggttactgtcagaacaaaaggaggtgactcatgtagagcccttgtctcgaggctttgcacacaggaggtgcagggggcctctgtgcttagaaggcgatttttctctgcttgggttcccgggggtgtcctcggccgcaggagcctctgcagggcttagttcagtcccttcctctctgaggaaacactttttttgtgtgtgtgagatgaagtcttgctctgtcacccaggctggagtacaatggcaccatctcggctcaacgcaacctcctcctccctggttcgggtgattctcccgcctcagcctcccgagtagctgggattacaggcagctgccaccacgtctggctgatttttgtattgttaatagagacgggatttcaccatggtggccaggctggtcttgaactcctgacctcaggtgatctgcccgccttggcctcccaaagtcctgggattacaggcgtgagccacccgcccatccaggaaccgcttgtaaagtgagtctagactttcccaccagctttcagaaagctctgaactatgtacgggacaccgcgggggaagtgcggtggcctcacgtggctggtgcagatggccctttgtccccttgaggacatcaacttcgactttcttccacccccagggtatacctttctcccccagccacactgtgggctgcagagttctagagagccacagcctcccgctggcctggggcagcctccgtccgtccatctgtctggcctgaggaccaggggccggtggtgggcggcgggacacagcgcctgctcagcaccgcctgctgggcgggggtttgtaccccgtgtctttcacagctgagagaagtatcagtgcacgatccaacccctaagcagcttagattaaaaaaaaaaaaaaaaggaaaagttttggagctagagggtggtgctggccacacggcagtgaatgcgccgagtgccacggaaccgtgtgctgagaaatgggtacaattatattgtttaggtggtgcgtgttataccacaatcaaaacagaggagggctcggcgcgctggctccttcctgtcatcccagcactttgggaggccgaggcgggcggatcatgaggtcaggagtttgagaccagcctggccgacatggtgaaaccccgtctctactaaaaatacaaaaattagccgggtgtggtggcgcacaccagtagtcccaactacttgctaggctgaggcaggagaatcgcttgccgggaggtggaaatggcagtgagctgagatctcgccactgcactccagcctaggtgacagcaagactccgtctcaaaaaaaataaaaaataaatgaagatcttattttttaataatttcagatttacagagaagttgcaaagatattacgggggaccccatgtggccctcaccagtttcctcccttgttaacatcttacatcaccaagatgcagttgttaacactaagaaactagctggccgggcgcggtggctcacacctgtaatcccagcactttgggaggccgaggtgggaggatcacctgaggtcaggagttcgagaccagcctggccaacatggtgaaaccccgtctctactaaaaatacaaaaactagccaggcctggtggcaggcacctgtaatcccagctactcaggaggctgaggcaggagaattgcttgaacccgggaggcagaggttgcagtgagctgagatcacaccactgcactccagtctgggtgacagagtgagaccctgtctcaaaaataaaaaagtaaataaaagatggaactggccaatgtcactaccagagggaaccaatgtccctttcagatgtggcccgagcctcctgcaggcagctagctttggaattgcaggtgtgtcttggctgctgctagaaatcatacacatgtccttcacaggagatgagtgtggacctgtcctgttctttccccgcgccccagctgtctgtgaaatggaccctaatttactttccctctttctactggtggctatttaagcattttcaggttttcctaattcactgcacacttcagcaccacaggcttctcactccagccatcgggcgaattcctggaagattctgagaggggaggggccaggtttcctcagggctctggccgggcctgccaacctgccctccacagaagtatcttgtctgtgcgactcctcactcctgccagccgctgggcctgttcccaacaccctggctggcacctcctgttatcaggcgttttaatctgtgccagggggaaggatgaggacagtctcttgtttccatttgcgcttctttgattggcgacacggccgtcttgctagcaccagacagttctgtgtttcctgttggtgaactgccggcttttgcctcctcgtcttcttggagcgtcacaggggtccgggaagctggattgcgcaaatgagtgtggaggcaaaacagccctgcagttcccctgagtgtgcgggtgctaccagcccgggtgtgccttctgggtgggaggggacggtggccggcgcggcctggagaggagatatctagagttggctgaggaaggcagatctgaggaggccccaggcttccaagtccagggacggacggctggactcatcaccagaattaaccattaggccccccttgactcagtttccccatctgcaacagggggtcatgagcattgccccatcagcctgaggtggtgctgccgcaggcctgggctcacacatggaagggcagagtgccagggctggggaggggacaggggtttgtgtcgcatgggaacagacgtcagccagagaaggtggagagttctggagatagagggaggagatggctgctagacaccgaatgtgcccagcgcccatgaactgtgcacccggaaaaggccaaggagatacattttatgttacgtgtattttaccacaatttttttttaaaggccgggcgagttggctcaggcctgtaagcccagcactttgggaggccgaggtcggcaggttgtttgagcctaggagttcgagaccagcctggccagagatggtgaaagcccatctgtaccaaaaatacaaaaactagcgaggtgtggtggctcacgtctgtggtcccagctagtcaggagcctgaggtgggaggagcccaggaggtggaggctggagtgagcccagattgtgacactgcacaatgtgacacattgtgtcacagagcaagacagagcaaggggagcctgggtgacagagcaagaccctgttaaaacaacaaaaatccccaccagtatggctttgagagaaggccccggctttgaatctctgctctgtggcctggggcagttactcagactcatctgtagaaagtgtggggcccttaggactgctgggggatcaaatggtggggggcactagtctgcatggagaggggagcagcactggcagccccccagtcagcgctggcacagccttgccccggccatccacccctgctggagcttcggagtggagctccgtcctcctggctccatccccgccggctgccctgtgatggggtgccctatctggggtgtgcccagagcttcctggcagcacagcagggcagaggttgggacgctcggagctggtcagagtcttcgggtaccccttggacatccctggtcccaaccatgacgggctgcttggacaaggccacctcacatttgcaggtgctccaagggcagcccccagtgggctgggcccctgccagagtgggggctgctgtggccagggctcaggtggcccggaccctggctctgctgctgctcctggtgtgacctcagacaagccccgagcccctcgccgcctcttcacggggaaagggaaccggcctgattctgtagggtaggggtgagagagggtctcggtctcggctcttttctggaagaacctttcggaggtcgtttcagaggtctccactggcgccgacactttcttcctgatgtggccctgccttgaggggccagtgaccttccccagggtgtgtggggccccatttcctctgctggggtgcagaggctgctctccccgacgtgggtccttcatagcggacgtgagagccagtgccagttcctttccggctgggtcccctgtggggtggatgagggctgggtgggccctggatgtggatttggaagtgggcgccttcccatgctcctagcatccgagttccagaggctctgggttttcctctgttgctggggagatggaggcagggcagccgtccaggtgggtgagccgggcccgggactctgtccgcttcaggggctccctcccctgtgtctcccggtctcctgccccgtgccaggagggcccctccccagcctcctccacaccccacccccaggccttcccgccccagcctcggctgcgggatctgtgggacccgtgttcatggtggcctcccctgcagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggtaggccgggcctcgggggtggcttctggggtttgagtggggccggctgagctggggctgtgtggggctgggtcccggggacgaggacacagggctgcctgtgcctgggcgagctcggcctcagtacctccctcagggccagacacagaggctcggaggccacacgacccgtccaggtagccagggagaaggcagggtgccaggcaggcctgtgggtgctcagcagctgtcttccagcgcacgctgtctccccctctctctctgtctctgtctctctgtctcccaggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacgtgagtgtgcagggccgggctcggtggggttggggtggggcctgggcggggccaggcaggggccagcttgtgacttggttttggcagaaaaaacaagacccccacatcatccatgctccgcaggtggggtcccacgccagacccctacatcatccatgctccgcagatggggtcccatgccagctgctttgcgaagtggggcttcttaggaggcgaggcggcgtggcctttctggggtggcctgggcgtgaggtcagtccaggctctcctctccctgcagctcaaagtgtggatctatcccgagggtactcgcaacgacaatggggacctgctgccttttaagaagggcgccttctacctggcagtccaggcacaggtaggctgagcccagccctccctgggtgggtgcaggctggggaggcggggtcaggctggcttaaggcagcaggtgaccaccagccgagctgaggacccttgacacacaagggactcctcccactgagttggggacagggcctccttgccccttcctgcacttgccccctgaccgaccagggagggcagccccttgggccttttgcccacacagagcccagagtgaccagctgcccttggtgggcacccagtgcttggcctgcgaggctgggcaggtagaggggtggggagccgggccgctcgcctctgctgcagagctctcaggaggctcatttctgggcctgtgcctggctggggtgggcttcagggcatgggcagtgggtctggacaagccaggcttttggtgtagtatcaggccagaccagagctcagggtgggtggagctcattgtaagcagcgcctccagactctggacttcctggtccccagcctccaggggtgcagtgcatcctagggtgtctgggagaggccagggtatagccattcccccagcacctgtcctgcctctgccgctgtgctgggaagagttgcgtcaggagaaggagcttttacccatctgggtggggtctcgctcagggcaggggtctcagctccttccctcacactggccactagtggcccccagtgcctggccctgtgcaaggtggtggggagggggccctccttccagaggctcccagctaaggccgtgaggcctggggagccccggaggcgctgggctgggtgagcatccttgggctctgatcccagccctgcccaggtgcggggcacacctgcccagcctggggctgatgtcacttccctttgggggcagagtgagggctggatcagctctgggagagcagaggggagacgggcggctgtgatggggtggctgggggtggccgcagtgcagcttcagccaggagacccacagcttttccgtccctgctcccggtccccagcctacctgctggccccctccctccctgctgccagtccccagcctacctgctggccccctccctccctgctcccagtccccagcctacctgctggccccctccctccctgctgccagtccccagcctacctgctggccccctccctccctgctgccagtccccagcctacctgctggccccctggaggttccctggctgcctcgggttaatgatcacccccaagtgcccttggatttgaccccggtgacttccaggaacaccagcaggctccacccctcccccgggctagggctgcctccctcactggcttcctgagatggagaggactgggagagaggcgtgggcagggaagagtgccataatctcctcctaaaccggacagggccctgcccccctggctagctgcagacccaatatggggacaggtgtgaaccaggcaaacacgtgctagctcaggagggcttcctagaggagatgagtaaaaatttgcaggatgagcttatggaactctgggccaaccagagcaggacacatatcccaggtcccaggggcaggacagccacaaggacccatggcagcagcgaaggcaggggtgggtgggccgcaggacagggctccccaaccacatgcagcctggggtgtgcctggcctgtccccagggctgcctcagctgtgcgtctccctgcctgcaggtgcccatcgtccccgtggtgtactcttccttctcctccttctacaacaccaagaagaagttcttcacttcaggtacccccacatgtgtgcacccggggtgtaggccccgcctgaccctacagtcacggagccccgggcccctcatcgttcccatttccgggtggcacccgtggcgtggccacacggtgaccacgtggcgaatgagtgactcaggctggagtcccagctgtgggcttcatggcctcatggccctgtgagatgggtggtgctgggcccatttttcagatgagaaaactgaggctccaagagacttcacacggatggaccccagctgtgcacacagcttgggggcctggagggcggcctctgagcccatgtgtccaggctgatgcccgcatagggtagatggaacccaggcagcccaggggcacaggctgcggggctcatgacctcttgccccttccagccagttcccagaacgtgggcacctggtgcccaggcaggacagtggggtcaaagttggagagcagtgggggaacccagctccatctctcccacagcccctcgccccgtatggagggcagaggccaggcagtgaggtaggggctgatcaggaagtggggctttctgggggcagtaacaggggagcgcagacttgtcgaaaatgcggcgtgaaggccaggcagccatggggtttactgcagcaacgttactgcaattaaaataacccaccacggctagggagtccaggggaagagcccggcctcgggcttcccagggaggggctgtggggggctggggagaggcgaggccagggcagcaggctgaggtgggccccagctccccacaggccactgaggtctgttgcttcccccacaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggctggggagctgtggtcactcacagggcgggcaggtgaccagggcggtggaggcgacgctgtgtcttcccagctgccctgcctagaggcccagggtgcaggcaccgccacccacccgtgttccctatccaggagtggacccacatcaccctatactacttccatcgatgggtgggggtgtcgcctaacgggcaagtgtgccgggatcctcaggctactgggaaggaggccagagatttgctctttggcctctggttggggccaacatgtccccaggacaaagctctctgtggcctcacagaaaccacctgcccaccccctctgccttggaccccctccccaccccacgactgcccgctccaccaggccccctttgccagctggcacccagcagtgggtctgggaggggtggccaggaggtgagcgccctcctcccaggcccccagtccatccactgacacagcagctcacgtttcatttttattgtgctgggggtcaggcagcagcccccactgaggccccacccagcctccgggctgcctggcctgtgccatgggtcccaggctccagcagggagctcgtaccttccctcagctgagggcccacctggccttgggatgccgttggggtagccagggtgggggtagccaggggtggattcacagagaagatcccagcccatcccatgccagggtctggggagcctcccgaggaaggggaggaggaagaggaggaaggccctgcctggccttccgctcagtcaccccgaggtggcttctggacccccagcatgttgggcaggggcatgggggctgcagggcggcgtgaggggctcagtccagcctggggcgctgggcagtcacgagtctttcttgcaggagcctagggttggatgaggcgaaggtcagagatcactgctccccacagcctccccgcccagctagatctgactggccccttggcctttggtcgcccccgacccccaagcctgggtagcccctctaggcccactgggcccagacccgggaggagggctctggagggtgggggcactcacaggaccccagctgctcctccaggaaggaaatctgctcgctcagggagtcgatgcggccgagctgctggaaggagtgcaccaggaggctgccggggtccgggagcccatgctccagtgcctgcgaggccaggctgtgcagtggggccagcaccagctgcagcttctgtgggtgcagaagggcagtgaccctgggccggcccccgccctctctgctccaccggggtctagggaggacccctgggaagggctccacaagcctccagcccccgcctccgcggcagggctccaagtgtccactagagggggctgccgtggcagaaaagcttgccgcagagtgggtgcctggggcatcaggctggcggggtggtcccagccttggggtccctggcaggagaactagggggacagctggaccactggccagtgggaagactggcaagagctctttgtcctggtggggacaaagatgggggggtggggaggtctcgtctgggtccaggctctgtgtattgtctggggggctgtcaagcttggttcctccggccctggggggtcctggtcagtgtccagctgcttctgcccagcatggatccaggccagggccccctcggcagtcagcagcgaggaagccacctccccagggccaggaccttttcagaccacccccagccatccgtgggtcgggaccatgtcccaggagactacggagcctgtacccgggcctgggcctctgctgttgtgaagacctgccccctgccgacgcctcacctcctccagcaggtccaccctggactgcctgcctccccccccgacgcctcatctcctccagcaggtccaccctggactgcctgcccccccgacgcctcacctcctccagcaggtccaccctggactgcctgcccccccgacgcctcacctcctccagcaggtccaccctggactgcc

SEQ ID NO: 12598 - DNA, 49673 bp, Human
acagagtttgacatacatgggttcatttgccatttatttttccctgtaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtcagttactttttcctgcatcctgctggtgttggggtaactcccaatcctagatgaaaaccttagactttctgttgtcaggtgtccccaggcaatatcctacgggggcatgatagaaaagggtaactctggggtcagatagatgtacttactcactgtgtgaagttgggaaagctgcttaatttctctgagcctacttcctcacctgtaaaaatggggatcattattacctacctcacagggttgttgtgaggattaagagatgggatgtgggagcacctagccgtatctggcaaataggtactcaataaatactggttttacttccctttcctcttgccctttttccccaaaagtattgataatggaaaagcagtccctttcattcttaacagtcatttgggaatgactgggggacttttcaaaccttgaagaattggcattgctaagagttaaggtggacgaggctttttaaggtggctctaatcctctaattaaatccttctaattaatgaatcatcactatataaacctctctgttgggaccttactttctcaagttcagattctattagagaaataaatttacaatcacagggaaaggttttagggactgagttcccttcgctagaacgtatagtaattgtgggcttatttgcctgaaaagttgatttaggactaccttcacgcagtatccagggttattagtgaaagatgctatctgcctgggactttcacagtggacttaagtttcaggtgatactagggctgagaggcaaattttactagaacctctccttttgcatgttatcgcaacaggaaattttagtaggagattcacaggatgcactggtttgtttcggggtgtggaattgaagttgacttatcttggttttagttctaagaccctaaggtaggaagatctgaattatactggagagaagggcagcatggaaattttatggaggaactacaggcttacctttcaggttatcgagtatctgctagcgatttcaagtggccttttgccaatataggagttaagcaaatctcaagcccacagaaatacgtgaatagcaaaaggaccaggggacattttgagaggagtcagtgggccagagacggcaaaaagttattgctgaggtcctaagcacagtcggtgttacgatctcagatgtgagacgtgaacggcgcccaggccggatagcttgttcccattccattgatctgagataaccccaacggaggcagtgtcccatacttgggtaggggtcccgagtctccacagccagagatcaaaggagttttctggcaggcgagaaattaccagcagatattcccgcgcgggatgtaggctttaatttagaaatctccgccccaaaactggcatcttgaacgcgggagggcattatgagttagaggccccggtttttctccatttatccaaatcaggtagccgaaaggtaaatgaggcttcaagttgggcggcgggcagcgaacttgacagaacctcgaaactctgcagatccgccgcccaacccagccgccagctccccgtgacttccgctttcggtctcaactcctctccctgaggagagtggtttaaacggtgaaggctgcggggcgtcgccggaagtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgaggggctggaggcggggactgagtggtggtcgggagagcctaggcgcttggaaggcctgaacggggtctggtcgggccgacggaaaggaccctaaagggatctggagggcgtgccgggcgtggggcggggtgttggggttcctagctgaggccccagagggcgtgatgaggggggtggggttttggggttgcgggaattaggctgtagagggtgtgactccgggctagaattgcgtttagcagagagacttgggagtatgggccggtagatgttgagggagtaggaatatgggaaaagctcataaaggaagagttgatactaggaaggttttacgttgggttggagcgtgttggtaacgagaacggcatagagtatatgttgggcttgtataatggtttgtgagtttggagcgtcgtggttctttggcaggataaagctagcaggcttgaatggatggtacagagactggaacagaatggtcacataaggacgttgacatttgttagtaagagagccatttgaactgttggaagaaccctggattatccaggaacatgaagataggtaggtgagataaatgacaagttatcaggtataaaggaaaagagcttgggtgcagaggccatctctacttttccaccgtttcctatcatttttattttcaaagttttataacgtcttcttctgtttttacaaaaggatgggaaatggtgtgagctgaagaaatttaaagaatgatttctttgaggtttgtagcagaagatctagtgaacaagagattacacattggaggatgctgaatagttgctatagatgatgtgtagttggaatagttaccttaggataagttacagagttggacatattcactgtaaagactatggtagacttctggtggctgttttatcctttttggcctcttcaaagcaaaaccattgacttcaggaattactgtttatgttatttgatagtcgttttaattggctttttttaaacacagtcggatgtattttactcaacatgagtttcaaaatttttgagaggctcagtaaatcatacaaagaatactggcattagcttactaataaatcaagccacatttcttcattattagtgaagattttctagggtagtatttccattattttccaatattttctagggtagtatttccattagagaagaataagtaggagtaggggtttctacagaaacccttacaagcaatagaaatttactttttaaaacaattgatttttgaggaaaaggagtcactttaggggaaatgctaaattttcatggtataaagctccagagaacagaatgtacactgtaacccaagacttattttgtacattctaagtgcccctgttagtctcttcgtgtgaacatatttggttggttgtagattgcagaagctctggtaatagcttttttgaatatactataaagggaaagttatgtattggagcttaaggttccggtttgtatacctgaactttcagaagatgcgagttcaaattgtagttctagactgcgactgtctgtataacaggtggatatgcatggtccctggtacctagtaggtgctccttaaatatttactgttaaccagcctgagccagcaaatgttgaacactggtccttggggcctttgagaaatttgatataaactataacattcagggcgttaacttttttttttttttgagacggagtctccctctgttgcctaggctggagtgcagtggcgcgatctcgtctcactgcaacctccacctctcgggttcacgccattctcctgcctcagcctcccaagtagctgggactacaggcgcccgccaccacgcctggctaattttttgtatttttagtagagacggggtttcaccgtgttagccaggatggtctcaatctcctgaccttgtgatccacccgccttggcctcccaaagtgctgggattataggcgtgaggccaccgtgcctggccagcattttctttattgatcgattggttatgaaagtaaagatgtattctcatcttctgtgagtgatttgatttacactgaccaacagagatacccttaggacatcagtttattgtaatgtagttggaaactttgagactttcttccaaaatgcaggattaggcaggcagaatttggataggcggaacttgtccagatgtctagaagaatttttgttcaggattttatctgtagtgcatttaattaaaaacaaaattagacacttgacttagggaacttgaaaagcagtaagtaaaaatcaaagtactaaacatatttgcttttaatttttaccaacttcattcttttttaagtaagatttttaaaatattcttgagcaagttaaatccacaaattcaaataggttgcagaaacatatgttcttgcttgagccatatcataacacacataggaaattaaaattatcttctatgctatttctataagcaaaatgtacccaaaacagtatacagttttctttttcctggataatgtctcctttgctgtagatgcaagtcatttttactttatcactatggaacttagtttaagttgagatctatctacttaccctgtgtctcctgacacatgatatattttctttcttatgggggtgtagtttaacatggtgattaatagcatgggtcctgaagtcagactgctttaaatcctaattcccatttactagttatagccttgggaaagttaatttctcttggcctcagttttcttatctttaaaatggagaaaatagagctactcctaggattgctgtgaggattaaatatggtaataatgtaaagcagaacacagcttggcacatagtactagctccatgaagattagctattcttattaagtcaaaatgaatgttacagattgtaggtattatggaaattataccaaattaagcagctagtgtgggccagattatttacagacacttcagtattgtaattcttcctttgataacctttggtttgaatttcatttagatgttcttggaaagggctgggcgtggtggctcctggctgtaatcccatcactttgggaggccgaggctggtggatcacctgaggtcaggagttcgagaccagcctggccaacatggcgaaaccccatctctactaaaagtacaaaaattagccgggcgtggtggtgtgcacctgtagtcccagctacttgggaggctgaggcaggagaatcgcttgaacccgggaggtggaggttgcagtgagcagagatgacgccactgcactctagcctgggtgacaaagtgagactctttgtctcaaaaaaaaaaaaaataaagtgttcttgggaagatcttggtatatcaaattagtgtttaattatgacattctattgaaaaaataccatgcaaagcttcccaaccaatgttccagtgcttaggatggcatataggtgtgctgtttacaaattttttatagcattgaaattttaaatcatttttataagttcaaacttttacaacagttgaaattacatttgaacatctttggtatgatttcctcttgtataattcatgaatttggtaatttggttatttactatttaaacaattagagatgggggtctcattatgttgcccaggctggtctcaaatgcttggcctcatgtgattctcccatctcagcctcccaaagtgctgggattaccagtgtgagccactgtgcctaccctaccatgaatttggtaatttgaaaaaattttatttggtataaatactaaatttataccaatttaatatttaatatcatttgtaatactttgtatttttttcatgccataatttcataataagaaattttgtgtgtgcgggttttgtttttgtttttttttgaccccagggcaagcaagaaaattttttttcaccaagctctttcagctcaccccaatgagccttacaaatatttttaatgtgtgccatcatgtgacaaaggttgggaagcactggtataatggataagagcactgcttttggattcacacaaaactgaatttaagttctacctccacttattagctctgagacccagagcaagtaacttaaccataagaataataatttttacatatgtaaagcagagatgatgtttcataatatgaaatgagataatgcatgtaaaatgcttcacattagtgcctagcaaataaaaaatagtaagtggtcacttctattgatgatgatgatcgtgagaattaccattttagctacttttttcagaggtttttcagacagctgttttattatttttcatattaatatactattttcaaagatcttcaaagaattttaatatccttttgtggtgaaaggaattaaatgttagtcctttttttttactcatcactgtactaatgaagatacttagttttgtaagttattgaattatctgctctctgtatttctgtttcttgatagtttcctttagcaggttctgagaaaacataaaaaaaaactttgttctttgggatttgctggtggtagtatggcaaaaagccagttgcatgcagagaactggaatcatctaatttacttaaactctatattatacagttaattatatttaaattgctgcatattattggctgaatatgcttattattgagaataagactgccctttggtaaacatgccattacattatatcctcctatgggattataccctttattatgtttgccatttgcttgggataaggttcatggccagttacatttcatgtgaggatgcatctgtgtttcggggaaaaaaagctttgtgttttataagcatgtatcattctttgtgtcttttatttaaatgcattagtcacttttttaacatttcaataggtttttggggaacaggttatgtttggttacgtgaataagtttagtggcaatttctgagattttggtgcacccatcacctgagcagtctacactgtacccaatgtatagtcctttatccctcaccaccttcccaccctttcccccgagtccccaaagtccgttgtatcattcttaggcctttgcatcctcatagcttagcatccacttacaagtgagaacgtacgatgtttggttttccattcctgagttacttcacttagagtaatcgtctccagttccatccaggttgctgcagatgccattatttcattcctttttatggctgagtagtgttccatgggtgtagaggggtgtgtgtgtgtgtgtgtgtgtatatcacattttctttatccactcgttgattgatgggcatttgggctggttccatatttttgccattgtgaattgtgctgctataaacatgcgtatgcaagtatcttttttgtataatggcttctttcctcagggtagatactcaggagtgagattggtgcatcaaatggtagatatacttttagttctttaaggaacctacacactgtttcccatagtggttgtactagtttacattcccaccaacagcgtgaaggtgttcccttttcatcacatccacaccaacatctattttttttttattatggccattattgcaggagtaaggtggtatcacattgtagttttgatttgtagttcctgataattagtgatgttgagcatgttttcgtaagtttgctggccatttgtatatcttgtgagaattgtctattcaagtccttagcccactttttgatgggattgtttttttcgtgctgatttgatttccttgtagattctggatattagtcctttgtcagatgtatagattgtgaagattttctcccactctgggttgtctgtactctgctgatttcttttgttgctcagaagctttttagtttagttgagtcccatttatttatttttatttttgtctttgcatttgcttttgggttcttggttgtgaagtctttgcctaagccaatggctagaagggtttttccaatgttatcttctagaatttttatggttttgggtcttagatttaagtcagtagccctatacaccaacagcaaccaagctgagaatcaaatcaagaactcaaccttttacagtagctgcaaacaaaaaacaaacaaacaaacaatacttaggaatatacttgaccaagaaggtgaaacacctctacaaggaaaactacaaaacacggctgacagaaatcatagatgatacaaacaaatggaaacacgtcccatgctcatggatgggtagaatcaatattgtgaaaatgaccatactgccaaaagcaaatctacaaattcaatgcaattcccattaaagtaccaccatcattcttcacagaactagaaaaaacaatcctaaaattcatgtggacccaaaaaagagcccgtatagccaaagcaagactaagcaaaaagaacaaacctagaggcattagattacctgacttcgaactatactgtaaggccataatcaccaaaacatcatggtactggtgtaaaaacaggcatatagactaatggaacagaatagagagcccagaaataaagccaaataacttccagtcaactaatcttcgacaaagaaacaaaaatgtgaagtggcgaaaggacaccctgttccacaaatggtgctgggataattgacaagccacatgtagaagcattaatcacttttgcagtctgaaaatacggcccttttcaggaattaaaataatgtaattttccctgactacgctattcctgtagtacactgatggccatagagtagggtgcttaatactagatttcacagggcatgtaaggttctaataagcgctgctactacgtttctttaaaaaataatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctgggttcaatgatttgcccacctcagcctcccaaaatgttgagattatagactgagattatagcctctaacttccattcttaaaagtcgctcatctgtaaccaggaaaaaacaatatagagagacagatggcaggaaaatcagtagctgtgcaaaaatggaatgttcaaaacgcggaagaaaaaactgaaacattgtgaagagtcttttggttccttttttagaggacaattttttacttggaatttttgaaaaatctgttttctctacttgagatggcttctctttctgcttttcccccagtgtattaatgaactatatcctgctacttacctcaagtcagtttatccagtatagaacttgccttcactcctcacccccaaatccacctgttgggaacttttctgtttcagtaccagcattctcaacttcatctaggctgaaaactgcagttgtttttaactcctctgttactctcatctcttacaaccagtcagttgcgaagtcctatgactcagtcattactagattccagatttttggactttaaggaccagaaaaatttttaaaaacttgtttttggtagactgacctaggattttaatattttatttttcttagtaaatacattttaaaaatctcagactactgtctgttatgattactatttagttctctttcctcccgagacagtctcactctgttgcccagactggagtgtagtggcatgatcttggatcactgcaacctctgcctcccaggttcgagcaattctcatgcctcagccttctgcgtagctgagagtacaggtgtgcaccaccgtgcccagctattttttgtatttttagtagagacggggtttcaccatgttggccaggctggtctcaaacttctggcctaaagtgatctacccgcctcgacctcccaaaggctgggattacaggtgtgagtcaccatgcctcgccattggtgaaactgttttgatgttctgaattggatatgatatgatcctctatttttgaaacctcatagtactttttatgccacttatagtctgccttatatatggttatttatatacttacctggtcctaaccatatggtcttttagggcaggaggactaagtatttctcatctttttgtctgttgcaggacttaatagaatgctaaagtgtttttgcccataaggaataggaacaccactcatacaagtcacaagtaaaagagaggtatattgaaaggacaaagtaggcaacttcataggtgttagacattcaagaataggtaagaaatgaaatacaggtaggttgtatgtacatggactgtgatacccaacccccaccctctcccctatttctcctagagcagaatggcctcccccgagtcttcaacttttgtttactctgacatcttctgtggctcacgcaccgcctgacccggtagttcaagtgcttcatgttatctgatgcaggctcccaggatcccattcccggttcctggtaaagagtatcagattggcccagccttgtcatctgccaaccacaatccagtcatgtatggttgggtatagcagagttgatggggtatcatgagttttataaggtgaccctttcaaggactggagtaggtcaaattctctattaaatgcatggccagagagttaatgtttaataaagagatgacagtgcctgacacctagtaggcactcactaaatataagttgaacataatggaatgacatgggagtattgaggaactaaacatatcactgctttactttctcattagttcatgagaacgtgcctgctcattctcaatattaccatcttgtatagttgggagagagaacttaaattcagatttaaaattaggccaggcatggtggctcatgcttgtaatcccagcactttgggaggctgaggtgggcagatcacctgaggtcaggagttccagaccagcctggccaacatggtgaagccccgtcttttctgaaaatacaaaaattagccaggcgtggtggcgcacacctgtaatcccagctacttgggaggctgaggcatgagaatcgcttgaacctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatcaccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaagaaaagaaaaagaaaaaatgtctagagcagtctgcactaaatttgttcacgttactgaagttcatttttaaaatttgttttctagccaataaaatatagtagactagcaataataaaacacatctctttgaactggtaactcacatcagaaataggagataccatgcaattaatacagggcaaagagaatgaaaactgagagattagtccttatcactgagcttcattttcctttctttttaccactgagggatttaaattgaacctcaggggtcctttgtctgtgaacttaatattattagccagatggaatattttagcaagttataaaggtaactatttttgtgttatgtctcttattcttgagtttgattgaagttagcttaacatcataaagctggttagaaagatagttaaaaactgaagttaaaaacctgaaaaacataaattcatgaagtacccctaatgtacatgttcaaaagaaaatacaaagaaatcactcagtatttgacttcccctccaattttaattgtcttttggtataattcttttttggtgtttagcaagttaaagttatctttaagcatttatcttgtccaggtgatcctgttaccggcttagtaatcagctgtatcatttctgtaattcaagctgtttgaactgaataacatagtgttaggatcactgtttaattgttctagttttgatagatacaatgctttatgtaagtgaaatatccgatttttcatgactttctgttaagttgtgacaaattcatgtatctgatgtgaactaagcaaagaagaaagatacctaaaagactaaatttgtttgacttatacctgaatagtggtctagtgatgttagaaacaagtttcaggaagagctagtcttcagatctgaacttcctttgatttccaagttagacttagatacctaaaagtttaagaaagattgttaaggattagctgagatgttactgtgtttgttgatccattactaattgctgttagggcttctttttgttgccaagtcatgttttcagatggataaatgtttttaatgttaatacaaaacatctgtttcttgaataatgttagtattttatatctcaaagaattcttattgcttaccttggaagtagatagtattctaagtcataataatgataattattattttgctgctcagtataataatctgaattttttctagctgtagtagctgttgagtcaggcttgccttgccgtgatcaaaacatgcactctatatattttaattgtactggctgggcaaagtcctgtaatcccaggactttgggaagttgaggccggaggactagcctgggcaagatggcaagaccttgtctctacaaaaaatttgacagagtgagatcctgtctcttaaaaaaaatcatttgagaaacagcaaaagtactctgtattcagtgctcttgtgatcctcctgtgtcagcctcctgagtggctgggactacaggcatgcaccactatgctaggctaatttaaatttttggtagacatgaggtctctctacagtgcccagggtagtctttaactcctgggctcaagtgatcctctcaactcagcctcccaaagtgttgggattacaggtgtgagccactgcatctgacctgattcactgctcttaaagagctgatgtgaaagtgagttttgcctaggatcttgtaagttattgaagggttgtttcaaagtgacatatctttaacagaacattttctcctgtatttcttgaagttagaacttgggaatcattaacttcaaaacagggcttcgtttgatataatgataaaactatgaccatgacttatgtaggtaatgtagtcctgaggtatgtgttaggatagtgcagtcttaattttggttcattccagggtattgaaaataatttgcttcttttcttcttctgcttctaagaagaaaagcatatttcttactctatttttgttattatgtttgtaattaaaatccacattcatgtccccagcaaaagttgaagtagttctttcaactttttctagactactcaatgtttaaaaactaaggttttaattttgggaaaattttagatttacagaaaagttgcagatagtacagagtccctatatactttacacctgtttttccttaatgttgatatcttacatagctatggtacctttgtaaaacactcagggattaatattggtgccttaatgttaactaaacttcacattttatttagatttcagcagttttcccactaattttctgctccaggatccaatccaggatacaccattgcatttagtcaaggctactttttattaagctttttggttttcattgttgcactgttcagtgggaggctcatttattaacttagtttctagcctggagatagaaatgagaaatatacagaattcttaagcagttcaagtagggaagatatgcaagtaaactatggtaataaaatgtgattacagaaggaatagccaattttgtaaggaggaagagagagagagacatatacgttagggaagccctcccagaggaggtgacatttgaaatgggctttgaaaattaaatagcaacttttttttttaagtttcttccttttagaatattttactaagcgagaagctgggatgaaagttagataggaactcttaaggcagaggctggagagaagcatatccagacaaagggaatagtaagcacaaagactcagaacatgagtgagcaaatagatttgattgaaatgaagggttggtacaggaagagtgtagaaggtgagcctgaaaaggtatgcagaggatttggagagtgtttatgtgaagttttttggtagctgtattttaagctgtattatgtatgtatgtgtatatatgaatatatgtgtgtatatatacatacacaagatatgtatgcacacgtatggagtaggttctgcatctggatttaaccaatggcagatcaaaaatactgggaaaaattaaatgacaaaaataatacaaaaaaagtataactatttacatagcatttacattttattaggtattataagtaatctagagaggatttaaactgtacagcagaatgtgtgtaggttatatgaaaatactacaccattttatgtaagggacttgagcattggtggattttggtatcctagggggggtcctggaaccagtcccctgcggataccaaggtatgtgtgtgtgtataaaatttaggggaactcatccagagactgcattgttctccttcttattacctgcctttttgttttttttgccattccaccactaattcatgctgtaacaaaaggttaagtagaagtaaatacatatgtgaaatccatactgttttgggttttggctgaacagctttggtgagcatttattatagtaaaggaaattgaaattgtaggcatccttatctggcaactcagtttgtagtgtttgctgttggtgaattttaaaagtgtagtttgatttacattggattaaatacacctgtagaaacgtgccctatgctgctatcgatgttagagggccctaggtagggaggaatatgatttcaacattttaaatcccaaaattttacaattttgggatataggtgctttgataaatgatttagcattgcaattaactttggaggacatctgcagtataatgaatcattatttttatgggttaaaatgaaatatttggattatttgtgggttacagttgcttgtgtcagttctgttcccttttactctaaataaatatagttttcagtcatgtcatatataaatactacgtaatttaatgttagcatcaaaatggctttttgctgccctgctttcaaataaggagaaggaaacttaccaaagtccaaaattagaacactgagactgggcacagtggctcatgcctgtaatctcagcaccttgggatcacttgagctcaggagttcgagactagcctgggcaacgtggtgaaactccgtctctactaaaaatataaaaattagccggtgtggtgatgtgcacctgtggtcccagttactccagaggctgagggggaaggatcgcttgagccctggggcggggcagaggttgcagtgagctgagatcatgccactgcactccagcctgggtgacagagcaagacactgtctcagaagacaaacaaacaaacaaaaaacgttgaggcagccagaggatgatccctgtccttgctcacaaatgactgctcccttaagcaatcaaaggcaaggaaggaactctacgtacttctccccctttaaatgataacattttgaggagagctgcttagctgagtgagctgccttttttttaaaaaaaactcaagccaacccttccttagatgatttatgaatgtaaaatgcttgttaactttctgctttatggtttatgatgcttgtaaaatgataggattattgtccatgtatgtaattggtgaaggatatgaaactcagaacaaaccatatagtgccatgtaagttatggacatattttagttgttagggcttttaaaaaacatctccccctctgtcattacatgttttaccctctggaaatgtttaatgaaacagtaactgatattgggagggacacacaggttgcttcaaagataaatggtaatgtttaattttttatgctggacaataggtacacagattttttgttacacatatgctataagtattcccttttatgtatccaatatttatttaataaaaaacaacctaaagttttaaaggcaaaaaaggtaattctcatgtccttaaagcctattccattcagtttttgtgtgtttttttttttttttggtggcaaggaaaagaaaactcattcaaactaggaccaaaagttggtgggttgataggttattgttagaatatagaaaggtgtttgtgggaatacaggaagagctggagaatcaggccgcaagaactgatgcagctctgagactggccagactgttttctcttttttgtctgtttctgcctcttgctggcttcactatttctgcctttattttatttatttattttttttgctttcttacctttgcttgttcccgtctctttctctgtttccttggtcccatccgtttgtttttttttgttttttaaactgggtcaacaacctttgttgtaaaacaaaggtgcccttcccccattcattctgttttctcacttacttgatgtctctttttttgtgagctctctcctttaagtcactgcatatttttctgttctcttctctccagaccaaccttcctctgaatcttttcctttgtgaccttgttgtgcatgaagctctataatggtagcctaggtttttttccacatgtatctcctagtgcagattcctcagataatccagttggtcctgctcatcttttagagctaggtcacataggccaccaacagcctgtgactaggtgactcctgtgttaggtatttaccctcgattcggtcacaggaaaggttgtggcctagatcgtgtgggccatttcccactgaggtagcgaagtagggatttttatagaagagattatgggcaggcagatgttctgaaattctaatatgtcaattaagttttatcagaattttcttatgtgccctttaagcctttttggtaatcggtatgtgattgcttcctagaagaatctttttcaaagaaaaaccattagctctcttccagttacaactcactgccttcttttatccttaagatattcattcatagccaggcgcggtggctcacgcttgtaatcctagcactttgggaggccgaggctggtggatcatgaggtcaagagttcaagaccagcctggccaagatggtgaaaccccgtctctactaaaactacaaaaaaaatcgacctggcgtggtggcaggcacctgtaatcccagctacttgggaggctgagacagagaatcacttgaacccgggcagcagaagttgcagtgagctgagattgtgccactgggtgacagagtgagactccgtctcaaaaaaaaaaaaaaaagataattcattcataatctcactgaacaaataataaatgagtgctcactatgttttatatacccttctaggtgttagggatagaatgagatgatgagtgcaggggagataggacaagggtttgagagtaaggttagaagggagtgaggctagtgagtgagtccaaatttattgtcagtatagtcatgggatgagagttgaagggccaagagtgggtgtgaggctgaataaagatagcataggaatggaaatcttccgtttctgttaactacctacgttgaagattccatccattgcatctggcattgtgattaatgttattaagcaaccactgaatattatagaaactcaagccattcatttcacagatagtcattaagtgcctaatctgtcctagattttgctctagattggcggggggtgcacaaaaagaaatagcaattttgtgctttcaaggattgggctttgagcttagggctagtggagtcctaaacaggcacaaacccgaataattacaataatttgaccaagtactaatgtaacagtgtatgacattaccctgtaaagccaggttgagcctggtcagggtgcccctgagggagaattacatagatatggaagggttttcaggttgtggcagaaagggtttcattactattttaatcaaaatcaagaaaaccagttagcagcttatgagaagcaaggagattaggagctaggaatatagtcaaataatttttttacagtagccagagctggctagagataaaatgaagtgaggtggctgggaaggacagtttgggggctagttttggaaattaacctcttgaactgatggtcaaagggaataatctatgccagccaccagggtggaagtgataactgttcagaaagaatgaggagggcttcagcaaggagttgaagtctgagttgaataggggttttacggatgcttatagcatatgtagaggcttgtcatgtttagagggatagtgggctggctgaaaaactattttgagattgtaggctaaggaaacttagtaatttcacaagaaaaatagatctgtaacttctcccaccagaccgtaaagtccataaacttatttgtatttgaagtcaccatattcagcattttcaggcatgtaggagacatgtttgttgaaaaaaaatttttttatttgctcagtgatgtttttcctatctgttattcttctagccttttcttttattgaactaagaagcaactggttttttaattaagtatagtaccttgaaaagccgtttgaatgaaatgtcattcttttttgtttgttcgagatggagtttgctcttgttgcccaggccggagtgcaatggcgcggtctttgctcactgcaacctccacctcctggattcaagcgattctcctgcctcagcctcctgaatagctgggattacaggtgcccgccaccatacctggctaattttttgtatttttagtagagatgaggtttcactatgttggccaggctggtctcgaactcctgacctcaggtgatccacccgcctcggcctcccaaggtgctgggattacaggcatgagccaccgcacctggcctgaaatgtcatttataaccttactctgaatttttagagttacatacttatacctgttactaaaaggaatcaaccgggagcagtaggtactcctattggaaatagaatggacttactcctatgatctttagttgtagatactcacaattcttttttctttcctgttgtaaatgaaaggtgagaataagttagcaaaaaaatcaattttatttgctgatcaagctttcagcctgccatgagggaggggctgtctgtgcctattctagtcatatgttcctatatgtctgataatgggggcccgtagaagagagagtcttggtctagcactgactaaaaggttatctaaaaatagtgccatactgggacttggctgtccagacctctggaagagggactatactctaattataatcctgttattaaaaattttaagatttctatatagaaaccagtatttaaaaggaagaggagatgtttcaggtacccctggaataactgctatctcaggtggtagtggtgcagagagacctgtgaggaaggttcaaggaaaagctatagaggtataaatggttgaaaaggagaggcgatagtagacaggaatatctggggctgaaaatacatttaaggaagagaatatttttgttcttcaggatagggtgaagaaaacgactaatgctctgatatattatagtttgctgtaacttttaggttataagttgcagtttaagtgtgtgaattcagattctatctaggattttattattatgaaaccactgctaaatagttacaccatttttactggaattttgaaccaacatcagtatccaagttgttattactaaataaaactttgcgaggccttaacgttacttggtgatattctcaacattggaaatggcattcataaataatagctagctaacatttatggaacatttactatgtgccaggcactgttttaagcattttttattgacccccattcagatgaggaaattcattgtgcttgaaggcacagaaatagaaattcacatagtatactcatgtactttctttggactggctttagtcaaatgaaagagaaaaaagagaaggactcaggggatagtgtttttttttttttttgagaattagccatctgtcagggttaatttttaaaatcagtctgtatgtgagctgaatgagtttgctcatatgtgataatggtttatttgttttagcagttccaaattccaatcacttggggccttgtttaaaaattatcttgcaaagaaattatcaccatctctcactttgcatacccataatgtaatatatgttattgaggggtggagagcatatgctctggtacctgctcagagatctttttaaaaatacaattaagaacatgtgtctgggtgcagtggctcgcccctgtaataccagcactttgggaggtgaggcgggaggattgcttgatctcaggagtttgagcccagcctgggcaacatagtgagacttcatctctactaaaaataaaaaaaaattagccaggcatggtggtgtgcccctgtagtcccagctactcccagctactcaggaggctgagggaggaggattgcttgagcctgggagattgagactacagtgagctgtgattacgccactacgctccagcctgggtgacagagcaagactctgtctcaaaacaaaaaacaaacaaacaaaaccccatgtttaggtaaatacagtgattctacattagagtacatattggtgaattttttttttggtctaacagtgttgatgattatgtatccaaactgtagataaacacagatgattttctttttctttttgccagaacaaggtcttgctctgtgcccaggtttgagtgcagtagcacagttgtaactcactgcaaccttgaactcctgggctcaagagattttcccaagtagctgggattacaggtgtgtgctaccaggcccagctaattttttgtgttattcttgttgtttgtttttttttggtagagatgaggtttgcctatgttgcctaggctggtcttgaactcatggcctcaagtgatcctcctgccttggcctcccagagtgatgggattataggtgtgaaccaaccattccctgtccccagatagttttctaaattaatcctctccctttattctctgcagattgccttgcctcttttattgagaatgaaactaacatggcttccttcctccttttattctcaaaaatctccgtgacttcacctctcatccttttctcctacttatataggatatcctttaaaggataaagcttctgtgttgaacggatcctattgcctcctgtttctgggacctttccaactttttctcccctgtgtatcctaaccccctgcatagttccatcccttctgcatacagagtcctcttcagttcctcccttttgaagccatagctgctgtctttgcagtatcctttgcatcttcccattctttgtatttcaactattacttccctggtgtattgaagatgggcaactgaatctctccttaaacttgtgatacatttttgaaaaaagatagataaaagatgcagataaaattaggaagttctgaacaccacatgtgttgtggagtagggagatggaacataggaagcagcttggggaaaacgcaacaatgagatgttatgaaaagggagcttactgctagaacaatggagcacagagagttgaggtaaaagtgaagagcccagacctaataagaaagggttatagaaagtgtttcaataatttggagaattattagataaactgatggttttaaaaatagtgcccctgagatggaactggaagctcaggagaagatattagtgtgataataaagggaaaggcaaactgacattttctcagggagccttggaaaaatgtgagagaggtagggcaacagagggttttttgtttttttttttaatcagcgcatccatagggtaggattaatgagataggtagaaattgattctgagattaatggatttattatttcattcaagataatctcacatgaatgatggaaatgtggttttcaatatataaaagaatggtacacattaattcattaatctcaacttttcttaatttagtagctcttgttactatggataatctgggaattctgtcttttaagcaatttaaaatataactggtatgcatttgtattttcttcccagagtagaatcattggattttttagatatgaatgagaggattcacctttttataacagcatcctaagaaagtcactatgtgctatttgagtattaactatttagtactacccctgattatcgattatgtaataagacaagatcatatataaatgtaccttttgattctgtaagaatgtagttgtctagaatttttatatttggattttaattaacttttggttagtaaagttgagaaatatttagtaaagaatcatggttactaaatattattcattgtttagtaatatttatttgagtagataatttatgtcatgaccagtttaaggccctgggaatgcagggatgaataagccttcatggagcttatattttagtggggaagataagaaatgagctaatctgtcatgtgaagaagtggtaagtgctatgaaaaaatataacacagaataaggggagagactgtgacggggtgggagctatttagatagattagtcagaaaaggctgttcctgtgaggaagaaaatcttgcaaaacttatttcaggtaacagtaaacgcaaagacaggaaagacagagtcaggacctaactcagtaagaaccggtttggtatgttggaggaaaagcaagaatgctggtctgacaagagctgtgaggacaaagtggagagtaacaagagatgagggtgaagaggtaggcaggggccagagcatattgcaccataatgcccatggattttgagtataattgaagatcgtgtgacaagatctaatttacattttacaaagtttattccacctactgactggcaaactggctttagaaaaggcaaggtctgaagcactgaactatttaggaagcttttgcagtgatctaggcctatggtttccaatgttcaggaacaaactgttaaaactattatattaactatttatattgctttatttaaaaaaattaagctttactaatatttaatatacagattggcactggcatccttgtcttatctgcacgttagtcacatgtcatttaacatttttggcttgagcaactggtgaatgttggtgccatttactggaatgagaagactgagggaggagcagggtttgttttgaggtgagagtgagttggggaatcagtatctcagttttgagcattttaggtttgtgaaatctaaatacctactagaaatctaatatcaggtagatggtttagatatatgaatctggagccaaggttagaagccaagattagagatctaaatttggaaatcattagtatagagacagtatacaccagctttggagccaaactgtgaatgcaaatttcagttctgccacttactaactgtgtaattataggcaagttacttgacatctgtctgcatcatttatctcatctgtaaaatgggggtaataatgtctacctcatagggttattgtgaggattaaattagttattacaaacaaagtgattagaacagtgtggccgagggtactcactagatgttaactgttaggatcagtttttgaatagtgtttaagccatgagattagggccgggtgcgattgctcacttctgtaatcccagcattttgggaggccgaggcaggtggatcgcttgagcccaggagttcgagagcagcctggcaaacatggtgaaaccccgtctctactaaaaatacaaaaattagccaggtgtggtggcgtgtgcctgtagtcccagctactcaggaggctgaggcaggagaatcacttgaacctgggaggcagatgttgcagtgagccaagattgcgccactgcactccagcctgggtgacagagcaagagtctgtctccaaaaaataaagaccatgagattagataacttagagaatgagtttagatagggaaaagggccaaggagggacccctgaagcaatataacctttagaattcagaaactgggttgggtgcggtggctttcgcctgtaatactagcactttaggaggctgaggcgggcagatcacctgaggtcaggagtttgtgaccagcctggctaatatggtgaaaaaccctgtctctactaaaaatacaaaaatcagctgggtgttgtggcaggcgcctgtaatctcagctactcaggaggctgaggcaggagaattgcttgaacctgggaggcggaggttgcggtgagccgagattgtaccattgcactccagcctgggctacagagcgggactccatctcaaataataataataataataattcagaaactggagagaggagattgaggagtgaagtaggaatcaaacctgaagggtatgttggctagaagcctgcctagtgaagaaaatatttcaacttagacaaattctgcttgagaggctaagatgagcaccaagaattgaccaactgggtttgtcaagatggaagtttttggagaccttgagaagtagttttattagagtggtggggatgaaagcctgattagcatagctgaaggacagaattggatgtacgaaattggaggcactgagtatagatggcacattagaggagttttgctgcaaagagggatagagaaaatggtgtggtagctagaagaaaatgtgtggggtcaaggaaagttaggggtgtgtatgtgtgttgatttaaagatggaaaatagtatagtaagtttgcatgctgatgagaatgacccagtggaaagaaaaaactgatcatatttgagatgtggaaaatatcatgggaaattgcagcagccatgaccttgagtaggtaaaatgaaggtgcataaggggagaagttgattttaaaacattggcagagacttttcatccattgatgaaggtagagaatattaatggaggtacagatagactggtagatgtcgttgtgggaaaatgtagttttttctgattgctttaatttttatggaaaagtagggtaggatcatcagttgagagtcagaattgggagggggtttataaaatttgagagagaggaggtggtgtgatataggcatcttggaagataggaaaatgagttgactagggaagatctagcaggtggatttgtcaaggaggtcagaaggctagcttgacatttgtggtcatttgtttaaagtgattccagctggctaaggagggcagggtggtcttgagatgacatatggtgagaaattgataggaacaatgccttttctgcttctatttgaaacatctttagtcctgtgactggtagtattgctctcagaacatttctgtggtataggcaggcagcaacagaggaattaataaaaatgaatagaccaaaaaataatgatttcatttttgcccatgttcagtgtttatatcatgttttatgtagtgaatgagttcctccaaaagtttatgttgccatctgtccttggatatgcctattttacacaaatgataccaagcaagccctaggacactttcaataaattatacttggttgctgagttatgtaaagaaagcaaaatgctgtagtggagaagctccatacattttcttgatagacatgaaagcctcaccaaaattttccctaggacccgtggttttcatcaatctagagttatcattcatgttgatattatacttttatgttgattaccgagaaattcaaagtctggttttcttttcttacaggtgctggagaatctggtaaaagcaccattgtgaaacagatgaagtaagttggaatgtagcgttttgttagactaggatttctcctaatgcatataaagtccatagtatcttttcattttaggtccatggtattgacttgtggttttctttgttttaaagaatcattcatgaggatggctattcagaggatgaatgtaaacaatataaagtagttgtctacagcaatactatacagtccatcattgcaatcataagagccatgggacggctaaagattgactttggggaagctgccagggcagtaagtgtttctcatttcctcttcacttgctcttattcagcagatacagttaagttaagcaaaatttttgcttcatgttttagggaaatgaatttaagcaacaagataaaatgtagcaaagtactttgtgctcacttgagaaatgttagcaatctactttagcaggtgttagatataaccaccccaagaggagcctaggaaatgggattctgtgggtgcacggtaggtttctgggataactgttctattcaattgctttttttttttttttaacagcactgttgacttttatagtagtagataatagtacattaaaataatctaagagaaaggttgccatgatatgtagctctgctttctgaggtgtacagattaaaggccaaaatcagtctcccagaataaattctgtaaggacatgagcactaagtccaaattcttgaatatctaagtcagatattcaagaatactgtatactacatggaacctaaggctatagaattggagtataacatgccctagtataattctttaatgccttgcacatgtcagctatttaaaaagttgtattattataataatacttagtggaccctgaagatctagtttataaaattagagcatgtgtaattaggatgttttatgccattggggagggtgccaatatgaaggcaggagatctttgatattattatcagctaaaatccagagaaggctgggaaattatagaattatttcctacatctaagggactcactggctgtgttcagagtgtcatacttatgtgccatggcgaaataaaaggaaatgatttgggaggtctgcctggaaaggcaaaacctatatgtctatgaagttgcttaggaactctcataagccactcccaacttatcaaatgcgaatttatatttgataaaaagataggaaattgttgaggggaaatactgaaagggtagtcacagttggatagtgttagactagaaagtgtcttagaaatggcataaaggaagaggagctggattagggattgtgaaatgagagacttgtatcaaaaaataagaaaatatgtgaatgtgacttttatatttttgtgaaatatatcacagagactatttttctatgcatctgagcagggaagtttggcagtcaagcaaaaataaagcctttatccttgtcttaccctttcctattccttctctcaccccctgcttttgtttccttcttttcctctttttcttctttataccagctctatctgtggtcttattttttcttcctcccttttctcatttctccctatcacctaactctacttctctgttgtatttgttgtatctggtaactggtcagtagtactgtatttattctcttccttctctctgttggttttttctctgtctcagttatttattcttttagtttgtcccttttctctttccctctttaattttattccccgccgtctgtcttcctttatttatctccctaccctttcattcctttttttttttttttttttttttttggagacggactctcgccctgtcgcccaggctggaatgcaatggctggctgcagcctctgcctcccaggttcaagcgattctcctgtctcagcctcctgagtatctgagattacaggcgcgcacctccacgcccagctaatttttgtatttttagtagagatggagtttcaccatgttggccaggctggtctcgaactcctgaccttgtgatccgcccgcctcggcctcccaaagtgctgggattataggcgtgagccaccgctcccggccccatttctttccattatcaaatcaattgtcattaatctttgtatcctaatactcttgtgtcaccagatgcagttgacatcattagtccctctcaggcctcctaaatcatccagctttctggtgtccacacaacctagtctgtaatcctatattataatttttaaacattgctttttatttttccttctgtgtgtaaggttttatgtttatagctcctctcttattgtcttctagtatttttgtttgtttgttttttgaggcggagttttgctcttgtcacccaggctggagtgtaacggtacgattttggctcactgcaacctctgcctcctggattcaagtgattctcctacctcagcctcccaaggagctgggattacaggcgcctgccaccacggctgactaatttttgtatttttagtagagatggggtttcgtcatgttggccaggttggtcttgaattcctgacctcaggtgatccacttgccttggcctccccaagtgctgggattacaggtgtgagccactgtgcccggcttctactctagttttttatagttggttagagagtgtgaatggaaaaaaaatagagctgagtgtggaataggttcctttttcacatctgcttaagtgtggaggtgtgaagtttattgtaaagaggggcctcttctgtttttttttttgttgttgttttttgttttttttgagacagagtttcactcttgttgcccaggctggagtgcaatggtgtgaccttggctcaccgcaacctctgcctcctgggttcaagcgattctcctgcctcagcctcccgagtagctgggattataggcatgcaccaccatgcccgcctaatttttttgtatttttagtagagacgggggtttctccatgttggtcaggttggtctggaactcctgacttcaggtgatccatctgccttggctgcccaaagtattgggattacaggcgtgagccaccatgcccagccaagaggcacctctttatagacctttagagagggtttattgtggggaagcaagagcaggtcagtggaagaaattaagtgataagaaaaaagtgtttgctcctaaaagaatatttaaagagtcaggacagcaaaaaaagtagtaataattccctctcttttgaagtttctaaaattagagtcatggtttttttctgttttttttttttttaaagtagtgcttaataaggttatttgaatacgtgcatgggtataggtcaaatttcagaaccaggggattatgaagacttcacatgttagataaagcaccataccttgcatatgtacaaggacatgctcactgctgagtatgtttgccaatttgtctaatatttcaacttttctcattcatttgtttaaaattttatctttgaaaagaaagggaggggcatatagatcttagctaaggtgttttttttgttttttttttttttttgagatggagttttgctctgtcgcccaggctagagtgcaatggcaccatctcagctcactgcaacctccgcctcctgggttcaagcaattctcctgcctcaaactcccgagtagctgggactacaggcacacgccaccatgcccagctaatttttgtatttttagtggagatggggtttcaccatgttggccaggatggtctcaatctcttgaccttgtgatccacccgccttggcctcccaaaatgctgggattacaagtgtgagccaccatgcccgaccagctaaggtgtcttagagttgagcctagtctaccgccatgccaccctgaatgcgcctgatctcagaagctaaatgagagtgggttgagcctaaatattactagaaagaatacaggaaaggatcataaaggaggaaatattactaggtaaaaaccattagagctggagacccagagtttggcaaaaataatttgagtgcaccatggatggttttgttttgctaaggtggatgcacaagttctggtaattcacaagtctttggagttttaggttgtgagttcacctgtggtctgaaatgacttttgcttgttagtttatttgtcttgatgactacttaagatacaaatgattgctcccctttctcctttactttttctttacacgttatatactttttaaattttttatttttatagttatttggaatctctcaaggtagataaatattagatgtggatgggaaaatcatcccgtgagacctgtgtttaattttaaaccaacaagtagggatggatagaataaaggaaaacaataaaaatctcataatccatttctgtcctctccctcacatattttatgtttaaaaactataaccacctagaaaactatggctatgtctgggcccagtggctcacgcctgtaatcccagcactttgggaggctgaggcgagtggatcacctgaggtcaggtgttcgagaccagcctggccaacatggcgaaacccctctctactaaaaatagaaaaattagctgggcatggtggcagatgcctgtaatcccagctacttgggaggctgaggcaggagaatcgctagaacccaggaggcggaggttacaaggagccgagatcacatcattgcactccagcctgagtgacaagagcgaaactccgtctcaaaaaaaaaaaaaaaaaaaaagaaaagaaataaagaaaaccatggctatgactcatgaagttatggttactttcttttcctcctgctcccttcctttccctctctcagaacattattattattccttattcctttagggaaatctagggactgtttgaatctttccctgagggatttatttcccccattaggcttctagaccttaagtgcctccatctcctcttcttgttctactgtctgggctgaaggcaaagaagagaatacttttttcttaaacttgattaatgttttactccctttgaggtgtttagactttacctcttatgtgctagtctttttatttctatttttagtgtaggcttcctttaatagaacgggaatgttttacataatcctgtctcataaaccagtttttttctctcaaaaattattagcaatctggatggagatttgtgggctggccagaaatgatcttttctggggatggtggtgtgtggaggagtggtggggaagtaaaatcattcctcagctcagttctggacttaaaactgtagtgaaatgagaataaggaaagacttaattataaattctgtcatgctggcctgtcagaaaaggtctctgtaacaacacctcttttaacataacatgtaatgtgtctatattttaaagagactgtcatcaagtcttaaagaaatggagagtcatctgtctctttcttaactgctttcttcaggatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatagtaagtaatttttctctgtgaaactataacagagaataacttggtgacactacagaaattttagtccccacttaaggaaatgtttaagtaatagacactcttagacgtttataggatactttataaaaattgtctaagtttaggattatagagcccttggtcatttgtatgatttggagaaaaaagttccctcttggaatgtaaatgggagacttggcaccacaaaattagttccatggcattttattataagcaagtgaaggaggagagacatctgttgtggctgggttctgaatctgttccaactcataagttccctctgtgtaagggcttggcactgatagccagctagagagggaaattagaatagtggtattcctttttatgcagccagctctctgtgtctgggccgcactatggacttcactagtaacccttttgccagatcacagtagtagactttgtatagaaagagaaggttgagtcatggaatgaagttgaagtatctttttgtcaaggatattatcttgagtgttaatatagttttagagaatttgtaatgaatacttatattaagctattacatgttatcctattttacctcttttacatatacttatttatgaaacctagattcagaatgtattttttttgttttgagacggagtctcgctctgtcgcccagactggagtgcagtggctccatctccgctcactgcaagctccacctcccaggttcacaccattctcctgcctcagcctcccaagtaactgggactacaggcgcccgccaccatgcccggctaatttgtatttttagtagagacggggtttcaacgtgttagccaggatggtctcgatctcctgacctcgtgatccacccacctctgcctcccaaagtgctgggattacaggcgtgagccaccgtgcctggtccggaatgtatttttttttaatgtacttttgcggggcctggtgagcacttgttatctgtatttctctctgtactggatgagggcacgtttaagcattaaagttttttctccaatattactgttttcctacttttcacgtcatgattctagcttaaattgttacaagaagaaattaaatgatatagtcaggctgtgcataaggacagggatactttctgaaaaatgcatcattaggtgatttgtcattgtgtgaacattgtagagtatgcgtacacagaattagatggtatagcctactacacacctaagctatatggtatagcctgttgctcctaggctatgaacctgtacagcatgttattgtactaaatactgtaggcaattgtaacataatggtaagtatttgtgtatctcaacatctctaaacatataaaagggtaatgcaatggctatgatgtcactggggctaggagtgtttcagctccattataatcttacaggatcactagcatacatttatacagtctgttgttgaccaaaacattgttatgcagcacatgactgtatttgaaaacttgcttattctttcaatgagaacttggctttagaaacgtttcaggattcttgcctaccttttaataacatcttagttgcaagtattgatagcttaaataattctaccagtggtcatcaaaggtagattataattgctttttttcatctttcattcagaaagctctgaatcctctaactacatgtgcttatagagattttcataactgttgatctaagcttgcctctttacattagtgatagtatttggttttatagatcattaatgattcacttacattggtgccatctgctcatcagttttctagcctggaatcagcaaagaatacagttttgaagcagtcttttaattatttccctgaacaaattaatttttttggaggtatttacaatttgtttttgatttagattaaaaaaaaaaaccccagacctccccagctcttctgtttactgaaagaaaacggaaaatattcttactcactatagttctctcaattttagttaatcaaacaccattctctaatgtcctgtcaaatggttaaacacgcatgacctattgagtttaattgtctgaggacttttggtatagtttggttttgatattatacagtacacagttgatttagtattacatttcaggaatttttctttaataagaacatttcctgttcctattgttttaattttttaaattggccttcacaatttaattctgtagaattaaacctacttttgtgtccgggcgcggttgctcacgcctgtaatcccagcactttgggaggccgagacagacgaatcacctgaggtcaggagtttgagaccagcctggccaacatggtgaaaccccatctctactaaaaatacaaaaaattagctgggcgtagtggcgggcacctgtaatcccagctgttcaggaggctgaggcaggagaatcatttgaacccaggaggcggaagttgcagtgagccgagttcgcaccactgcactgcagcctgggtgacagagtaagactctgtctcaaaaaaacaaaacaaaacaaaacaaaacaaaaaaacctacttttgttaatatatatagactctatactttaattgtcctatgttggattcatattttttcttattatttctttctttttttaagagacgggggtctcactctgtcactcaggctggtgtacagtggcactctgcagccttgacctcttgggttcaagtgatcctcctgcttcactcaagggtaggaggattagctaggactacaggcatgcaccaccatgcttagctaatttttaaaatattttgtaaagacgggtttctttatgttgcccaggctggtcttgaactcctggcctcaagcgaccttcctgccttggcctcccagagtgttgggattacaggtgtgagccaccatgcctggcttatcatttctatgatactgaagatctgattctgttttgccacttaataactagtaacaggtttaaaataggaactaatttagtctgttcatttgctatgcacatggttggcttcaccaagtaaaagtaaacgtgtcttttatttagttatctaaatgatctggatagaatatcccagtctaactacattccaactcagcaagatgttcttcggacgagagtgaagaccacaggcattgtagaaacacatttcaccttcaaagacctatacttcaagtaagtcattagcctttttgctaggtgtgccaaatacaagtatctttcattttagtttaccatctcttaatcagggtaaaatttctctgggcagtattccttggtttaaacttaacatatttatcagcattgtttgaatattttaactgaatgggggcccaaacatctcttgtttctccaaatagcgtcaaatgtttgtgtccttttagaggaatttaaattcaaaaataaatttaacttgcctcccagtaaaatttttcctgtgataactggtttgttttaattttattattttcagctgcttttttgttagactcaccaattcagatattgaatgtttaataggataacaatattaaacttatgaaaaccagttttttttcggttagttacatggttttgttttgccattttgatttaaaatagaaatgcttttctcaccagtgtcacttcttattggtttgaatttcccttcaagttgaatggaatggagcaagtattgtcatggctcttaaagtaatttgtgcatagtgtcatgtacaattaacttcttaatacagtgcagaatggaaaatagacttggggatagaggtattttgggttggtaagatgacatataaacagtgatttttttggtttgtttttaaatttttatttttttagagacagggtcgtactctgtcgtccaagctagagtggagtagtgtgatcacagcccactgcaaccttgacctcctgggctcaagtgatccttctgcctcagccttccaagtagctgggactataggctcatgccactgtgcctggctaatgttttaaaaaaattttatgtagagacaggatctctctttattgcccaggctggtctcaaactcctgggctcaggctattctcccacctcagcctctcaaagtgctgggattgcaggtgtgagccaccgtgcccagcccaactgtgattgttttagagagagaaaattctagtattctaatacaaataactttctcattagcattagtaattcttttttttttgagatggagtcttgctctgttgccaggctggagtgcagtggtgcgatctcggctcgttgcaacctctgccttccgggttcaagtgattctcctgcctcagcctcctgagtagctgggagtacaggtgcgttgcaccacgcccggctaatttttttttttttttttgtacttttagtagagatgggcttttaccgtgttagccaggatggtctctatctcctgacctggtgatccgcccaccttggcctcccaaagtgctgggattacaggtgtgagccaccacacccagcaacattagtaattctaaaacaagcctcagcttgtctctgtgttaatggtcttttataaatattagaaatgtttattttggttcccattttcttcttttgtgacctttgagattaggagtaaacttttccccttcaatataccatgtgttctttagttatggcattatgcttatatgtagaatgtgatgtttgttattattgcatacagatgtaactactacctcaaatcctctcagttctttctctgaaaacaactgttccacaggatttgtgaaatccacatagggtttacgtattactagataccagttggggtcttgaaatcctaatacaccaaactagattttttcctggtgcaggaaaatagcagttcagctatgaatgcttttagaatagacttgctgcttatctttagtactgatgaatttatttagcaagagcagcaaagaccacatggattatcactcgtgagaccataagaatgagatttctttgtataaggtttgtaatctacttataattaaaagttgtgatcattatttagtgttggaaactttcttattggtgttgttatataaatcagtctttagttaggcaaatcctaactgtcctgtctttttatgccatgatcaatagccagatctaattaaggtgccacacctacttgattgttggcatgtagatatcttgttatgaagtactatcatttcttccttttcctcttctctctaggcaaaactactatccatttattcaaacatttattgagcatctaccatatgcaaggcattgtgtaattgcttacttgcctctcagttaatgaggtaatgtttataaaatgttgatctcttagtgaatgatattgtaaatgttaatatgtgctaaaagcccaccttggaacttcacagtgttatacagactttgtagaagaaaatgggggagtaaattgaagttactggtgtgtctccccttgagacctccatggtgaaatatatgatgttagccttcctaaaacctgtattgtgaccctatattaaagccaacttgtgattacatcatttcaggtgtcatgaccaaaggtcaaaaagaatcgtgcaagatcaacccaaaggaagagttgggtcataaagagataattcctttcaagcatacattgagaaatcaccaactgtgtcttatttctttcaatttctgggggaaaacatctctggaaatgtaggcctctagtcactatagatcttatacattaaaccagtttggcagagtttagcctttaaaaattgtgtcattttcttcaaacaccgatcacaagtaacaatttgcatgtgtacatcattagacctaagtatcagctaaaacacaaagcagtgcagatctttttactataggaggtagttgaggatgctgttgatagaagttcagcagttgactcagaataccaagtaagtcacccagaagacagtattggactaaaactaatatggagtgtaacataaagtttgtgaacagttgagactttattaattaggtttaagtaagactcggagtttggaaatattggtcaaggctgttttttagttattgggttcatagaatcctaccataaaaatataatttatttgtttttacaattaatctctaattttttttttaaggtaaggaaaacaaacttaatagggagaagttatggaagcagagtgcaaatagggcatttagaggcaaaccattttgagagtcagaacatgggtgctggagttagagtgcctaggttcagatccccagtccctgtttgttagtagtgtacctttgagcaaatcatttaacattgaatgtgcctcaatttctttatctgtataattgggataataataatagtacttctaggagtgttacaagggcaaaatgagttaagatgtttagtagtagtgtctggcaccatggtaagcactcaataaatataccattattattattatctcaaactgtattatttagctctttgcttttcctgtcttttcccctccttcctttaatccatttcagtgcttattctgctgacttttcacacatctggtacaagctttgatagagaagaggctcagctatctaaaatgagaatctagattattcacaagttttattttctcatgttgttgtcttgtacttttagccaggataattattttgactgcatttaatctattctttttcttctattataaatgaagttttgaatatgtaatagtgggaagtttcctaatcatttcagtttaggggaaggtgtatgtgtgaccttgctgaatttgctttctttccccttgcgcaggatgtttgatgtaggtggccaaagatcagaacgaaaaaagtggattcactgttttgagggagtgacagcaattatcttctgtgtggccctcagtgattatgaccttgttctggctgaggacgaggagatggtatgttggagcttctggtaaaaagcctgtctaatgtagccaggaaatggaaaataacttattaggaagattatctgcatccatttcctcattcaaccaaaacttagtatctttaatttttttgatctgtgccctattactctaaaaaagatgttatagccaccttgagtatgtggaaaggatgttagccagcccttcctcctacctcctctcccccaaaaattacaaaaatgaggactgacactcaactttatcttattggtgtttgacttatttccgtgaatgccatttagtgctgcaaaacttgttggtttgtctttttcattaacttaatccacttttactatttgctactgacctatcatcctttatttctttttcagaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggtaaggggttatgaaagattttattggaggtacacatcttacttagatcaacactttggtggcattcataaaactgcctttttttttttaatgattgattgggagagtattcagtggtagtggcattggcattaagcctgtgattaaaagcccctaagtcaagagtgccatatcagacacaattgagttttctgtgtttattttaaatttctatcttcattttttgaggaaaatacaaaaggagaaaaagtaaatttgggagctgggcatggtggctataattctagctacttggaagcttgaggcaggaggatcatttgagcccaagagtttgagatcagtctaggcaacatagtgacacccccctgcctcacaaaaaataaagtaaaatttggtatatgttgaagaaaatacaagggtaaattttaatcattgtgcccaagagactgacatgtagttgcagagagacataaataattttattatagtgtttaattgcacataaataattttattatagtgtaaaatatgcattaatagaagtggaatagaagtggttacttctgatggggtcactgtagtctttttctagagctactaagaggatgaaatagaaatcatcaggcagacgggaataaaagcattttagaaaagaggaattgcatatatgagaatatggaggtaggaaaatggtatgaccagttgtggaacccagaaggaatttggtattactagagtttacagtggcagggaagaagtggttggagagatggtcagagatcaactcatggagggccttatatctcatgctgagacgatgatcagttaaaggtttaatatcctaccatgatccatatcatggggtgcatgatatagaagaaactgtgcttgagaaagattatgcaataaataataaagatagatagtaggggatttgaattagtaagaactcaggatggaaataaaaacttttgatggggattaagggatatatcatagaacccaagggcaagaatggacaggtcttagaatggaattagaactaggaaataattgtcaggaaccctggaagcactctttatccccatcttttttctctcctctctgtgtatcttttttattattctttctttcctaaccagctttctctgctattcagtttatgtgataacagcctagtcacagtttctgtatctctggtaaaaagatcagactaggctgggcgcggtggctcacgcctgtaatcccagcactttgggaggccgaggcgggtgaatcatgaggttaggagatcgagaccatcctggctaacacagtgaaaccccgtctccactaaaaatacaaaaaaaattagttgggcttggtggcaggcacctgtagtcccagctactcgggaggctgaggcaggagaatggcatgaacccgggaggcagagcttgcagtgagccgagatcgcgccactgcactccagcctgggcgactgagcaaaaaaaaaaaaaagatcagactagactgggattgcttggccttggtttcaaattccaaggagagagattctggccgtggttaagtcaggcagaaatctgtaggccaatcagttgaggtcaggggcacaaatgtaactgccagggatggatcactatgaaacttatagatcagaatcaggtatttccagagaaggggaactcttattagcagagacactgtaaatgctttctataataaagtgaggctgggtgcagtggctcatgcctgtaatcccagcactttgggaggccgtggcaggtggatcatgaggtcaagagatcgagaccatcctgaccaatgtggtgaaaccctgtctctactaaaaatagaaaaattagctgggcatggtggtgtgcgcctgtaatcccagctactcgggaggctgaggcaggagaatcgcttgaacccgggaggcggaggttgcggtgagccgagatcgcaccactgcactccagcctggtgacagagtgagactccatcaatcaatcaatcaatcaatcaatcaataaagtgaaggggtaaagcaggggtaaggaagtgggaagagtcagaggtactcccaggtttctgtcttggatgctggtgctgtgacctgaattcatgtataggaatgttgatttttaattattcatagaacgttgaaataatatctcatggacagttatattcgaggttgaggagaggttggggtttgagatcatcagtagtgaaaacatggaaatgggtgaaatgacctatggagataatattatagaatgaggagaaaaaggaccacaggtagaacgagagagaatagcagcctctattggcaggagaggaagaaagatatcataaccaaaaggagaggttaaaaagtgagttgattaaatatttcagtcaacagtgttatctgcagataagtaagatacatactgaaaaagagcctttggagttaacagttaggaggtcgttgacctgctgttgagagcagtgtcagtggaaagttgagtacagtgagttacagaatggaaagtgaagaaagaagacaagtgtagactactcttgagcaacgtgggtttaaagggaaaggagagatttaagaatgtttataggctgagggctaagatcctataagcaaaagagatacattaaaaaacagatgtaattgaaggagcaagatttgcaagcaggtgggaaaaaaggaattaagagtctaggtaggataaatggataaacaaattgtgttatatacatacaatgaatattacttacccaagaaaaggaataataatagatggtacaacttgtatgaaactcaaaacactgtgctaagtaaaagaggccaatacttctattatatgatatatccaaaatagggcaatttctgtccatagagacagaaagaatattagtggttatgagaagtgggagaatgggaagaaaagggagtgattacttaatgggaatagggtgttgaaaaagttttgtcactagagagaggtggtgattgcataacattgtgaatacactaagtgccacagaattgtacactttaaaatggttaaatatctgttatgttaattttcctcaataatttttttaaaagagtataggtagagcaattgatttttgagcaagaagtaagacacctctaagaccagaagtacaaataagtgcagatatgtaacattttgagtgaggtggtaggccaaaaagttgagatgtagtttaatcctcatggcctctgttttatcaaggaagttggaaatgtggttacctgttcagagtaaagaacagagggaggtgagaataaggtgagtttatagaaagcaaccaagttttaggattgggggagagagatgtaagacaagtaaaataattggcattaatgttgaaggcccagcttagagtcttcacacaaagcaaagagcctttaatatcatttccattttctttgttgttgttaacttccaagcctatcctccattgtcttcattctgtgtacagattcttacggtccttatttgccaggtattattatctgttcctagcagacaaaattcacttttcactcatctgcctcctttaatttacagaggttgttttccagattttaagaacctgcttcaagcacctacaaagctgttttccttcagttctttaaatattttaattaatattcttttcctttccttttttttttttgagacagtgtcttgctctgtctcccagacagaaatgcagtggcatgatctcggctcactgcaacctccacctcccagattcaagtgcttcttgtgcctcagctctactacaggtgcccaccaccaggcctagctaatgattttttgatttttagtagagatgtggtttcactaagttagccaggctggtgttgaactcctgacctcaagcgatccacctgctgcggcccccaaagtgcagggattacagatgtgagccaccgcacccagctccttttttcttaagctccgttttgttacctggtcttctttatatctttgttattgatatttttgttatgcttcacgttactgaaaatagcctgtagtttattggaataatgaattgtctttgttgcgtttccctggctttatagccagtttctaaggctactctaaaggttctataagtagacaagatggtgtaaaaagcaggtgatttaagggtattaattacaaatattgttgagacaggctttgcttttggttcctgtcacctttctttttgtaaaaaataagagcttcattgagatataattgggaaaccctaaaattcactcttttaaagtgtattgcttttccttatttaaattattaccttaaggctttgaagctaaacctctttaaaactgtggaatgattttgaaaagaacaatttaccttgttgaattccttttttttttgttttaatacaaacaatcccatagcgtttattgccatcttttagtaacataagggtaatcaaaacactatgaatgaatgttcatattggaaaaaggacatctaaaagcaaactgtatccttctcaacaatttctcacttcattgatcctttctagttggagacactttgtagcagagtaatattatctccttttagcatgatccgacccagttgttttaaaaaatatggaacgcttcacgaatttgcgtgtcatccttgcgcggggactgtgctaatcttctctgtattgttccaattttagtacatgtgctaccaaagcaagcactaccctgttgaatttttattccaagatcactccaaggaacacagcctctctcagaccttttaagcagttgtgttccctagaaatgcaccttcctactttcctagtttccttttatactttctagatttttttagctgaaaagtctaaatgaaaaggtaaagagaaatttaacgttatgttttcctcaatctttgtgtttgatgattttattttgttaccatgagagtccactctcacgaagaacctaattatagaaacacctaatgattatagaaatagagaattctactcatatttaattgggttatgttccctctccataagtaaatggtaatggtctgacttagttgagttcaggcagctgttacaatttgaactgagagtactgggtgtccgttttaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaaggtaaagtttcatacaaggtagttatagtgctacagtgatgtctcttggtttttaaactttttctaattaagaatattcttctcttctagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagtttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattcagtaatataggatcctggaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcaggtccccatttttctgcctctgtaccatttacatttgctctctgtttgttaacatgaagatcactcttatttcaccatcccaaataacttatctaaatgcacattccttgaggacacagggagacaatttaagtcagtagtttttaatatgacttaagtaaaaatcacttggacccatctaagggattgacttttggctggtgggctggcaatcgatttttttttttttttgagacggagtctcgctctgtcgcccaggctggagtgcagtggcgcgatctcggcttattgcaagctctgcctcccgggttcatgctattctcctgctgggactaccaggttcctgccaccacgcccagctaatttttttgtatgtcttagtagagacggggtttaaccgtgttagccaggatggtcttgatcccctgacctcgtgatctgcctgcctcagcctcccaaagtgctgggattacaggcgtgagccaccgcacctggctggcaatttataatttttaaaaggtgattctgattaccagccaggcttgcaaatcactggtttgtattgaaataaaagatattttcttgtagcagggctaaaatgtgggatgaaacattaaatctactagcctgaaaaaaaactttggcatttgtaatcaaagaagctgaaagttgccttgtgtgtttcctctgaagaatgctggagatttgtgatggataatgtttcagaattcaggtgcctatgctttggaccatcaaagaagccattagtctctgtgtaaagaagaagtattcttaatggacagtcccccctaaccttataaattcagctttgcaacagatttcacctcctagcatgaaaattccaaaaactttaacaattactcataagtggatcttgagatgacattttcatcttggacagtttgaattctaaatctctagttcacagtgaatcgttttttaaatttttactgatggatcgttatttttcacaaggtactacattcttacaatgtaagactagatggaccaaaattttaaaaaaaacttcttgccttgtttttttaattttcatatatattctatttgttgtatatacacattagactattttaaaataacagctggtttttgtaattcattcattcaccctatattcttatattctgctcattattctctcatttatagctgtgacattctttggacattacttgcctggcctgattagttacttaatataatttattcatttgcttagcatgtgtgacatagttctggaatttcctgttgcagaactccttgctgtattgcagtcatatataaggtaaagtcagtctcttgttcctattaaaaagctaccattgattattttccctttttacatgttcaaaaaaaaaaaaataagcaaccctctactcatttgtataaacctaaaacgtcactgttttccttgagcgttagtacttgtgggttctttccttttcatgtgtaatactgattttaagagcaatgatcttagtttgccagtgccaggtaattattgtgttctactttaggcttcgtagtgcaaatcagggatctgacctggatcagcctcagctctttacatagctttatgatcatcatattttgttgtattgctcccaacaagcacaagagaaaaaggcaggcttcctagagacctcaagttgaaagttgattttgctgacaactatcagggagtaaaagaaagcctttttcaggcactggagaactaactttaatgatgatcaaggtctttatgcctttatcttttagtttttaagatcatttctctccctcctttccccccagttttctcaacatttatgagttagttctgctgagaacaacatacttcagaacatgtcaggatagggcagttttttcttgtttttcttt

SEQ ID NO: 12599 - DNA, 10994 bp, Human
  misc_feature (1)...(10994): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcgcaggggggccgcgccccggctaggggtctgcggtggagcgtgccagggagcagagccagcggcgcggcggggtcggggcgttgcgtctgggaggacgagcctcctccctgggtccccgatccccgggcgccttgcgcgcgagcaactcttctttgcagccagtttgcagccgggattctagagtatcccgggagcagcactcggaaggcggggaggaggctgcttctgggaacgagaaggggtggagctcagcctttcggggtgctggggggtgggtggtccctgaggtgctcactctgggggcccgcaattgaagccgggcaggaggcgcagctggggcgcatcctcaaagcctgaattccgcgcccgcctgttgctggaaaaggcagcttccttcgctggagggggtgcgccgacccaccccttcccccttctgcctgggcatcacgccaggctggaggtgagcgagagcgggaggttcggcggctcccgcccgagctgggcgttggcaggggttgcggggcggtgtgggtcgcctcgcgcctccccgagtgatgggatcataggggacagagatgagggatggaggattcccatactggaagcgcccgctggcttattttggggaccacattcaggtgggaagtgcgcccgggcacctcggagcgtttctccggatccgcctggtagcagggcgctctcgggtccacgctgcccttgtatggcccgcagcggtgtcgcgtgtttctcttggctcccattccgccgtcccagccgctgtccggctggggaaggggagggctaggcaatacccagctcgctggcctcatgcccagtgccaaccatgtccctggggtattccaggctactgcctcccaggctgactttatttctggggaaagggctaaatcgggctccacagttgcagccggtccagctccaccctgccctgctcttctagctctgggaggagtcaggggtctgaggctctgggttggagaccccaccttccacctgccctccttgtccgagagccaaggtaacaacccaggcatcccagagcccaggcagatggtgtcgagtgacatcacctcctcacagggctggcagcacgctggcaccactgacgtcactcctgcccactgcctggcccttgccctgacccctgggggagactctgacctctccatccttaccagctacctagggtggggtccgcgggtgtgtgcggagtgttcatggaggtgctgctgagggagcatgagaccggaacttccgccagagttagcccgctggggagtgagggcagggattttggagggcagagggtagagcagtggtgtcttcccctggcggtggtgacacaaaagggcctgtgtgccccagcctggcacatgctttgcattcccacactctgagctcacccggagaggagggggcctggaaggaaaggggccttcctcttggccccgagcctaggttgcccctttctgcccctctaccagcctcagctggagctgttcggtgctcagtctctgctcaatctctgcttggctccaaggacctgggatctcctggacggggagagggctggcccaggtggggcgcgggtcggggtgggggtagagcgttcagaggacagggccctctgcagaccctctgagtggcaggaaaaacagctgcagcagcgctgcgaggggaggggcggacagcagccggagctgacacagctgcgggggccccgcctccctcccccaggtgtgcccggagaggctgagcagcctgcgcctgagctggtggaggtggaagtgggcagcacagcccttctgaagtgcggcctctcccagtcccaaggcaacctcagccatgtcgactggttttctgtgagtgcttgggctcctgcaagagcagcccggggagggagactctgcccctcttgtagcccaggacccttctcctcctctgtgtctcctcccattaggtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacagtgcgtgaccctgtgtctgccagcagggtagtgagggtggtgggacgtggccagatgtccccctcatttctattttcttgtagaagctccggaggagccaaacatccaggtcaaccccctgggcatccctgtgaacagtaaggagcctgaggaggtgagatgtgtggcaggtgggctgggcagctggtgcgcagccgctgagatggggcttgaagggggctcggaggcagggagactcacaccctgtgctctttaggtcgctacctgtgtagggaggaacgggtaccccattcctcaagtcatctggtacaagaatggccggcctctgaaggaggagaagaaccgtgagtagccctttctcccaaaagccacccttgggccaggtgtggtagctcacacctgtaatctcggtgctttgggaggccaaggcaggaggatctctggaggtgaggagttcaggaccaccttggacaacatagggtgaccctgtctctacagaaaataaaaaaattagccaggcatggtggtgtgtgcctgtggtcccagatacttgggaggctgaggcaggaggatcatatgagcccaggaaatgaaggctgcagtgagctaggattgcaccaccacactccggcctgggtgacagagcgagaccccatctcttaaaaagagctgtccctatggtactacacaggaactgccttatattttcattaagcttttaacttaaaaaaattatacaaatggtacttgaaaatattttcatgagaatttaaactgacaaaaaatctagaagtttcttcttgcctgagaccccccctcccagaaataatctctgctatcagggtgtgttctttcaagcctatttctatgtatttgctcatatatagaaatatttctagaatgatataggcttctgtgttttattatctaaatcagtcattcttaaccaggggtgattttgtaccccctcctcctaggagatacttggcaatgtctggagatatttttggttgtcacacatagagggggtgctactgccatctagtaggtagagagaccaaggatgttgctaacatcctatagggcacaggacagcccccacaataaagaatcaacgtggcctaaaacatcagtagtgctggctgggctcacgcctgtaatcccagcacttttggaggccaaggtgggcggatcacctgaggtcgggagttcaagaccagcctgtccaacacggagaaaccccatctctactgaaaatacaaaagtagccgggcgtggtggcgcatgtctgtaatcccagctactcaggaggctgaggcaggagaatcacttgaagccgggagggaggtggaggttgcggtgagccgagattgtaccactgcactccagcctgggcaacaagagtgaaactctgtctgaaaaaaaaaaaaaaaaaattatcagtagtgctgagaaaccctggtctaagtggtggtgtatggtatacattgttagacaatttcttttatacaatgtttctgggtcagtctatttagatcaactgatcgttttgcttactgccaagttttccatactacgcatagcaggtagtcgagttcaccattccccatttagtggacatctagacggctgctcgtttttatcattgcagcattctttgcacacatccttggatatgagcagacatgaaaatgtttttctagggttgacactgagcagtaaaagtgctgggttgaagggtttccagcttgcatttgtacctggccttctacaggggacagggggctatttagatggtcccctgccaaccccagtggacaaccctagggtggggctggaggtggggctgaggctgagtcttcctccccttcctccctgcccaggggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctgtgagtactaacctgactctctgcttactggggctggggctgctggaaactcctgctggctcccccttatccagcccagggttgactcatgggccaagagctaccccctttgcctatgcagacccgacagaaaaagtgtggctggaagtggagcccgtgggaatgctgaaggaaggggaccgcgtggaaatcaggtgtttggctgatggcaaccctccaccacacttcagcatcagcaagcaggtgtgggggctttgtgctgggtgcaggtggggatgcaagcagagacccaggtggagtggcgggaggtgcactctgctcacctccccaatcctccctagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactgtgaggggctggggacccaggacagggggaccaggctggggcaatagggaactggccccaccctgccctgggtgacatgattgctgtacccccagatgtgtctgacgtccgagtgagtcccgcagcccctgagagacaggaaggcagcagcctcaccctgacctgtgaggcagagagtagccaggacctcgagttccagtggctgagagaagaggtacccaggcgggtctggggcaaggggctgatggggtgggtggggctggcggtgacaagaatgtgctctttcccagaccctctgacccatctctcatcccagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggtgaggccctccctctgggtagagaccaggtcaccccaagtggggtggtttttaagctctttgacaaaaagccacctgctgccctggggagctctggtgcggagggggaggcaggctagctgggcttgccacctcacctctccctacctccccaaggccccccttggatggcattcaaggagaggaaggtgtgggtgaaagagaatatggtgttgaatctgtcttgtgaagcgtcagggcacccccggcccaccatctcctggaacgtcaacggcacggtgagcgggtgtctcatctgccacactctcctaatccctgcctgcgctttgtggccaggaccagagatcctccccatcccctgagctgcctccttcctttcctcgcaggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctgggtgagggctgcatccctgcaggggatggcaggggcaggcccaggcacgggcagtaacttgcgcttctcctaacacccctccctctgcctcctagtcaatttaaccaccctcacaccagactccaacacaaccactggcctcagcacttccactgccagtcctcataccagagccaacagcacctccacaggtaagccaggcctggcaagagaacagggctgtgccagggcatcctttctgccctgtccctccccagagagccctgtccagaaaggtgagtagcagccccatcttgtcggccctggactggctggggcaacgatggtgacgaagtggcctggggcagggagtgacgaggagtgtctttgtggcgcagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatgtaagcccaacaccggcccctccgcccccgcccgttttgccacccagcctgctgcctgcccagcgcccgcctgccccttgacagcaggagtggggccctgggtcagggtgctgcctgctccactacccactgcccagcttccatcagccacatggtctcatgacctgcttccctgccctgggctggccctggagcaaggagccctcatccattccacatccttcacagcgggcccttctcttcctgtggccctgagataccaacctctcacctccctccctcctcccagcacgctgcccccgtctcgtaagagcgaacttgtagttgaagttaagtcagataagctcccagaagagatgggcctcctgcagggcagcagcggtgacaagagggctccgggagaccaggtaggaggcggttcctgtggccagagcctgccacatcctcagggaccgggggcagtagggactaacggttctctctatccttcatccctctttgtcagagatagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctccttcctctcggtgctcacaccttcaactcagcaccgtctccgtgttcccctcttctcctctacccacttttagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgtagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaatcatacattgctttttattcatcatgggtaccacaggaacctgggggcctgtgaaactacaaccaaaaggcacacaaaaccgtttccagttggcagcagagatcaggggttacctctgcttctgagcaaatggctcaagttctaccagagcagacagtcaccctacttttcagcagcaaaactgccctgatgacgcagcacgaagggcctggcaggctgttagcaggagctatgtccccttcctatgctttcctgccacttggaactgccctccagacagcagctcaggctcaccgccatgaggaagggggccttggcatttggtcctacggcaactcgagtattgcctcccaaccccctgaatgagcaagaactcaagtctgctacaacaaaagaaactttatttaaaaatatttttttacagacatgggtgcttgaaaaagctctttagttaactaactgtgtatggaaatgaaaaaaaattaataaataacattagtaaaacagacttctaaacattaatacactggcaaaataaaatggacttaaaatgaaaatgaatcttaaagctctgctattctctgtaagaatatttaccttctgtttttcttattctttacaggtgagaatgattaaatactgctaatataaattttttatattaatgacacatttttaaaatagtccacgaaaatctcacctatgtgtttgttttgttttcttcttaacactgatatacaaattgggactcttcattctggagaaagcatcaggttctctccagcactcccaggctaagaatttcaaaatcttgaataaggaggactttaaaatttctgtctcccaattctttattagttaaaggcaggggaaaactgaggaaagggtaaaagataagtaagatgtcattatatagaaaaacttttgctaaagctcactatagtcacattactgaggacaggcttctggtcccatgttccttgctgcccttccctggggaaaccaggccctgcagagggcactagctgcttaatgctttaagtctgaagccttcaaatgaaaggccagccacatctgatgggggctggggggtgggggcaggaggtctagaccagttcaggatccagcaaaaagaaaagacaaagccaccaacctccccttctcaggagagtccatcctatactcctcgacacaactaggtaattaatgtcatcagaaggctaggacacttggaatggtccagagtttacctgggaattgtgaaacattctgtcttttgcaggagacaaggcatgcaacctgataactaagcttgtgattggaaccaaccaaatgatcccagggtacaatgcttctctcctccactgaagtctcacagcaggggaaagggactccagacacactgcacctgcatgtcacctctccagtcacagagagcattctttcctgtctcctagacactaaggactaatgaaactcaaggtagaggagctcagactctggtatttccatattaagtcctaaaatgcagcctgggatacagtgctgccttagaaaggcacaaaacatttggctttttttttttttcagtgtgctaaaaattgttttgttttgagtaaaggaaaaagatatataaggttaaaaatcccaagtcaccacagccagaaaacagacgtaggaggtgcctcatagctgccatgcccctaccacatgtgtcagcaggaagtcaggcttttctttcaaggccaagacactagaacagtgctgagcagggtaggtcaggaggcatttactctcatgggcattgcgttgcaggctcactcacccagacagcaggagaaacaggccatggaagacaacacgtggtctacagactcataagtagttctctgcctctccagttttaagatggccataagcatggccaccctcacccacaagaaggtcagaggtaggtagagaggagggagctgacacacaggcacccaggacaccctgcttcagggctcagcatggaggtggcacaaggcctgaggagttgcacatagcacgcattgagcaatactcctctctggcctcctgtctgatttaggggcagaaggagaatgtaggagaggcaatgttggtggggagggggcggggcctgacattcatttttgggactgaatcaggcaatcaggactctgctgatttcttcagctgccaaatcaggagatctgaggttggcttttgggctttgctctgtacaaacacagggagtg

SEQ ID NO: 12600 - DNA, 21885 bp, Human
acaagcatcagatccaagttagagagggcacccggggacagaaacctccaagccagccaaaagccaaaggaaggattttacagaaagatacaggaatgtggggccaggcacagtggctcatgcctgcaatcctagcactttgggaggccgaggtgggaggatcgcttgcggccaggaattcaaggccagcctgagcaacatagcgagatcctatctctacaacaaatttaaaaactagctgggtgtgatcacatatgcctgtggtcccaactacccaggaggctgaggcaggagttgagcccaggaggtggaggctgcaatgagcaatgatggcgccacttcactccagcctcagtgaaatagtgagaccctgtctaaaaataataataaaaataaaaaacatataaagatgtcagagcacagggaccagagctgttagtcggcctcatggagaccctggccaggacagccacctctggggaccaggaagtctctcagtttctgtctctgagggtttggctctctgagtctctctgtcacctctcatttctctctcatctccctctgtctatgctgtgtctctatctctttcaatctctctgtctctgtctcccagcccttatctctgagtgtgtctgtttctctctcatttctctctctctctctctctctttctctctctctctttctctctctctctttctctctcccccctccctcctcccctctccctactgcaggctggtccataacccttatcttccccagacctgatggagttctggtattaatctgtttatggtctgtttccctccactagaacacggtcttcattaaaggcagagatttttgtctgtcttattttctgctgtatacccagtgcctgggatactggctggatcaataaatatatgctgaatgaagaatgaatgaatgaccattctcatgaacattattatttgatgccaactgtaaagcaacaataataataattgtcactgccactgctgctattgttggtatatcagctttttatttagtacaaactatatccccgaaattgagctaggcagtttcttgtttaagttttacagaccacgctgtgaggtaagtactgttagtatgcccttttttctttctttttgagacagagtctcactctgtcgcccaggctggagtgcagaggcccgatcttggctcactgcaacctctgcctcccgggtacaagtgattttcctgtcttagcctccccagtagctgggattacaggcatgtgccaccatgccggctaatttttgtatttttagtaaagatgggtttttgccatgttggccaggctggtcttgaactcctggacctctggtgatcctcctgcctcggcctcccaaagtgctgggattacaggcgtcagccactgcgcttgctcccccagcccccaaacttttttttttttttttgagacaggtctggctctgccacccaagctgtagtgtagtggcgcaatggtagctcactgaagcctctaactcctgggttcacacagtcctcctgcctcagcctcccaaaatgctggaattcaggcctgagccaccgcgccctactatgcccatttttcagataaagaatctgagggccctcgaggagaaaccacttgcccaacatgagccctggtcttgtctgaccccaaagcccatgggaagtttaggctgcgtggaaggacagcctggtgggctcaggatctgtcccatcacgagttggaacctcagctctgccactcggcaaccgcgagccgttagtaagttgctgaatctctccgtgtgcctccgtttcctcacctggaatgtgggcgacctcacacaggaagccgcctcttctagtgggcaccgacggagcgagcgcgcgtctgcagcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggtgagtgacccccgcgcagtccggtggcccctgtctggctcccagctccgcatccaggccgggtactcgcccccttgggttcccgaagatgacggccccgcccggcgccacccaccccccatctctgccccggggttggaaggaacacggtgcgagggtgcgagggcaggaccctcctcttggccacccggagagcggtcggagttgggtacagaaattcctcgaaattggcagcaacacgggtcgggcacaagaccctcctctgggcccctcggaaaggggatggagttgggtgaggaaatttcccaaaaaggcaagtgaatcccggaaaatcagcagatggtgacgcatgccggattaccttacccaggttcctgctcagcatacccaggccataacccagcagcgtgctggcaggctgggtctggacggaggggatggttgatgttggggaggaggacagtgggtgacacttgacaccattacccctctgacccccaatgtctgactccaggggcctggccattcattcattctttcattcttttttttttttttttgagacagtctcactccatcacccaggctggagtgcagtgtcctgctctcggctcactgcagcctcctcctcccgagttcaagcgattctcctgcttcagcctcccgagtagctcggattacagacatgtgccactatgcctggctaatatttttgtatttttagtagatacaggatttcaccatgttggccaggctggtctcaaactcctgataaatatatatattatatattattattatatattacatattatagtaatatataataaaaatatataatatatattatagtaatatataatatataataaaatatataatatatattatagtaatatataatatataataaaatatataatatatattatagtaatatataatatattataatatattatatatattattataatatataatatgtatattatatattatatatattattataatatataatatgtattatgtattatataattgataatatataataatatatttcttaataaatatatattaaatatattatatatttataacatatattatttatataataaataatatatattttattatacatttaaagagtaaatagataacatattttattatttatttatatattttgtgtatatatatatatatatatatatatatatatagtgcgtgtgtgcgtgtatgtgtgtgtgtgtatgagagagacaaggtcttgctttgttgcccaggctggagtgcagtggtacaatcccggctcattgcaaactcgacttcccaggctcaagcgatcctctcactgtggcttctggagtagctgggattataggtgctcacctggctaattttttttgtatttttggtagagacagggtttcgctatgctgcccaggctggttgcagccaagcacagtggctcatgcctgtaatcccaacactttgggaggctgtggtgggaggatcacttgagcttaggaattcaaaaccagcctgggcaatatggcaagaccccatctctacaaaaataattaactaaataaaaatttaaaaataaaaaagaatgcataggaccatgtttattagtgtcaataagcgctgtcacattttgaggacctactatgtgctagggcccttagcagaaagatttttatataggacctgggggattagaggtcagtctctgaccgcccaagttcaaatcccacctctgccactaaacctctgtatgacttggaggacactatactctgtgtcagtttccctgtctgtaaaatgatgttaacagtagtgcttgcctcaggggggctatttgaggattaaatgccaagatatatgtgaagcacccagaatagcccctgatctgtgtcagcaccctgtgagtgtccactgttctaagtctcattttacaaactaggaaaaagaatcagagaggttaagtaaccggcctgaagctccacagcagaaaactgaagggacccaaaactcctgggctataattgccttcctctcgtgcctcaatcccccacattcttccaaccaggacccacccagagtaataatgcagcgtttcatggatttgaagacccaagatttctccccgttttctacattggggttattctaacccctaatggcaagttgtgctataaatgacaacagtcatggtatgtgaaacctacgacactggtgcgatgaaaaagttctgggccaggtgcggtggctcatacctgtaatcccagcactttgggaggccgtagtgggaggatcacttgaggtcaggagttcaagaccagcctggccaacatggtgaaaccccatctctgctaaaaacaaaaatacaaaaaattagccaggtgtggtggtgggagcctgtcatcccagctacgcggaaagctgaggcaggagaaccgcttgaaccccagaggcagagcttgcagtgagcagagatcgcgccactgcactccccctgggcgacagagagagactccgtctcaaaaaaaaaagagaagaaaagaaaaagttctggcgctatatagtagtaacggttgcacaatatcgtgaaatgtacatagtgccactgaactgtatgctttaaatgacttaaatggtaaatttagttttttaaccacaatatttaccacaattttttaaatcagtgatgttgagattcagggaaatacggtaataatagaagaaatacggtaataaatagccaaagtgaaggagcacggccaagttgcagaccatcccagacgcccttaccctcctcgcctgccatggccccaactagtgccccagttccccctccccccacaccccacggtccaccggggatccagggccccagcgtgcaagtgcacgcccaggtgcccgggctcctggagcccctccctatctagtccaagaacgccccgggtctgacaccttctcttcggttctccgcaggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttggtgagcagggggttttggggaggctgaatgaaaggcagagacttggtgggaggatcagggaagttggcaaagagcggggaggcctgggagggagggagattccctccacagcagatcccctggggacaaaaggagggggcagcgcaatgatgtggggtggggtgggggggaggtgagtggggggaggggctgcagggcaggaagaaagcagagatctcagggagtaaggacccccaagcctgggatcagaaagccctgagggaggaggaggggtatattggaaagggagctgggaggggactgggaaggaagggaggaggcctgggtggcctcttctgggtccctcctttcctcatctgtaaaagggttggtgacaacagcatcacccttggaaagctgtcctgagtgtcatcactgcctaggaaagagtctgtctgcccccttggactgtgtacccatgagggcagaaccggggctattttgatcactgctgggccccagcactttccaccaaacaatatttattgagcacttattatgtgccattctaagagctttacctgcatattctaattgcctgtgattccatcattatcacctgttgacagacaaggaaactgaggcacagacttgcccaagaccaaagctgcagccttagggcagcggcgcttcaccgctggcccatgtgagccccttagagctgtcggttactgttactttatctggtgaagaaggagaaagttgaaacagacagacaggaaagcaaggatcctgatacccaaaagaggaggggatcatgctttcattttcatgagctccatgaagccttcctcttggaacttgagcaagaagtctctgtgcctcagtttcctcatctgtgggatagggatcaccatgaggattcaaaaaaactgaccctttttttttttttgagatagtttagttctgtcgcccaggctggagtgcagtggtgtgatcatagtaggtcctcactgcagcctggaactcctgggctcaagggatgttcctaccctccctgtagctggaattacaggaatgtgccaccatgcccaacttgttttctgttttgttttgttttgttttgttttgttttctttttaagcttatgtgccaagaactattccaagcctgtgcatgagaaactcatgaaatgtcaagggcttggaactgtgcctagcacacaacacccaaccaaaggcagctgttgtcactccagcaagcctgggattctgggtatcatggtttaggatgagggtaaaacagaaacagtgagtcaagttaaggagaaatcttcggtaaataatataggtaatgatggggaaggaagttccaggtttgggaatcaccaggatgatgattaagagatggtcaaggtggttttggagtcagacagactttatgtgaaagcccagctctgctgcttacagctgtgtgaccatgggcaagtcacttcccttctcaacttcagggctcaggcttcctctcctccactgagccccagaccaggataaccccctttgggtttcccctttccagccctgccctctccgagtcatcactgcctaggaaagagtccgtctgcccccttggactgtgtacccatgagggcagaaccagggctattttggtcactgctgggctccagcactttccaccaaacaatatttattgagcgcttattatataccattctaagagctttacctgcatattctcattgcctgtgatcccatcactatcccctgtcaacagacaaggaaactgaggcacagacttgcccaagaccacacagctgctcagggacacagctgggatttaaaccatgccattctgtatcttttttttttttttttttttgaggcagaatctcactctgtcgcccaggctggagagcagtgacacaatctcagctcactgcaacctccgcctcccgagttcaagcaattctctggtctcagcctcccaagtaactgggattactggcgtgtgccaccataccctggctaatttttaatagagacagtttctccatgttggccaggctggtctcgaactcctgaccccaagtgatccacccacctcagccccccaaagttctgggattataggcgtgagccaccccgcccagcaaccatgccatcctgtacccttaatgaatgcccccttctgccacggaggggttcattgaatgacttgttgcttttgttcctcttcccagccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactgtgagtgtgcccaagtcagcgatggcaagaacccctgccgggctgcccccaccactgtctacactgactccccaaggcactgtaggcattgcttccatcatctgcaccggctcccctgactcctgtctacacgacccacccccattgtctgcaccagctcccctgggccgtaaacaacactgtccctattgtctacaccagtttacttgggccatagtcaatgctggtacccagactgtctgccctggctcctctagcggctgtctgcacggatacctgacactctgttgactcccttgagcacagtctacactgcccctaaactgcctacacccatttccccaggcaagtatccacaatgaccctccccacattgctacactggttcttctggccacgatcaacactgcctcccttattgtctacacccactcccttgtccttttctttctttcctttttttttttttttttttgaaatagagtctcactctgttacccaggctgcagtacagtggcatgttctcggctcactgtaacctctgcctcccaaattcaggtggttctcctacctcagcctcccaaatagctgggattaaaggtgcacaccaccacacctggctaatttttgtatttttagtagagacagggtttcatcatgttggccaggctggtttcgaactcctgacctcaggtgatcggcctgcctcagcctcccaaagtatgctggaattataggcatgagccactgtgcccggctttttgttttgttttgtttttcctttggacagggtctcgctctgtcacccaggctggagtgtaggggcatgatcatggttcctacagcctcacccttccaggctcaagcaatccttctccctcagcctcccaagtaactgggactacaggtgcagccaccatgcccggctaattttacagtttttttctagagagagttttgctgtgttgcccaggctggtctcaaactcctaggcttaagtgatcctcccgcctcagtctcccgaagtgctgagattacaggcgtgagccactgcacctggccccttgtccattttctacactgccttaccattgtctacactggctctcctgggccacagacagcactaaccccattgtctacaccacctattttggccaccagctgtggggtgttttcactgtctcccatagtgtctacactggctcctatgaccactgtctatgtaaacaccccactttttctacactggttctcctaggcactctctaaagtgccccctgacactgtctacactgactccctggagaactgtctgcattcacctcccacattgtatcgaccagttcccctgagccacgatcaactgtctccgccgggtgctagttgcattgatcttctcacattgtttgtgctggctcccctaagcagtgtctgcagagtcccccagtgtagtctccatgttcctctgcccaatattgtctacactggctcatctacaggctatccagtctcaccccacatcaccacactggcctccttgtgttctgtctgcacagccccctgacagcatctgtcctgattctcctgcacagcgttacctccaccagctccctcatggcatcatcgacattgacacccacacatttatctccactgacagccccaggactctctaaccagtgctgtctaacagaaatagcatgcaagctgcatataggattttaaattctccagcggccaccccattaaaaaattaaaagaaagaggccaggcacggtggctcacgcctgtaatcccagcactttgggaggccgaggcaggtggatcacctgaggtcaggcattcaagaccagcctgatcaatgtggtgaaactctgtcttcactaaaaaatacaaaaattagccaggcacggtggcgggtgcctgtaatcccagctactcgggagactgaggcaggagaatcacttgaacctgggaggcggagattgcaatgagcgagattacgccattgcactccagcctgggcagcagagcaaaactccatctcaaaaacaagaaaagaaagagatgaaatttatttgtttatttatttatctatttatttatttgagacggggtcttactctgtcacccagactggagtgcagtggcacagctccctgcagcctcaacctcctgggcttaagtgatcctcccacctcagcctcagtctcctgagtagctgggactacaggcgtgtgacaccatgcctagctaatttttgtttttgtttttgtttttgtttttttgttttgtgatgaagtcttgctctgtcacccaggctagagtgcagtggcacgatctcaactcactgcagcctccgcctctcgggttcaagtgattctcctgcctcagcctcccgagtagctgggattacaagccctggccacagtgcccagctaatttttgtatttgtggtagagacgggatttcaccatgttggccaggctggtctcaaactcctgacctcgtgatccacccaccttggcctcccaaattgctgggattacagacgtgagccaccgcacccggcctatttttattttttctggagacaggatctccctatgttgcccaggctggtctcaaactcctgggctcaagtgatcctcctgcctcaacctcccaaggtactgggattacaggcatgagccactgtgcctggccaaaattaatttttaataattgcctttacttaacccaatatacctaaaatattatttcaacttgtaattgtttttttaaaattattcttgagatctttcccatttattttgtcctagtaaagcctttgaaatctggtgtgtatttcggcctggctatatttcgagtgctcagtagtcacatgtggccagtaggtgccatattggacagcacagatctagactaagctcccacatcatctacactggctcatccaaatactgtctacacacatacacagagcctgtcttaatttcgtcagctcccggggacacactgtatatgtgggggtgatctcacccccaccaccacattttcaacactggcccgacaatatagcatctgctgtaatattccaacaccctgtctacactgaacccatcagtaatatccacacaagctcttctagacatcattcatactgttcctcccaccattgtctatactgcttactccccgccaggcaattggtacacagattccctcaggtactgtctatactggagtccctcaacactgtcactgggtctgagcgaggaggagatctacactgactcctacccctcgcccccgaataaaaccctgtcccattggcctgcccccaaggacattgaaaggtcttcgctgtcaatcacgtatgggatggctgagcagcagcctagagcagggttatctgggactctttcctgcaggacttgtcagaaccttgaatacactgctgtgtgttgtgagtggtcattgcctatgagtgagaaaaggaggaggcattttcctgcaggacacccaagacatgcctggtccaggctacccaggaaagctagtggagaaaagcagctcctcagaagccttctccatgtccccactgaccaaggactcctaggcttctgctctctgtggcaccccatctacctagactcctcctaggcctctccagctcccgctgttttccaaatatccccgggccttttcctgcagtgtcgtgaatcccgcgtagccccaggccccccaaagcctcccagtctctgaacctctgtatccatttcctgcagaccccccagaggtatccatctctggctatgataacaactggtaccttggccagaatgaggccaccctgacctgcgatgctcgcagcaacccagagcccacaggctataattggagcacgtgagtcctgggtctcagggaggaggggctgggggtctggatttctagcactgagggaggaggggctgggggcctggactcctgggactgagggagaaggggctgggggcccggacccctgggtctgagggacgagaggctgggagcccggactcctgggtctgagggaagaggggctgggggtctggacccctgggactgagagaggaggggctgggcctggacccctgggtctgagggaggaggggctggggggtctggacccctgggtctgagggaggagaagctgggagcctggacccctgggtctgaggcaggacagactggggcctggactcctggtctaagagaggagggagattcagaaaagagaaaaagaggaggttgacttcgggcccccagtggggggcatctctgttttgacatctctgttttgcggttgaggcgtttagcaggtggttgaatcctggctggtggatgcacctgctttttggggtgtgcctgctctgtgcccggtacttcccccgaatcccatgtgaccccatgctgtgcacagtcagcagctgttgccctgcccaggttaaagaccagccacgagagggcagaagcggcccttgaatcagcgctcggctccaaagctggtcctccgcctcttggccaagcttgtctaacctgcaggccacatcatttgtaaactttcttaaaacattatgagactttttttttgcgaatttttttagctcattagctattgttagtgttagtgtattttatgtatggcccaggacagttcttcttcttccaatgtggcccggggaagccaaaagattggacacccccactctagactgtaaccacctcaccgtcaccttgtgtaacctacttggttatctctggatggagcaagtactatatatccccattgtctagatgagaaagttgaggctcacagcaataagatttccccagattcacactgaggctgagatcaagagcaaggtaagaaaaaggcaaagagataatacataattttataatacataattttacataaattacataattttactgaaccgccctttttttttaaagaaggggctctgttgccgaggctggagtgcagtggcgtgatcatagctcactgcagcctggacctccctgggctcaggtgatcctcccacctcagcctcctgagtagctgggactacaggcacacgccaccacactcagctaattttgttgtattttttttgcagagacagggttttgccacattgcccaggctggtctgcaactcctgggctcaagcaatcaacccacctcagcctcctaaagtgctgggattacaggcgtgagccacctcgcccagccttaggtctttttccttattacaaaaataacttgtgtccactgtagaaatatcaaacaatttagttatgagcaaaaagaagaaagtagtgcctatagttcaagtgtacccagccacctccagaaatacccagtgaccccttattatacatcctgtcttttttctctctgtttctaaacaaagactggaattatgctgtacatataattttgaaccttttcgtctgtcttgtgaatacctttccatgtcaaagcacatagatccacaactccattttcccccacgttgtattaggaagactgtcaaacatacagaaaaatcataggaattttccagtgaacacttaagattccaccacgtggattcccctgctaacattttactgtgcttgctttatcacgtttctgtgattccttcagtccctctattcatccatcaatcatattatgcatttcagagcacccccagctctcctgctttttttttttttttttttttttttgaggcagggcctcactctgttgctcaggctgtagtgccgtggcacaatcacagctcactgcagccttgaattcctgggctcaagcgatcctccagcttcagcctcccagatagctgggactacaggcacacaccaccacgcctggctaacctggccccttttttagtgttgctgggattccaccactttaaaaaaaaaattcaaagaatagagacaggatctcactatgttgcccaggctggtcttgaactcctgtactcaagcagtcatctcacctgggcctcccaaagggcagggaagggattccaacatatgtggatgtcatcagttatttaaccagtccctagtagaggacacagatgtcattttccattttcaactctgcaaatgccatggtggtgtccatccccactggtcacttgtcagcagttgtccgtggaaggaattgccggtcaaaggttttcaactggtgtgatggtgcctttactgtcctgcctcaaagcaccgcaattcaggctcttgagccagatagctgcgtttgcatcccagctctgcggagcacccaaagcctgatgcttccatctcctccacctctgttcattaaaccagtgttccttgactacttactgtgtgccgggtgcaattaaccaacatacgttggtcgataaaacagaccaaatttcctccccatatagagcttccattctagtggtgaaagaaacaagaagcaagataaagtgtgtagtgtgtgtgcaatggtgataaataccatggagaagacaaagcagagaagggaatgggactgggcgccatgactcatacctgtaatcccagcactttgggaggcagagatgggaggatcacttgaggctaggagttcaagaccagcctggccaacatggcgaaaccccatctctaccaaaaaagatacaaaaattggccgggtgtggtggcatgcacctgtagtcccagctactcaggaggctgaggtgggaagattccatgcacccaggaggtggaggttgcagtgagtcaagatggtgccactgcactccagcctgggtgacagagtgagacgctgtctcaaaaaaataataattaaataaattaaagagaaggggatgggaagggtgatcatcacagttgaaatagggtggccaagtgaggtgttactaaggtgacatcccagcagaggcctgaaggagatgagggtgagctctgcgggtgcctagggggaaagcattccagcagagggaacagcatgggcaaacccatttctatccatcagtccctgcataagcaaacaccctggacacctaactggagagtttgaggaccaacaaagaggccactgtggatgcagaggcgggagcaaaggggagagtaatggaaaacgtgggcagaggtagcaggggccagatcacgtggggcctgtgacaccagaagacttcggtttaactctgagccaggctaggcccccagagggtactgagctgaggtatgggaactgacttagggttcacaggcgacctctggtggccatgtggggaacagacgagggggcgagggcagaaacggagcccagcgtggaggcggctgctgggggccgggatgcacagcgccagagcagggaggtaccgtggaagccctgaggagaggtgggattctggatggatcttaaggcggggccgacatgattggctaatgggttgggtgtgggcatgagaggaagggaagagttggggggcctccagagttgctctccgcttatgctatagagggcgtgagggtttctgggcacgtagtgcgtgctcaatcactgtcactccggacctgcagcagaggccacctcctcacctttctgtctctcccaggaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtgaggaactccctgggtgggaagaacagggaccaaaggaagaggtcgaggcagggttccctgtctaatgctctctggctcccatccttctcctaagccttctcacaaaaggaccagtggggccagctttactcccctgttaactccatacctatatcactggtaccgttgttcagctgcctggatacactccctccacacacacaggttgggatagatgtggaatccctctctctcagggactcaggcctttccaaatatattaggcagacctctatcaattgcaattgacagaaacacaaagtagtctaagcaaaaaaaaccaaacaaaacaggactttattgaaaattcaccttcaggtatggttagatccaggggctccaaccatgtaacccaggaacttttattttatacatctcttgtctctgcttttcgttatactggctttattctcaggcaggctctgaagcaagatggccctcggcagggacaggctcacattctaccagaatggcaacagcaggagaaaaaacataccactttcagtaactgtagccatagtcccagggctggctctcattggcccagcttaggccacagcccacctatgaaccaatcatagcagccagggagaatggaatattctgattggccaggcctgtgtcaaagtcccattctgggcaccagagggtgggatccattccacctgaattaaatagactgaggcagtggagtggtggctccctaaggaaattcaagatgccatttcaagaatgagggataaaccccaagagtttccttacctaaatacctgtttccttctctttcagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgccgtaattgagcacctactacgggctctgtgctgagtccttccagtgtgcctctcactgaatcctcaccccactgccatgaggtttcccccatttgactgatgagggtgcagagccagggagccttgttcactggttcattgattacatttacaaatattatttacagagtgggagaagagcgtatagggtcttaatgccatggtagggactttggaatttaattcaggtgatgtgggagtccctgccagatggatggagggtgaaataatgcttaagccctcagccttactccatctgccttgttcaggagtgactcctaggaggaggtggcaggaactggcacctctgatcctcagctctaaaagggtctgatgctttcacacctcaagagatttgcacaggccgttcccctgcctggagcaccctcccatggctccttctggagaagtgtgccagctcattctgtaatcagaggaacgatgctttgctgagcactgtctacatgccactttgtatgtataaccccctcgattttaatttttaattttttttattatttatgtatttatttatttatttttgagacaggctctcactgtcgcccaggctggagtgcagtggtgcgatctcggctcactgtagccttcacctcccaggttcaagcgattctcatgcctcagcctcccaaggagcggggattacaggcacgcactactatgcccagcaatttttgtatttttaggagagacagcgtttcgccatgttggccaggctggtctcaaacccctggtctcctgtgatccacccgcctcagcctcccaaagtgctgggattacaggcatgagccaccacacctggcctgtacaatctccttgaatgcccacaaccacccagcaaagtggttctcccgtgagccccatgttacagaggaggaagtatttgctttgagagatgaagttacctgccaatggtcaaacagctggacatggttgttggggagaagaagccagatctttgactaccaagcttttccttcaaccactaaacaaagctgctcccttacaacccaggcggatactgcctcgtccaggaagccctccctgacccccaagcatgagccaagcatccactaggctctcccactccagccttgcccattctgggtcatcaccgtgggggacttgtttgtcatccccagtggactgtgagccccaagatagcagacctgaggctgtcactgtcatgactgtgtccccaggaccgcctaccactgggccgggcataaaagaggcactcgaggaagtgtttgctgagtgattcaatgtgtcagctccagagccagactgcctgtatctgggccctaaagctactgcttgattagtgatgtcaccataggcaaatagcttaagctgtatgactcagtttcctcatctgtaaaatggggtgatggtacctaataatacagtagagcacttaacacagtaggtggcacatggtaagccacatactgagtatgtatttgctatgattgttattgctattattactattattgttattattaacataaactgcacaagagcaggctttttgtttgtttgtttgtgttttgttttgagacaagatcttgctctgttgcccagactggagtagtgcagtgatgtgatcttggctcactgcagcctcaacctcccaggctcaggtgattctcccacctcagcctctcgagtagctgggattataggcgtgcactcccacgcctggctaattttttatatttttagtagagatggagtttcgttgtgttgcccaagctggtctcaaactcctagactccagcaatccgcccacctcagcctcccagagtgctggaattataggtgtgagccaccacgcctggccaagagcaggcatttttatctgttttgttcacagctgtgtccccagcacctagaatgtacctggcacaaagtagacattcaccatttgctgaataatactactatttgctaaataaacccctgttgaatagtctaggaaactgaacacagagaggttaagtcacttgtccaagttcacacagctcctaaaggacagagatggaatttgaacccatccatctggttccagagccaggctcgatatttatggatatttcataaccaagtgaataactggatggctaaatccttagaaagcacaccctccatccctgtctgacacacgtgtataccattaagggaaatggcacccccatgtaatagcagaggcagaacttgacattttcagggccctgacacccaggcatgtcttcttcccatgcttcccagcattattccttcctgacgacttcccctcctatttccccaggtacagagcatgccagcgcctcagctaatggggtaagtgcagtgttggagctaaggagggtgtggggtctgcacgaactacagaccagacgtcttcagatgcccacggcccggcctcaggagcctgggtcttttctcctggtgcctcgagcagcatttcccaacccttcctgctgggcggaatcccctgtagagtttgctaagacgcagccccagacagtctggtctgtgatggggccagggaatctgcattttaatatccgctctctcccccctgccccacgccccttcaattccacccatggccacaccttgagaagcactgccctggcttccagggagagaggaggggacgggcctgcagttctttgcacatggggcttcagtgggaagatgtttgattttgttcaaaagagccccaaggctaaaatttgaaaaccctcttctagcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaa

SEQ ID NO: 12601 - DNA, 6900 bp, Human
gggcaggaaggtgaaatgttttatggggctttagcaagggtacttcagccaccatcaaggatagagggactgttcctgaggattagcagtcataaattgagtaatttgaatttaatcaaaagatatgaagataaatcgttaggggatgaagtattatgcaagtggggattagttggaggagggggacattagctgaaagggcatgaacatgaaagtccagaggaaatgtcttaggtatgaagccttttgattctttcatgtgggaaatagagtaattgttccccttatacaagtttgagtgaggttcatcgcagaggagcatgaattatttgccatgctgtgctatgcagaattatgacccccatgacccttgatgttatgtaatgtgtgccctatgaatgtgagcagaacctgtaaataggatgagattgaaaaaccacaactatgttatattacatggaaaaagggattcttgaagatacaatgaaggttactaattcattgaccttgtatcaataagaaagcaggttttgggagattcctggaggggcccagtctaatcacgtgagccatttgaaagcagataattttctctgactggcagcataaggggaagtcaagaaattcaaaggccaaaaagaattcactgtcctgttgctagcttagaagatggagaggttcttgtaccaaggaatctagctgagactggcacctaagctgatagccagcaaggaagtgggaacctcagtgctacaactctacaactacaaggaactgaattcagtcaataatctgaatgagagtgaaagtttgtcacacagccaagttaaactaataaactgactttacaggggaaaaacatatatggggattagtctggaatcctcttgtgagttataattaccttctccaaagatcaaagacctggttcctctaaaattttaatgaacagatcttaacctatcttctggtgcattataaggctattttaatctatgctaaggagacaacatgaaggaaaattcttaggtctggccctattgtgttctttaattggctaagtagagaaaatgccaatgttgaaaagaaccaataggaaattctactggatggtaggatcagaaggcaagccagcaaatccagtaagggagattctcagaaagaacctggagctccttttgcaaaagatagagagtgatcttgatggttttaaaagtgtgctcaacagaggaaggaaagcataggcttttcagctacttgtgggacagtccaaattgaaatgcatgaatggtttgagaagtacataaaggttataacagggtgatgcaggcagtggtcttgtcaggaaatggacagtgcagaaggactgaccatacatggactgacagaacctgcaagtggagggtgctcagagaccaaaacaaacaaacaacaacaacaacagcaacaacaacagtatattagactacgaaggagaaaaaaagaagaattgagttttagctctgctttcttccatagtacagtattggataagtcaattaagttaccaatattttaaactctatttgccccactgctccaaacagggatgctccataaccattcagcagctcccttctccctgtgtctcaaagacggccctactccaggttctcactctctctgcctctactactgctggcctagcctgcataacagctgccaagattcctggaaggtctcagctgcttgctggatcttcagggctgcaggataggacatctggtttctgctgagcaagggcaaggtctgccttgaacttggaaaggtttccagtttaggggaagggacttcatctgtggccattcccaggatatgccaggaagagctcctcttgatgccagaacctcttactgtcaatgccctctgtagaaccgctgtctctcactccttgctccaccccggcttaaatactgtggctcttctctcagatcctgttatacatctctaccattacctagcctgaaaagccacctcagattcagccaacaagtaagtgggcattacaggagaagggtacctttcacaagggctgtaatctaaaatcttggggaagatacagcgtcatctgtccaagaggtgtcagcagtaacgaagcctcagtagaagccaaagttattttggattactgagcctgtatagtttccagattctcaagagaaatatatgggaatgtagatatctcagaggaccttcctgctgtcaggaattcagaggaggaaataaggaaggtaataggtgctctgctctcattctctcaaaccctcttccctgtgttttcctatagagattgctgatttgctccttaagcaagagattcactgctgctcagcatggctcagaccaactcatgcttcatgctgatctcctgcctgatgttcctgtctctgagccaaggtgagattgttttccccacacatacctcccacaaccccagccctgaagccctcactctatcctcatgcatatgagttcacttgagaaaaagcagagtcaagttcaggggttgtcttgtgttgttcagtgatatttattgctgatctcatcccattcaaaaacatcctgacctccctaaggagttagagatggaacttagcataaccctttatcagtgaccactgcagttggcattggtttgtcatattaacactactcatgatgggggggttgaggatgtctgtttgtagacagtcattagtggaatggggaactgaggggagctttgtgtgtagagaaactggacaggcttgagaaagaagcctcagtccttcaaggaagaaaaagccataagtaaaagggacaatggggacacttttcatgagcctattcattgtgtgctcttgtcttgagcaaagacatcttgagagcctataggtaagatgcagaagggcagaagtgaccaatcgcttcgtgacctataggatccttctattcctataaagaatcctcagaagctcctacctcatattttagcctttaccttgccctgagggtctttcttaattgtctctcttttcccaggacaggaggcccatgctgagttgcccaaggcccagatcagctgcccagaaggcaccagtgcctaaggctcccactgctactactttaatgaagagcatgagacctgggtttatgcagatgtgagtgaggagagcagtgtgggaagggaggctcacgaagggaggggaagctgccactctccagtgtgttcagtggctgatatgagatgagactaatcccctccctatccaatcatcagcccaaaactttccaatctactttatcccatcattcagcacagagatgctggtggtcagtgacagcatcatcagggacatttctgtgctgtcctttttctgttacatcctctgggagggctcaatatgtctcccacactttcctccttcactgagtgctccattttcttctccaacagctctactgccagaacatgaattcaggtaacctggtgtctgtgctcacccaggctgagggtgcctttgtggcttcgctgattaaagagagtggcaccaaggatagcaatgtctggattggcctccatgacccccaccggatcagtctgctgcatcttctacctcctgattatcaggttccagagggtctgatgtctggcacctcaagcatcagtttttactatattatgataaaagcaacctctctataaatcatataatgtaaaggatatcaaggttctccataggttcttcgagataagcttaaagctgaatttcctgtgtgtttcaggcattcacagataaactcattctctgtacttctagggtagcatctttatgtatctattatgtacctcttatctattgtgttatcatctctgttatagaagagccttctgtagaccatatagaaaaagattatagaggaggagaatctactgctggcaattgggaaccgcaaggtatactaaataatatatcaacaactaatggccatctaatgctatgctggatatgaacttttggggcctcaggaaagaaaaaccaggaactagtttcaataatgaggtgtcatggttccctgtggcaaatttagaacacttatcgtttggcaggacacagagaggtaggtgaacattccaggaaagaagcagcttagagaaaatgtggaggaaataatatgacacttagagaaaaaggaaggtttattcttgtcttatgtcttgacctgtttctgagtgcgaacacaaaccaggtgtttctgtctctttctgagtcacgtctgcccctgttctggcccttccccatctagaactgccattatcagtggagtagtgggtccctggtctcctacaaatcctgggacattggatccccaagctgtgccaatactgcctactgtgctagcctgacttcaagctcaggtgagaggcacagaatccacacacttattgccatcctctcctatttatctctgaggatcgaccggggactgggatagaggaagggtgagctcctcattcaggaaatagaggagtgtttcctctttatttttgctgagtcctgcagccaggagggtaatacactctgatcccctcagtctgaatcttctcattgtcttataggattcaagaaatggaaggatgattcttgtaaggagaagttctcctttgtttgcaagttcaaatactggaggcaattgtaaaatggacgtctagaattggtctaccagttactatggagtaaaagaattaaactggaccatctctctccatatcaatctggaccatctctcctctgctaaatttgcatgactgatctttagtatctttacctacctcaatttctggagccctaaacaataaaaataaacatgtttcccccatagtgctgtcttctgtgtctgctatttccccacctaatgcctgggtagttgggatggcagtgattgtagcactctagaagttgcttcggcccattcacttttaaaaactttgtccacatatcatgcatgttggactcaagggtttatgaacatatggtggccttgcttatgacaatgttaagaagataaggatttcactcaccacccacatatttccatggacccagtgtcagagaaattattactgttgatttacaagtgactggagtgtttggtactctaaagaggttcacatacctgtgacctgaggaaggcacatctgtgctttgttatacaagttgaagctatgactgaagtgataatttgagaattgtcaggtctacagtgttgaatgcattggtgttggaatgactagaggcttggtggccagcaatgttggttaaatggcactcctggaatgaacggctaaatgaataataaattagattaataaaatactcaggcatagttatttaataatcctatcttcatatacagtcaaattctgaagtactgatgttaggactttaatgaattaattttgtgggaacaccattcagcccataacaccaacagcatcaataatactattacctgggatttaataaaacaatgcaatcaaaaggcacatattgttagtctgaattaaaacaacaacaaaatctatttatgagctatgaataaattgacttagattcacagacactgtggagatgaaagtgactccatcttgggtgctaatctgccatgttgacttttgattagccccagtcgtgggaatgcttcctgattcctacattatttactgtccttagggtaagaacatatacttactagaaatcttgcctttagaaaaaaacaatcttgaggtctttgcacaaatgataggctatagtgaacatagcattcttgtctgtttggaagggttgcctctaattgtctgtatagagcacgtgcactctttccctgcggtacataagccctggggccagggagtaacagtgtggagatctccctgtcggtggccgccaagaccacacttctgtctgtatgttccccagcaaatcaccctttactgacaaactggactcttctgcctcagtctttagtttcttggctcctttcgtgtttggtggttgctttgcatatatggtcatttatgaaacaactggggagtcagtcaataggggtccaggaaccaaagtttgggcaaaaggcaggaaacatacgtggaggaaatcctggcaggctcccctcatctatgtggggtggtgttggctacttgctagatgcctgtggaccatcatgtgagtacagagatgccctgaaaatgctggagggtctagaatgcttgttagtagaacatcttacagctcactggggtaaggaagttcaccaggtggctgagacagagggttggccactgttacggattgtgggaatggccacagaagtgtagttagcagctaagatgaaggtactaagactagaggaagaattaccattagaaaaggatatgtggacctccacgtccatgtttgcatctagtctggcagataagctcaaaactcaggatactcacctggaacccctagcctgctgctttatatggttagatgggagagagctgtgttggccaaaagtgcaagctgttcttcctaaattggactggaacgctaagacttgttgtccttaggaaccaaatagtgagtgagatgaagacatacctcaggaggaggaggataattatccttcccttttgagagcaagacctctcatgcaatggaaaacaaaagcccaacgcctgcagccagctggtaatggacaaccttttcaggaaaacttcaatgtccaaaattacaccttggcagaattattgaacatagcaaaaactttcaaagagcagccaatagaaagctgagccacatggatgatgcagcgaagaaaacctagcgtgaatgg

SEQ ID NO: 12602 - DNA, 9447 bp, Human
tggttaatgagtaccaaaaaaatacttagaatgaataagagctagtatttgatagcacaacgggggactatagtcagtaataatttagctgtacattgtaaaataaccaaaagagtataattggattatttgtaacacaaaggataaatgcttgaggggatggatacccaattttccatgatgtgattattgcgcattgcatggctgtaccaaaatatctcatgtaccccataattatatacacctactatgtacccacaaaaaatttttaaaaaggaatgaaataaaaacatttgagtttaagaaaaccacaaaaaaacaaagtagggaaagctcttcaaatactatgaaattgagaagacaactaaagaaaatattaataaagacaagaacataaataatttctttggcagaacataagccatcataatcagaagataaataagctgggaaaaatatttgtaactcatatcctagataacatactcattttccctgtatataaaaagtttctctaatgtgataaataaaaacacaataaaccagtaaaaaatgactactttgatatgaaggtatgaattcacaattcctagaaaatagaaatagctcttaaacatgtggaaagatgtgaaaccaaaatcataataagagaaatgtaaattaaaattactttgagttttattttactcacaatttcaaagaccaaaaagtttgagagtatactgtgtgagagacaatgtggaaccaagttctttcactcatttctggtgggagtagagattgatacagccctcatggaaggcaatttgcaacatataaaaatttataaaatctagggccagggacgttggctcatgcctgtaatcctagcactttgggaagccgaggtgggcagatcatttgaggtaagtgggtcgagactagcctggccaacatggcgaaatcccgtctctcttaaaaatagaaaaattagcctgatgtggtggcatgtgcctataatcccagctactcaagaggccgaggcaggggaatctcttgaaccccggaggtggaggttgcagtgagctgagatcatgccactgcactccagcctgggggacagagtgagactctgtctcaaacaaacaaacaaaaaatttataaaatctgatactttttcaccatggagtttcttctgtaggaatttatcctagagatatatttgtacatgtgcaagagacatatgtacaaggttaataaatgcaccattatttgtaatatcaaaaggttaataactgtcaaaacagccattaatattgtataaattatggtccatccatgcaatggaatactgtgtagctgtaaaaaaaaaaaaaaaaaagcaacaagcccgacatggaaagacttccaataaatagtaagtttaaaagaaagtgcagaataatacatatttatatgaaaaaagagtttttatgcctcaaaggccttcacccttgatcttctggtgttattcctgtccttgtattctcccagaatcattacctcatcccatgaatggtacagtcaagtcttgcttgttctgtgtccttacattctttagagagaagtcacaagagacaagcaaacatctcttttgctaataatattgatcacttcctacagcataatatctatgtgcaattttttgggaagacctcctactaaacagttaagaatggaaagacacaaagagaagaaagtggagaaagacctctgtcttcccacactggattttgcaaatacaactcttctgtgatacaggaaactaaaaagagggaaaagtggcaattaagaaaaactgccagaaaataaataccttgatgacccaatttggaaaactacttctagataaggaaacactattacccaatatgttaatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacaggtgaggtttcttccaaggagtaatttctcttatttgactcttttgagatccttttctcacataattgtcaaatttcaattggagagaaactgtgttttctacctcattacggggtcagtgctgaggagagtaggaactcaggaaatgcttcttgattgactttagtctgctgtattgggtgacaaattgaccacagaccaaataacacgttggaatcctcttattctttctagagatctgggctgagaattaagggtttatgcttcttcttaaaacccgtttcaatctttcatgcagttatgattctcatacaaacaaatggaaatggggaattagtctttcaaattcagtcctttggctggcacagtggctcatgcctgtaatcctttgggaggttgaggtaggaagattgcttgaggccaggagttcgagactagcctgggccgaacatacataccaagaccttgtctctaccaaaaaaaaaaaaaaaaaaaattagctgagtgtgatggtgcacgtttgtagtccttaatactcaggaggctgaggtgggaggatcacttgagcccagaaggtcgaggctgcagtaagccttaatcatatcattgcactttagcctgggcaataggaaaaaaaaaagaaagaaagaaagggaggaaagaaagaaaggaaggagaaagaaagaaaaggaaaaaaagaaagaaaaaaaggaaagaaattcagtcctcaaaacatagatctgtgtttttttttatgatcctctgcccctgtctttctttctcttcagcacaatgaggcttttcacaggcattgttttctgctccttggtcatgggagtcaccagtgaaagctggcgttcgtttttcaaggaggctctccaaggtaagaactctggaggatggagggcacatacccaggattcattctgagcaggggccacatactcactggatgtgagtgctccttagagaagccacacagaggtcagagcaggagtgtggttttctgtatctgtttcttcctctaggctggtctgatttatcaccctcccttggggtttccagacgagaggttaaagatgctttgggcccagcctgtactcttggtgtagagtgcagaaggataaaaacttccagggggtgatctcccactgcggaaatttacagatggcagatttctcagggcatgatgtttatttagctcatccacctcagggaatatactgagttcacaattatactccaagattgagacatgcctagcagagagtagagaaatcccatcctgtacccaagcaaatggccaatgcttgggatgcagagcttatgaaaattaagccctaacttctatccataaaataaaaagagcaaatttctactgattagccacaggagggctgagatacggctgggaaactgacttctgccattctggatgggaaacgaatcttattgactagctgttaaaatgggaaaactatgtttgtcaggttatgcaatactttgaacttcatgtgttgttattaattttgtagttgaattttttgtaatttttcaattgaaattttataaattttcattttttctgcattttgtgcttttaaaaatgatattctataaatagtttttaaaaagttttggtagcatgtactaagtttttctgcacatagtagagaatatcttttcccttaggtcagtgtatttcagaatttgttgtatggtccaccagcatttaaatcggccggggtttgttttaaaagtacactctgaagcctcttctcatagttactgagtcagaatcttagaagtgaagtgggactaggaatagcatttgaaaaactccccaggttactttaagcacaatgccaatgagaacaactgtcttgggtttttctgtcacccagtgacagaatctgtcagatgcttggagaaaactcttgctagtagatctggaaaacatagaatgaacataaagcatgcatcagagaaaggacagtcatgccatgccagagataaactatttgacaaaattacagacacaaaataatacatgaagttagtgagaaatatcccttagaacacagtacctaagtaacaattaaaactatttatcacagcttttcttttttccaagtgagttggtttaaagaacttggtaacacgtaaaccacagcagaactcaaaaatatttattgattgaacaacacaggcactgatagacattttctatagctcttcctggcttagacctgtttcaaacatctatttttccactaatctttttaaaaactttaaaatgatatataacttacatatagtacacagtatagcttgatgaggtttttacacatacaaacatccatattacaccatcagatcaagatgtcaaacatttcacacaccccggatgggtctctcatgccctcttccagttaacaaccctcacgaaaggtaactcctattcttacctctatcattgttgattagtgtccctgtgtttgatctttgaataaaagaaatcatacagaatatgtcttttgtatccggctttgtttcactcaacattacgacatactaatatacatgacagcatttgtcatgtgtattaatattttgttctttttcattgctacatagtattccattgtatactgatatcacaatttatcctacattattggataattaggctttttaaagttttatgctatcatggctaaacctgtaataaacattggtgtacatgtactttagtgtacataagccctcgtttctgttgtgggtatacactcaggaatggaaatgtagagtcataaggtatagtcatgtcaatttagctttcgtagataccagcaaacagcttcccaaaattgtaccaatttacacttccatgaacaattacgagagctgggcatgatgactcacactcgtaatcccagcactttgggaggctaaggcaggaggatcacttgaggccaggagtttgagaccagcccgagcaacaaagtgagaccccatctctaccaaaaaaaaaaaaaaaattagctgggtgtgttattaggtgcctgtagtcccagctactcaggagactgaggtgggatgatcacttgagcccaggagatcaaggctgcagaaaaccatgatcacaccactgcactccagcctgggtgacagagggagactgtgactaaacaaaacaaaaaacaaaacccaaaacaattatgagagttccagttgttccacatttttgcccacaatttatattgtcagttttaaaaatttttatcattctgttgggtgtatagtggtatcttattgtcactactgcccttcactaataggaacaggaatccaatttgcatcaagtattccaatatgctaggcattttatgtatgttacctcattttatcttctcatttagtccaccagggaggtaggtatgattccccccaactgaagaatgtggaaactgacacttaattgtcagggcagagagttaaacatttacattcatgcccttcatgataagtctgattatccaggtcctatgaagctctctcaggtcattccacctcatcacgtactgcccattccctcggctttcttgtgccatttatgcccatagcagtcagatttattcaagtcctagttgtcctcactcagctggtaaggatgtatttttcttatgggctatggtagatgtgcagccccctcctcttctcaccaagtcccttgtaatgtccctggatcttacatctgtagtactattctccattgtgacattcctcacatgagcatcccctctttgtacacagtacacacagacccatgtaagatgtagcccagggcatgacaactgccaaccaattcaattcaatgtaatccatggaaaagcattcctcacatgagcgtcccctctttgtacacagcacacacagacccatgtaagatgtagcccagggcatgacaactgccaaccaatacaattcaatgtaatccatggaaaagcaccttccttacagttactcagggaagctgttcacaggaagtaatgtttatctccacgtatgatttcaaaggattattttgtcaagggccaaaatctggaaatcagtggaaaatgttcatttctacatttctccagtatgtcactgggttcatttttgtcattttttttctttccaggggttggggacatgggcagagcctattgggacataatgatatccaatcaccaaaattcaaacagatatctctatgctcggggaaactatgatgctgcccaaagaggacctgggggtgtctgggctgctaaactcatcaggtaacacagattcccggggactccagtgagaggccagcagtgcctatctgtcttgagagtcaggagaacctgtggctctttcccctcctccacatactcctggggtctgggtggctggcagagccagagcaaggctggtgaagacatgtctcctttcacccacaagggaaagtaagaactgaggagaggtcttgaaagcacactgttgcaggggctgggtgcaggggctgggtgcaggggctcacacctgtaattccaactctttgggaggacaaggtgggaggatctcttgggcccagggatttaagagcagcctaggcaacatagcaagactcttatctctacagaaaataaaagaaattagccaggcgtggtggcatgcaccgtagtcccagctactcaggaggctgaagtgggagatcccttgaacccaggaggtcgaggctgcagtgacccatgattgagccactgccctccagcctgggcaacagaatgagaccctgtctcaaaaaaaaaaaaaaaaaaaaaaagggaaagcactctgttgcagagcgcaaagtatcagtagacttaggcctttgcccaagaagattgatagttttcttcccctttccttgagttttccagcctcctctcagtcattacttgggtgggagaagaggagggagttagcaggtggagctgtctcaggtgagcaggtgagtcaagagattaatctcctgtctcctttctttgggttgcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattgaatttgttggtggaaactgggaacattgaggcagactttctgggaagaatggtcatctgaggccatatggaagataaacagcaccatggcagatgagcctgtgactgagggggaccaaggactcccagctggcctgtaactatgcaggctcctcacatgacccaagccaagcttctctggtcattttcggccccagcttcccctcctgagtaagcctaagccggcaaagcactgaccatcatcctgggcttctgagtggctggagtcatggctctggcacagccctgggcagtcttccatcagtctcctctgtatctcagattggacttctacccccaaattcccacttcttcttcagggcctcacagtttattttgttgcagtttccaggcctctctgtatacagactttgtactgcccaattcattgcatcctgtccactctctgcctctaggccttgtcccccagtgagctctttccttatggagaaggtacattgtgggctgagtgtggtggcttatgcctgtaatcctagccttttgggaagctgaggcaggaggatcgcttgagcccaggagttcaagaccagctaggcaacatagtgaaacctcatctttactaaaaaccaaaaaaattagccagacatgatggcatgtgcctgtattcccagctacttgggaggctgaggctagagtactgcttgagcccaggaggtcaaggctgtagtaagctatgatcactccattgtactccagcttgtatgacagagtgagaccctgtctcaataaaaacaaggtacgttgcttagagaagcctaatcctaggagttctatcctagaaactgctatcttggactctggtttctttctttctttctttttttttttttttttgagacagagtctttctctgttgcccaggctggagtgcagtggcacgatctcagctcactgcaaactctgcctcctgggttcaagcaattatcacacctcagcctctggagtagctgggaccacaggtgcgcaccaccatgcccggctaatttttgtgtttttagtagagatggggtttcgccatgttggccaggctggtgtcaaactcctggcctcaaatgatctgctgccttggcctcccaaagtgctgggattacaggcctgagcccctctgcctggccgactctgatttatctcttatcaacacccgtgcctcccctgactcaatttttaatttgtcctgctcattttacctaaggaatgactctcctgttggttttccttatctttattctcttttttttttttttttttttttttttttttgacagagtctccctctgtcaagcaggctggagtgcaatggtgtgatctcggctcactcaacctccgcctcccgggttcaggtgattctctcacctcaccctcccgagcagctgggattacaggcatgggccaccacacctggctaatttttgtgtttttagtagagatggggtttcaccatgttggccgggctggtctaactcatggcctcagctggccaaggttctgagaatgtaggcctgagccactgcacctggccggcatctcgttggcttttagttcggataaaattctacttcctgtcctaaaggggaagtgagatatgtagatagacaacacagtttagtaagagcctcaacagaagcacacactggtggcaatccaaattttgctggggtatgggaagtcagcaaatagtaattagaatagctgccatttttaattgcaattgcaagactgtgccctacagtttaaatactttatctgatttaagctgcagagaaggctttgatgttctcagctggataaactgaggtttagagaggtttgtgtttaggaccttctccaaggtcacatatgtaacaggtgcagagccaggactgcaggctggtttgtctgacttcagaacctgtgatacactgaacaaggccaagaggttcagcagtggagacccctttcttct

SEQ ID NO: 12603 - DNA, 5376 bp, Human
accacataggcatggttcaaagcagaactgaaggaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaagagggaatcctccctaactcattttatgaggccagcatcatcctgataccaaagccgggcagagacacaaccaaaaaggagaattttagaccaatatccttggtgaacattgatgcaaaaatcctcaataaaatactggcaaaccgaatccagcagcacatgaaaaggcttatccaccacgatcaagtgggcttaatccctgggatgcaaggctggttcaatataagcaaatcaataaatgtaatccagcatataaacagaaccaaagacaaaaaccatatgattatctcaatagatgcagaaaagacctttgacaaaattcaacaaccttcatgctaaaaactctcaataaattaggtattgatgggacgtatctcaaaataataagagctatctctgacaaacccacagccaatatcatagtgaatgggcaaaaactggaagcattccctttgaaaactggcacaagacagggatgccctctctcaccactcctattcaacagagtgttggaagttctggctagggcaattaggcaggagaaggaaataaagggtattcagttaggaaaagaggaagtcaaattgtcccggtttgcagatgacatgattgtatatctagaaaaccccattgtctcaggcatggttcaataaataggttttaggtgactccttgtggtttttgttcacttctctcctttctttaatttggcgattaagagtacattttttaattccttaaaaggtctgtagtacacatctttgagggcagcaaggaggaaaaacaccgaggggacttgattccactgtggaatctgtcctagcagagaaatgcctctatggattgggtggaaaagacagctctaaaaacacaaagaatataggtcaaacccaggattatataggaaaaaaaaaagagaggaaaaaatttcaggcttgaagaagagtctacaaatagcacaatgtggacagtctccaacccagagccaggtattattctctcctgtgaacacagaaagactcaaacccagggaggagaagtgacctacctgtgatcacaggacttgccaatgatagaactatgttcagtttctcattacttctagcaaattggcaaattatactaagggagtagaggtagagttgagttcatgtacaacaatatagaaatcagctaaagtggatcagagcaggaagttttacaattcagggaaaggttaagatagaaagggatcctttcccccaatcaagaaagacagccttggaccaccagttagagaatcccccaattttctctctgccataagtcactgaaactgagagctaaggcagggcctctgtgagtcatgagcacttaatccagcgggagacctcagaacaggatatttccttttttgagattccctgtcataccagttatggataaatttgcattttggatgggacattactggaccagcccattttaggcagttccgtttccccctgggtggggcagcaggccctgtgaagaggttctcagcctcatgactcctaaactcctggtacttgagcaccgatctgcttcggagaacctggtgagtctgcttacttgaatttctctgttctttgggccctcaaaagttgaatttaatctgaagacagaaagtatggttgatccaaacctctgatgacagttttgacactacttagtggatggaaccttaggattagatcataatgacacattgttttagcttttttttgtaagtagcttggtgttcatatgaacagcgaagttaataggaaggctttgatttgaggaagaggtaaaagcaaagtgtttttccttttttctatatctttctggtgtccttttcaaacatttgtgttttagcaggtgtgagagcctgcaattcttcccaaacagccctttgctctttgcccatcagcccactggggctttacaacagataatgatgataggaatagcttctgagattgcccagagtatctgaacttgtgactgcctttcatgaagtggttattttcatgcttgattctttataacagagatattttctttagaaaaattgcatgagaaaacacaggatttcccagggttgataaagcaatttgctaaagtggaaaggagaaaccagagagtcatgaaaagggaattaggagtttaaataattttttggagactggagaaatagcccatggtattacataaacgttggcttttctttgtaggagtcccttcctgtgaaccctgttatataatttctttcagattctgagactccagcaggatgtcttatcaacagtagcaatgtaagcagccctgccagccacctcctgtgtgccgcctgccaaagcgtccagagccatgtccacccctgaagtgccctgagccctgcccaccaccaaagtgtccacagccctgcccacctcagcagtgccagcagaaatatcctctggtgacaccttccccaccctgccagccaaagtgtccacccaagagcaagtaacagcttcggaattcatcaggaccacgaaaggatagggataattggctcacctcgttccacagctccacctgcatcttctcatcaaagccatccagggatacacagggagcttctttccccttagcctgtgatctgcccatgatgatccccgacagcaaaatgtttcctttctgaggctgccatgctgccactgtccaggtggagactgagcaaaggaagtcctcagctgtaccggcctttcagagcttctctttgggtgccatcaaagaattattttgatgtcttctgtctctgtctgtcacctggcatgagcttctactatctgtgcaattgtcacttttctttcactccctgaataaagtagctatgcctatatttttgtgaatggatatttcatttctgtttaaacctactttattaacaatatcatatgatcatttggatttatttctatctttcgttggtccccaggaccaggctctcatgattattgtaggaattttgggtcatactaaagattatttctgtgtgattttaaacccgttttattttccttagttagtgttttgattgattcaaggaacatattattcaacttccccaaatgtcagtctctttactgcaaagtgagcaaaataacatttacataacaaagctagtctaaggcataaaattgaattactatctgaaatttggttggcagaatgcttgacacataattagcagtcatttaattgaggtttattagcaggaatatatcatccttgtcttcatcatcatcatcattatcatcatcaccagcatcactacaccactacaaccaccaccatagttgctccagcaagagagtagcttggatataactaatacaggaaataagaagagtctctattgctattttttaagaattcataatacttgtatacaattacggggtacatatgatatcttgttacatgaatagaatgtgtaatgatcaagtcaggatatcaggaaatttagactatccatcgcctggggtatttatcatttttctttgttaggaacattttaatttttctctcctagctattgtgaaatatagaatacattgttgtaaactagtcaccctactctactgttgaatattaaaacttattccttgtatctttttgtttgtacccattaaccaacatcccccccatcccccacaaatacctttccctgcctcaggtatcttatcattctattctccatgatatctatctccatgatattgacttttctagctttatatgagtgagaacatgagatgtttgccttcctgtgcttgacttatttcacttaagataatgacctccagtttcatctatgttgttgcaaacgacatgatttcattcttttttgcaaccaagtagtatttcattgtatatatatactatattttctttttccattcattcgttgatggacacttaggttgatgggcacttaggttgattacacatctttgctattgtgaatagtgctgaaataaccatggaagttcaggcatccctttgatatactgatttattttcctttgtatacacacacagtagttagattgctgaattgaatggtagttctatttttagtattttttgtgaaattgctattattacctgtgcttttgaagtcttacccgaaaaccccttgcatactcttacatcatagagtatgtttcctgtgtgttcttctagtagttctatagtttcaggtcttacatttaagtctttaatccatattgagttggctcttgtatatgatgagagatataagcccatgtttcattcttctgcgtatgaattccatttttttctgaacaatttattgataaatttgtcctttccccaatgtatattcttggcatctttgtcaaattcagttggttgtaaatatggaggtttatttttgggttctttattgttttcctttggtttatgtatctgcttttatataatagcatgttattttgttgaccatagccttgtaacatattttgaagtcaggtagtgtgatgcctccagctttgctctttttgctcaggattgctctggctattcagggtgttttttggttccaaatgaattttagaattttttttttctatttctgtgaagaatgacactggtattttgatatggattcatttaatctgtagattgctttgggcagtatggtcattttaacaatagtagttcttctgcttcatgagtatggaatatctttcaatttgttttagtgttctttaattttttttatcagtgttttgtagttttccttctaaaacttttcatctccttagttaaatttattcttgggtattcttcttttttgtaggtgttgtaaatg

SEQ ID NO: 12604 - DNA, 20022 bp, Human
ttcaaattctcactgaactttgattttgctaaataaggacattaaaaaaaaaaccaaaaaactccactattgcctattgccactatttgattttttaaaaaataagcgtattttagcatctaaaagtaggaaggacctcaaataaatgagtctttgttcttggccagggaaaacagcgttgtcagaatttgataactgtttttctagggtatgtgctgttattcagttaaaaccttgcctgggacgctagcattcagtaaatacttgttgaataagcaaatgaaacttaagcttctatgtatagaaacctaagtcacttcacattctgattagcagagtaattgaatattcttttcaatgtgtagctctatccccagaaccacagaatattggaactgtaaaggccatcctatagtttaaccaactgcgttaaatagataatagaaagatgtggtatgtggcagtgacaacttgaaggttgtgactagaactcgggtctctggagtgttctattatatcacaccaagctggtcaccagcccatgtgttgatcctccattgtgatagcaacaaagaaaagacttcaggacattctttcctttaccctaatccttgatctgcagtcttatttagaaaagcttaatgttaaagatctagtttattcaaaactaaagataacaaggagtatgagaatttctatttcggagtgtaaaggaggagatgtttccttggcttctctgagcctgcaggccttccttgctctttaaggaagtagagagagggaggaaagtaaagtatgcttttgttttttaaggttactttgctgggagtagtttgcatgccttttggttttcttgggtggaattaactgacttaagttttaagtagttgggactatttaaaaacaatgcctatccaatgtttgccataaaggcagagggtattggctttagaagttaattcttctccaggagtgaaaattagcttctaaaccagaagcagcagagctaaataaagtaattttccacctggccagtgcatgatgtgaaaggtagattaaaaaaatgagagggcccattttctgatgaaagactaagccatgttgaaacagccctgttgaggattttattttaaatctatacattcacaaaggagctttgtgtatgtctttccctatttgttgtttggactaggaagccccacccagtgcttgttgaaggcagaaagtcgttgaaagcaagctgggatttgaacagtggattgaggtttcgaatatccagtgaaccaaaatatatcagggttcccctggccaagatgagtgaccattctgaggtgttaagtatttcttgaatggggattttaggaaaagtttctgtatttctgtgctcattttgttgacctctgtatgtgcaaaatctctaagggggtgtttgggcacttagatttcttggatgcagatttgtttgtatatgaaacaaattttaaattgttttgtatacactggatttaaaatagtttactaaagtgttttaattttttcatcttaattttcacagttcttatagtctttagatttagggaggctgttgatggcatccacatgtgcattttagtggcatttaaaatgtattcagctgaatttaacaatttctgacctaaaacttgacattttagatttaagtcggtaaagcactgatttaaactggattttaactggatgaaattctgatttaataagtgtactgactggataaaatgccaatgatttaattaacaagcacgtttaacaggatgccctatatattagttaaaagtgaagcaattgaattaggtaccttctctgctgcgtggaaaagaccgtatgactcacccacaccagccttctcttcgctctgagtgtagctaaccgtttctgttttttttcctctagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctgggtaagctgccctgtctccgtcccgtgctgttccgcctgtgtctgtctgtctccccgtctccccctctctattcccatctccagacaacgctggccaggaatggggtttggagagccagagtcaagtccaggctctttttggtatcactctgtgtaagtcatttaacctctcagggccttaattttctcatttctgtaataacagggttgagttaagaggtctccttgttctgaaaatatatatatattttttaaacgtgtatcgttttgctcacaaaacacactttaaaaaaaaaataacttgtgcatccagcccaaatgcactgcttcttaactggggcgattttgttcccaatcagtatctggcaatgtctggaggcattttggttgtcatactgtgtgtgtgggtgtgcctgctggcatccagtgggcagaggccagggacactgctcagcatggtacagtgcacaggacagccccatcatcaaagaattatctggtcccaaatgtcaatagtttgagcattgagagaccctagccttcacttaagtttttctggcgttcctgatctttttctgtagtgaatttctagtggccataaaaggtactgggagtgatgatcaactagagccaggaatattatttgggcagccgtttggtgctgtccaaaaccttgtcctttctgtctggcaagctagtatccatttataggtacctcaggaacccaaatgatttgtcataaaatacaaggaatgtgagcacactgaagacatttttaagaaggctcatttgctcagcagaattttcagtgtactagtggcatttatagaaagagaaggtgatcactgaaggcatgctcacataatattcctgagccctggtgggcgttatctagggcaaaggattccacctgtgtttggagttgcgcccatcctcactgtagccagagcttctcctatcagagtttagtattttgtttgaatagaggatcttgctgcttaaaacagttgaaaagaccctgatgggcaggccgtaattgacaagcgaatgatgggaacatgaatcggtcttagggaagcatctgtcaaagtggtcctcggttaaaacaagtgcctcctcctctcagtgtcacttgattgtgtgcttgaattcttcggaaaactgggtgtatgagacccacgatgaatttgcccacacgattgattggactcttccttcacctgctcttcagccagtgccagttccttttctgatcatgtgattgacgtgagaactgtagtctgtatatcaaatctttagaatgtttttgagtttcctgggacacaggaaacccagcacttagcatactacaaatctaatgtcttaatggcatcataaaaagaggctttaaacacagactccagttagctaagtggtttctgctagtgccggtactgttgcaggggccctgtgagatgccccagttccctgaaagaaatgaaaaggccagttaccggtaggtggtgtggaaaacatgggctagatcatcaggcaggacagaatgcctggctgtgggtgggagcaccccagcttggcgttgagttctggttctaccactgcgttgttttgtgaccaattatgagttgcttaacctttctttgctactatttccctgtttgcaaaatggttcattgacccctgtcttccacctcccaaggacaatttcaacagcctatttgtaaaaagatcacagtcctttaaaaaatataactgtaaagtcagaggtgatgcttgaaagagcaggaaccaggtagatgtggaaatgtcatgtcctttgttctaaagaaaaggcatttcatagctttttggatatgacgcaacataccataaatcctgacacatagttgggagtcggaaattgcaacaacgcccagttataaacccagctagtttgggtatgattgtaagaaaaaaaagctggccattctgtatttggggaattgattttcctaaacttatattatcttagtagtctagatttatcatattgtactatcatcctggcttttttaagacttaagaagatcaagtaaatttttttttctttctttagacactatatagatcatcaagggtgtctgtcttacaggtggatagtgatatgatctacagtgaggggacatttatttaaaacttaaacattcatgtgttttgggggtggtattttaacggcagcacctctgattgtcttttggagggctggtgtgtgtttgaagttctgtcctccttccagtggactctaacttctcctgatgcacgtgagacacattgtcctattgtcctgcagaaactaaagccaaacactgtcatttggggacaggttttcatttgtcagatctctttcgcccacatgagtgtttgtggacaatacagcctgctttccaaaactttgctaaattttgacagactttcctaggtgcttgcccaatgccagactttcttttctgttgaagattaagttgtgcttgctgccctctagtggtcagttgtttaatcctaaccttaaacggcttatttttcccctggtggttgggaagttgacggtttgtaattggctcatttttctaaattattctgaagaagataatttttcccgccagtatgtatgtccaccttcagtttgccagatcctgcctgctcagagacactgagaaccggaagctgcccgggcaattcagtctatgaaatgatctttcttgtgattaaggcaaacgaagaactgaatgtttaatagtgtactctgctgtacccagaaaaaaacaaaacaaaatcatgttataacactctaaaacttcaaacaacctccaacagcatttggtgtgtgtctagccgttttgttctaacccgatgttatataaaagaattttttcatgctttccaaaaatgtttatgtcaagaatatttaagtcagcatgccttattcaggtacttcagctaccttcttatataaatatttttgtttttcctttaagataaaaatgatgatggaggaaaaataaaacatcttacatcttcaagagagtgtagttattgtggaaagtttttccgttcaaattattacctcaatattcatctcagaacgcatacaggtaaagaacttttatttttttaaccatgcattagttaaattatgtagttatctaatttttttgttgttgttgttcagatactctgccagatccttggactagcttaaggataaatatgtagcatgttgattgcagtggttatttttattcttttagtgccattgtaacttgagccattgttcttatttgcagttcatttcttttctttcttttttgttttttgagacggagtcttgctctgtcacctcggctggagtgcagtggtgcaatttcggctcactgcagcctccacctccctggttcaagcaatactcctgcctcagcctccccagtagttgggattacaggtacctgccaccacacccggctaatttctgtatttttagtagagatggggtttcaccatgctggccaggctggtttcgaactcctgacctcaagtgatccgctcaccttggcctcccatagtgttggcctcccatagtgctgggattacaggcgtgagccaccgcgcccggacaaagttcatttgtttagtttatgactgctatgtcctgactcttatcttattaaaagctacagtattttaaaatgctgcatcttatgtctttatgattgagaatgaaatgagaatctatttagtagtcttgagattgtgaaaggagctatgacatcatgatgtaggaggctgcgtagatttgaaatttcatctcttccacttactatctgtgcacccttgggcaagttatttaacctttttgtgcttttagttttctttgctgtaaaagtagaataatacatatttccctagggctgttaggaagattaaataagttagaagtgttgctgttaatttttctattgaagataggcattcataatttcaaatattcattacagtaaggatgataaagaactgatgagaaatcctatgtgatagtagatcgagaaagcaaaaggaggaaagaagcctgttttcttaataaatagatatttgatctatttcagtgcttttcatacacttctataataaagtgccatttcttgccttaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtattgcatgaggggcgtcgtgtttaaatggctgcctacagtgattaatagctaatccaggcattctcagtggagatggtaccactcccaagggtggggggtaggcagccagaagttcttgggggtcacagagagaagcattcttagatacggcagtggtttgtggtcctccaaggcttacttaactctgtgggtttaactcttaaccctgtgtattttattcttttgatttgtttagtcttactttatttttagagaaagggtcttgctccgtcatctagattggagtgcagcggtgtaatcatagcttactgtagtcttgaattcctgagttcaagagatccttctgcctcagcttcccaggtagctgagactatatgtgctgctaccatgcacagctgatttttaaattttttttgtagagatggagttgcccaggctggtcttgaactcctggcctgaggtgatcctcctgcgttgacctcccaagtatcttagactacagatgcactccaccacgcttggctaacttaaatttatttttttgtagagacagggatttgctttgttgcccgggctggtctgaaacccctggcctcaagtgatcctcctgcctcggcctcccagaatgccagcattacaggcgcgagccaccatacccagccttattcttgagtaatttttcttgtcaattttatttttctgttgtgagagtgatcatggaaacagtgggtgagaacactggtctgtctagtccattcttgtcttgctgttgaaattccagatgcagccagttgaggccccagcttgcctcacttcatcacagccctttttcttcctttgcacatgtatggtgtgctcagtagtcagtgccaatccacctggagttgcgggggttttttttttctttctttctttttttttttttttttgagacggagttttgctcttgttgcccagcctgagtgcagtggcacgatctcggctcactgaaacctccttctcctgggttcaagcaattctccagcctcagcctcctgagtagctggggtaataggcacgtgccaccacgcccggctaattcttgtatttttagtagagacagggtttcagcatgttggccaggctggtcttgaactcctgacctcaggtgatgcactggcctcggcctcccaaagtactgggattacaggtgtgagccaccgcgcccagcctaggggttcttcctcacgcattttaccattccctgctggcctgtaaacttcttaagagcagaaaccatgttttacatgtacagcatcaagtcacatgcttcccacacggggcagaatagggggcgcccagtaaggaccacacgtggacccttgacctggcaagagcagaaagcaaaagaacttccgattaaagagtcttgtgaaccgttttgctgttaaatgttgtcagccctccatatccttgggttctgcctcagtggattcaaccaactgcgggactaaaatatttgggggaaaaatggatggtcgcatctgtactgaacatctgcagttttcttttccttgtcgtaattccctagataatacagtataacaactatttacatagcatttacttcatattaggtattataaataacgaagagatgattttttttttttttgagatggagtcttgctctgttgcccaggctggagtgcaatggtgtgatctcagctcactgcaatctctgcctcccaggtccaagcagttctcctacctcagcctcccgagtagtttggatgcaggcacccaccgccacgccagcctaatttttgtatttttagtagagacggcatttcgccatgttggtcaggctggtctcgaactcctgaccttaggtgatcctcctgtcttggcctcacaaagcgctgggattacaagcatgagccaccatgcccagcagtgtagagatgatttaaagtatatgggaggtgctggatgtggtggctcacatctgtaatcccagtactttgggaggctgaagcgggcagctcgattgaggccaggagttggagaccagactggtcaacatggtgaaaccccgtctctactaaaaatacaaaaattggctgggtgtgttggtttgcacctgtaatccgaactgtttgggaggcttaggcatgagaatcgcttgaaccggggatgcgcagattgcagtgagtaagtctagattgcactgttgcactccagcctgggctaaagagtgagactctgtctcaaataaataaataaataataagtaagtaaagtatatgggaggatgtgaataggttacgctacaatactgcaaattaatagtactacaaggccagttgcggtggctcacgcctgtaatcccaggactttgggaaacagcctgaccaacaatggagaaacctcgtctctgctaaaaatacaaaattagctgggtgtggtagcgcatgcctgtaatcccagctactccagaggctgaggcaagagaatcacttgaaccttgggaggtggaggttgcggtgagctgagattgtgccattgcactccagcctgggcgacagagcgagactccatctcaaaaaaaaaaaaaatagtactacagatactatgaatactgcagatacgacactgttttatattagggacctgagcatccatggattttggtatctgttggctggggtggtgggggcgggtggtcctggagccagtgccctctggatactgagggacaactgtattaatttaaaaccaaccttatttcccccataggtagattgttaacctcatagatgactggggttttccccatagaaatgtgtcctggtggtgtcacttcgtacaggtgtctggcacatacctgtatgtgtaaaaaagtagctcagtgtcccagggacatcttctccttggcaaactcggtcaaactgcagcatcttcctttatcacatagaagctctactggtttgtgctccccaaagaaacagattcagttttgcacatttcagtttgtgttagtttcaaactgaggattctgtgtggtgacaacactctgtcaagaattgcttgatgctgattggttcagtagagatagcaaattaaaaaacaattgctttcagacactccagtagattttataaaaattgtgatgaaatagtaatttttactgccttttggttaaaaatcttcatttccccccccatggtgcttaaaatggacatgaatcaaaactttgtctttacttaaagggggaaaaggctctgtgtgttgcaagtcagatcctcttttttttttcccctcctctgtgagacagggtcacactctgttgcccaggctggagtgcagtgggggcaatcacggctcactgcagcctcgacctccgggactcaagcaatccttccatccttccgtctcagcctcccgagtagctgggactaaaggtgcatgtcaccatacccagctaattttttatttttagtagagaagaggtctcaccatgttgcctatgctggcaaatccccttttaaatgattttaaaaaaagcaaaaaacaacacttttacatagtttggttcatgatgcatatacgtttcaagtattttgtgatgtcatttttttccggctttttaattctttctagtgacagcccagacaattttaatgttagtgacatcaaccaaattctgtgctaacaagtgtcataaaaacaattcagctgtaactgaaaacacttgcatgcgactgtgtgacttaggcgttgattacattatcagtgtcagaaattttgaaaattgacttctaaaaacctatacacatcttacctaattgtttgaccttaactctaaatatgttttttttttcaatcaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtgagcatatgtttcaattaaaaacactggattggctgagtgcggtggccatttgggaggtcagggcgggcggatcacctgagatcgagcatttgagaccagcttggccaacatggtgaaacccctgtctgtactaaaaatacacaaatttagctgggcgtggtggcgggtgcctgtagtcccagctacttaggaggctgaagcaggaaaatcacttgaacaacccaggaggcggaggttgcagtgagcagattgtgccactgcaggtctagcctgggtgacagagcgagactcagtctaaaaaaaaggggggggggggcggggattgattttacttgatcggaaataaaccattaagttgtctaatataatgtaacaaaattgcttttaagttggattttgattttttaggtgttttaaaattagagtcctcaggatctttggatattactgaagataataggaaaacagtcatagtgactggaatttactgagcatttactttgtgctaggcattgaatgaagtgttttattatcaggatctcatttaattctgttgcagcagagggcttaggtaagggatgagcaaactagcttttcatgcatcatcatcaataaagttttattggaacatgatcatgcccatctgttacatattgtctgtggctacctccttgctgcagcagcaatgtcgggcagttgtgacagaccacgtggcctgcaaagctgaaactatttaccgtctggccctttacagaaaaagtttgtgacccagcattaggaggtactgtgcatgcttttcagatgagaccgaggcatggattatgcagtttgctcaaagccccgctctgcctgtgagaggcaggagcctggtttttgtcctaggtctgcaaagatccaggctctatgcccaacgttctagtttaagaacttgttcaaagacttggcaagtacttatctgccaagataagtacttatctgccaaggaggggaactgggacaggagcaagtatgtgagcatgtggttcacatgttaaaggtctcactgtagtgcaccgccgtcccgtaaggctcaagtagtagtatcagaattatgcatgttggttttgttagtttatatttagttaattagtttgggcagaaggtgtgatgtctgtgtacaggttatactatgactcattcaacaataagattaaatggaaagcttggggctcacgggcagatttagttgttcctcaggtaactcttgtcccgtaaaaccgtcactgtatattcgttgagcagcctcttcaccaagtgcctgctggctgctaggatacgaagatgaaaagatgctcgtggtccaggacagaatttctctgtcatattttcatcgggactcatatgggaactgagatgacgttctccctgggcagcgtgagccttgtgtggttctgcagtcttttctcctgcttaggataatagatgaagaacacgagggagtaaagctttgtcatcacaggaataagatccagtccactctatattaaaacataaaaataatttatgaattatgaggagcagattttagtaacaggttactcgaagcatccattacaactgatcagtagtagcaaacagccatgctcctgtatctggagctggtgtctctctgggagctctgagcttctctgcttgtgtttccttcatctggagaacatcctgcctgctctgtctttgctttccagcctcttctttctcatcctctggaccagctcacatattggttttgtttgtctgagacagggtctggagtgcagtggcacgatcttggctcactgcagcctcaaactcctgggctcaagcagtcctcccaccacagcctcctgagtagctgggattttcttgtgcatggcaactgccttttactgaattctgattcttggttaagtcatctcagttaaattactaaaagtagctccaaagttcgcagcattatctagttagtcattctcctaatactttcatagcaaaagttgaacttaaatagaacccagggccaggcgcagtggctcatgcctgtaatcgcagcactttgggaggccaaggcgggcagatcacttgaagtcaggagttcaagaccagcctggccaacatggtgaaacccttctctactaaaaatacaaaaaaattagccgggcgtggtggtgcatgcctgtagtcccagctacttggaaggctgaggcaggagaatcgcttgaacctgggaggtagaggttgcagtgagccaagatcgtgccgctgcactccagcctgggcgacagagtgagactgtctcaaaaacaacaacaacaaatagaacccattgcatttctaggtcagtttggttctatgtattacgcttttttaaagaaagaattttctaaactgtattcagttttgatcttaatcatttaaaaaatgtttttttccttaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaatttttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgagttttagtgtttattgtgtttctggtttctgattttgttttatttaactttttagttttctttctttttttttttttgagatgtgctcctgctctgtcactcaggctggagtgcagtggtgcaatcacagctcactgcagccttgaacccctgggctcaactgatcctccagctctcggcctcccgagtatcgagccatcatgcctggcttataaacacaattttaaggccagcacgtggctcacgcctgtaatcccagccctttggaaggccaaggcgggtggatcacttgaaaccaagagtttgagaccagcctggccaacatggcgaaaccccgtctttactaaaaatacaaaaattagctgagtgtggtggtgcacacctgtggccccagctactcaagaggctaaggcatgagaaatcacttgaacccgggaggcaaaggttgcagtgagctgagattgcgccagtgcactccagcctgggcaacagagcgagactccatctcaaaaacaaaaacaagaaaaccccacactctttttcttttttctattttttttttttttttgagatagggtcttgctctgtcgcccaggctggactgcactggcgcaatctcgcctcgctgcaacctccgcctcctggattcaagagattctcctgccgcagcttcccaagtatctgggattacaggcgtgtgccaccatgcctcgctaattttggtatttttagtagagacagggtttcaccatgttggtcaggctggtcttgaactcctgacctcaagtgatccgcctgcctcggccccccaaagtgctgggattacagacgtgacctaccatgcccagcccaccaaccttcttccttaggattttagctgccattgatgttgcaaaagtcacttttaaagacttcttaaaattccacatctgttaattgaaattctattaagaagagcttccttatgattatttggttaccctgaaacacagtttcaaccaaaaaaaggagaaatgctcgttttgtttgttttttattcctcttgattaccagctttgaggatgagttggtgccagcattctccagaggtgacccaggaataagcttttacatttttggtatgagctcacaagtcttatacacttgatgtgttgagagcatgtggtcgtcattttgatgcctcaagtctcttgtttttggtcagtgggagttccaagttggcccagtgtttgcaggacaaaagtctgaaggcttcttaactttttgttaaaacatgttctggctgggcatggtggctcacgtctgtaatcccagcactttgggaggctgaggcgggcggatcacctgaggtcaggtgttccagaacagcctggccaacatggtaaaaccccatctctagtaaaatacaaaaattaactgtgaaaccccgtctctactaaaatacaaaaattaaccaggtgtggtggcaggtgcctgtaatcccagctactagggaggctgaggcaggacagttgcttgaactcgggaggcagaggttggagtgagccgagatcgcaccactgtactccggcctgagcgacagagcgagactcagtctctaaaaacaaaccccaaaacaaaaccggagatgatccaaatcccacctgtactgacccacacctgggaaccgtcatttatccaaggatcctgggttccttttatgggaagcggtaattagggcagtttgggcgcaaggggcatttagtcctacctgggtggttgtgctcctggcctttttaatgtagggaaaggaaataaatattatcaaaaaggaaacctcagtgaattatactgctatttccaactcacgttttagagttttctttgattttgtttttgattttctgaaaagctgggttcctggctttaacctactgtatataacagaaacaatgccaatgttattgctcttatcactgcccaatgaacctttcagatttctcttttgagtt

SEQ ID NO: 12605 - DNA, 23458 bp, Human
tcccaaaatgctgggattacaggtgtgagccacagtgcctagcctttttgtttaagttttttgtaaagatagggtctcgctgttacccaggctggtcttaaactctggacctgaagcaatccttttggaggcttcagcctcccaaagtgttgggatcacaggcatgagccatcatctcggccactgcactgttccaatattgcttagctcaaggccagtgcttattgagctactaagaggaaaagaaaagcagtgtggcagtaggaatatagtttaaatgtagggtgtgtgacttaacccttgcctggcatgaccttaggtcctattcataatttggtatcttattgccactggtgtccccttgaccgcaagggggtccattcagttgttgggggcttaggattttaattttttttgagacagagttctgctcttgttgcccaggttggagtgcagtggtgcaatcttagcccactgcctcccgggttcaaacaattctcctgcctcagccacccgagtagctgggattacaagcatgcgtcaccatgccaggctaattttgtatttttagtagagacagggtttctccatgttggtcaggctagtctcgaactcccaacctcagatgatcctcccgcctcggcctcccaaagtgttggaattacaggcatgagccaccgcaccctgccaggattttatttttagtttacagtgttgagggttatgggatgcccagggcctggggaggaaggggacaggatgtgtccgtcctagtctgagaatgacttttttgagttcaaaagggggcggtggacgcaccaaggcacagtcctgagggcagcaggtgcaaaagtccggccctcccagaggtgtaaggccttagagggatcccaagcatccctggggctcagcctcctggacctgaccccactgcccactcttttggctggttccactctcccctgcatccctcacgttgtccccaacaggaagctgtgggaacctgttctcaggtgtagtgcacccgttggggttctagttggctggatccgcggggccgtcagctgcaactgtgacggcggggaagcgggacgggatggtgcggatctacaggacctcgcctccaggtggaacctacctgctgagccagggattcttcaggatacaaacccagtcaactccaggcagagggtgggagcgtcatgcaccggcgacacagtggaggacgtcatggacgggcagggaggcagcggcaaccgaaactagcggctcagtcggtggccggtgtgcggtcaacggccagggcagtgggaccggaaagactcagtgtagttgtcaactgttgctacctaaaaggttactccaaaactttaagcggctcaaaacaatagacggcgcgtacggggcctgcagcggccacgggaccgtgggaagcagtcagtacccgccacaggccgcgccttccgggttccgggttccgggttcccgccagggaggagacacgcccccacctgggcaggaaccaagcagagccgcgctccacccaggccggaaccaatgggagatgcgccacgacccaggccgagaaacgtgccgcttacccttcccccacgacctgcgccgcgtcgcgcgcggccgaatctcccgccaaagctgcccccgcccgccaaggcgcgacctatcagcgtcgcagaggcccgcggcggcccggccgcctcaatcccgcgggtgggggcaaccttttcctcaggcctctcctcagcccacggcgtccatctggctcccgagccgagggccgggcagtcgggcttcgcggctgcccgcggtcccgaggcctcgccctagccccagtcggctcgcgaggcgcgcgcagctgagtggacccctgcggcgtggcccgatggtctcgcccgacccggcgcgcgcgggaggccgaggggcggggcccggcgcccacataaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccaggtgaggccgggctgcgcggcgggcgagggagcgcgtgccccgtggggcgggggttgtgcggggccggggtgtgggagggcggaggttgtaaggcggtcccgaacctcccgtgcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagaggtgggcgcgggacccgggggtcggggcgcggtggggcccttgacgaggccgcgggctccagggacctcgtcgcgctctcgcggtgccgggatcggtcaggtcggcaccctgcgtccttttatcttggtctccgcgcggcccgtggactggggcggccgcagcaggcctgggaggcgctggaacactccggaagcctcttgccaggatgggagtcagctgaaccggcgtcagcccgagttagccagttcgagtctgtgttgtgctcccgggagaggtcagggtctctgatgagcttctcgtgaacacgtggaagtcagggacacccgagtcccgaggagaagtgagttgacagggcttacctgcttggccattttctgggttaggcagtgtgcagggagggtggagatgcgagcgaaaggagggcttgatggggtgggacggccgaggagggtctggaggaaataagcaggggtgccagtggtcgtagtggcggggcttttcggggctgtggttagagaaaacttctcgaggggctttggggtggctcgtcccgcactgggggcttgttgctcctgagttccctgaaaggcgtggtgacttggccgagatggagcagtgaaggtggagggaaatgcgtggttcgggataggcttctgaaggcaggacctgtgagacttgctgatgggttggggatgggaggcgtgaaaggaaaaaaaaaaatcggacccaacttcactgtgccaaaaggaaaaaattatgctgagcgcggaatcatgcaagaaactacctttgcgttactttttttttttttttttttttttttaaagacagggtctcactctgtctcacaggctggagtgcggtgacgcgatcttggctcactgcagcctccccctcccgggttcaagtgattctcctgcctcagcctccccagcagctaggattacaggcgcatgccaccgcgcccggctaactttttgtatttgtagtagagacagggtttcaccatgttgaccagactggtgtcgaactcctgacctcaagtgatccacccaccttggccacccaaagtgctgggattacaggtgtgagccaccgcgcccggccacctttgtgtttctttttttttttctaagcagatacctacagatacaagattaaatatctccacgggtgaactctgttcaccttaagtggcgacttactgagcacactaggaatacataattgactattcccctacctgctccttttctcttggaacatgtagatctttctccttcaacctacttttctcttttaaatattgaagccctgacagtcatctctggagaaaggcacagaccacagactctttctgtaatttcgtgttcttctaggtatgtccttaacattagctaaattcctaaagcaattgagacctgtctcagacactttttggtttacacaggaaagaggcatcaagaatgactcaagcctttaggtctgaacgctgttgattggggccatttgctaagatagagaagatgggctggagcagctaggcatgggaagttgtgaggcttgagaagctgcttagagaagcaaaggagatgtcaagaaaggtaacggagtgtaggagtctacatgggaggcatcttcaggcacagtgagttaccaggacatagagatgatatttagagacttgggtctagggggctgggcgcagtggctcctgcctgtaatcccagcactttgggaggccaaggcgggcccatcacctgaggtcaggagttcgacaccagcctgactaacatggagaaaccccattgttggggaccagcctcgacacttacccggaatgagaagagacaggttaagagctcataaaggtgggagccaggggaccagttggaaaatggaggctgcaaaaggcccggagttgcggtctccacactatttattgagtacaatcactttaagaagtaggccgggcgcggtggctcatgcctgtaatcccagcgccttggcaaaaggcgggtggatcacgaggtcaggagatggagaccatcctggctaacacggtgaaaacccgtctctactaaaaatacaaaaaattagccgggcgtggtagcgggcgcctgtagtcccagctactcaggaggctgaggcaggagaatggtgtgaacccgggaggcggagcttgcgatgagccgagatcgccccactacactccagctggggcaatagagcgagactccgtctcaaaaaaaaaaaaaaaagaagtagatgttcagggtgaaacagtgaaagggaggcaggcgtcataggcgtaattatagcggtttcaatgaatctcctttgtgctcaaacagcatatctaacttattggagagtagctagtgggagcgggcttaactaggagcctgcaaatctgtccacattccagtgctttaaaggaatgtctttcttcttgaacactgtttacagataagagagcaggtctcgctctgagcatgggaacatgatggcaattaggaggctttcctcctcagaggcctcttgtggcttttcacaacttactgtgccatatttttatggccagcttatacaggcactcgataagcctttttcccaacaccccatctctactaaaaatacaaaattagtcgggcatggtggcgcatgcctgtaatcccagctactcgggaggttgaggcaggagaatcccttgaacccaggaggtggaggttgcggtgagccgagatcacgccattgccttccagcctgggcaataagagtgaaactgtctcaaaaaaaaaaaaaagacaaaagacttgggtctacgggtgggtacagaagaggccctaggtccagatatgaagggaaggtaaacaaaccttattgagatcaagctctgaactctccagtggtctcatttagctgaagataaaaatattaaatccttacagtgctttagaagttatggaagtttttggtgtcctcattcctcaaactataggaatgcttctgtcctagggcctttgcacttggtatttgcacattgtggataatgcctggaggcacctgacaaatagagccagctcgttgatggataagatctagaagtactctttggaaggttgttagcttagtgtgtaaaattaggctttgttgtcccaagatagggtagattatgaatataacctacttaatctaagaaatggacttaaagataccaaaatatggcatgtagtatatggtcattcacatacacaggctttaaattattcttgtagttcaggaatttgttatgttggcagacccagacttgaacctcttgatacactagtgaggatgcttgtatccaatcctggacaaacctctattgagtcaatttaattttcagttaattacctaatttgatttcataactttctaccatttttagaatctggaaatttacttttagaaatccaatttaagtttatctgagttgtgtgactgtaagggaagaaatgataattacataagaggattattcatttgttactgcaattgcattttcaaagcacagcatttggtttacagctaaaataggttgcttatttgttgtaattaaagttagtatctagtgtatttttttgtgacggggcataactgtcaaccaggctggagttcagtggtgtgatctcacctcactgtaacctctgccttccaagttcaagcagttctcctgcttcagcctccaagtagctgggactacaggcatgcgccaccacgcccgcctgattttttttttttttttttcgtttttgagatagagtcttgctctgtcgcccaggctggagtgcagtggcgcgatctcagctcactgcaacctctgcctcccgggttcaagcaattctcctgcctcagcctcctgagtagctgagattacaggtgcgcaccaccacgcctggctaatttttgtatttttagtagagactagatttcaccatgtttgtcaggctagtctcgaactcctgacttagtgatcagcctgctttagcctcccaaagtgctgggattacaggtgtgagccactatgcctatcctaatttttgtatttttagtagaggcagggtttcatcatgttggccaggctggtctcaaactcctgatcttgtgatccgcccgcctcagccttctaaagtgctggggtcacaggcatgagcctgtgcacccggcccagtatctagttttaatgtcagtagtgatcaacagaaaaatggggtagaaaaataaaaatgtgagtttatgtctgatgtataaataagatacatcaatttgaactgccagaatttggggctcgaagccttaagcttttggatttcctgattattattttttaaattttaattattattttttttagatggaatctcgttctgttgcccaggctggagtgcaacctccacctcccaggttcaagtgattctcctgccttagcctcccgagtagctgggattataggcacccaccaccacacccagctgatttttgtatttttagtagagacagcgtttcaccatgttagccaggctggtcttgaactctttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactgcgcccggcctggtcttgaactcttgacctcaggtgatctacctacctcggcctcccaaagtgctgggattacaggtgtgagccaccacgcccggactattatttatttattcatttattttttgagacggggtctctctcccccaggctggagtgcagtgcacgatctcggctcactgcaactccgcctggtggatcactgcaacttccacctcctgggtccaagggattctcctgcctcagcctccctagtagctgggattacagacacgcgctgccacgcctagccaagtttttgtattttggtagacgctgggtttcaccatgttgccctggctggtctggaactcctgagcccaggcagtctgccagcctcagcctcccgaggtgctaggattacaggagtgagccactgcctggccataaatttcccaatattgactgaagactatcttgaacttgagatggaactgagctcctggatgtggtttaactcaagcacagggggtactttgccagtagacggagtcctgacacagcaaggactctgacatatactcctccatacacattgtaatcatagtgtacataacattctgaattattaattacatgcgcccgaaaggtaaatggatatgctagctattctgtattttatttattttctgagacggagtctcttgctgaggctggaggagcagtggtgcaatttcggctcactgcaacctccgtctctggggttcaagcagttctcctgcctcagcctccctagtagctggggcctactggtgcgcaccactgcacctggctaatttttgtatttttattagagatggggtttcgccatgttagccaggctggtctcaaactccttaccttgggtcatccacccgcctcggcgtccccaaagtgctgggattacaagtatgagccactgtcctctgccaccatatatatttttttgagatatggtcttgccctgttgcccagactggagtgcagtgccaggatcatggctcacacagccttgacctcctgggctagagtgatcctcctgcctgggcctcctgtgtagctgggactacaggcacgccccaccatgcttgggtatttatttattttggagatgacgttccaacctttttattaaaatcaacttctcacaatgtataaatactgcatattagcacacatgaaaaagacaacttctaaggcacccagaaatacgttcatacacgttacaggaccatttgcagagtggacaatttgctgtagacagtcagcattggataaatcagaagattatcatccctcagtactgtacccagtctcagtaaatatttacaacatggtgagaaggtgtcagctgtacctgctttataattctatgaagtactcagacttacagataattcagaactaaagacagtcccatgataatctgacaaaataaaacaagtagtctaaagtcttagtgattttggtgtgtgctacatccatgatcaaatccaaacactcctggggtgggctggataagtttttggtagcctgcttcattatcagaagtttgttaataagccttgccaatagaataccatttcttcagcatcagtcatttctcaactggttaatggatcagtaatctcatcatgaatgagaatggagagagaacagaagacaattcttctcacacttaacaggaattaggatgggtcagtgcagtctgggtacggtggctcacagctataatcccagtactttgggaggccgaggcaggtggatcacctgaggtcaggagttcgagaccagcctggccaacatggagaaactcagcctgtattaaaaatacaaaattagctggacgtggtggctcatgcctgtaatttcagctactcgggaggctgaggcaggagaatcgcttgaacctgggaggcagaggttgcagtgagctgagatcatgccattgcactgcagtcttggcaacaagagtgagactccgtctcaaaaagaaaaaaaaaaaagaatgggtcagtgcagaacaggaggaggcagacatttggcaagtacaggatcatactgtttagtatagacatgtctggaaaattcttaccctggaggttcatattcagatggaggagtctacactggccagataacctggaggaatgccagacctgcacttttattatatggatacaggcttgggactacacagcggaaacacccacctgagatagcctcaattagagacttaccttgcagagccttctcagtatgacagcgaatccctctgtatggccagccaggggaagcacgaggttgctggaagtgagtagttgctctgcaccgtcaagcatgcacacatctgtctagatgtgcccgcgatctgtgaaactcgggctttgttagaataatggaattctttggtggtcggttttatgaaaggcaatattgtcacaatcctgtcaacattgacattggtaatgacttcaagctgggactaatggcatagagacaaattaaatacaagatgggaaactctacactctctgaacttcttagagtcaacttcataagctccagcatcaggccggatgttggatcaatgagataaggttaacccatagaaatgccagaactgaagctgaaaactagatatgggtttttctgactgccacacacactgcaaaaatttgaagcaaatctcccatcttaatgactttataaacacataccagagatgaacgaaataagttgatttcagccatatgatagccctggactactgaagtgtggacacccaaaaggaatcataatttagtttgaagtctaaaatctagttggttttattagacccccaaacacagtgggcacactgccaaggagctccatgacttctgctctagtaagacagccctggatagacagatgcagctgataggttatgttctacatctagtttgcttttgtcctgctaaactccagtttagtatggtttgatacacatagttcactgatataatgcttttatttttttgggtgggggacagagatgaggtctcactatcttgcccatgctggtcttgaactcctgggttcaagtgatcctcctacctcagtttccaaagtgctggtattacaggcacaagccactgtgtcccaccagcctttgaatatttcttgacatacagtttgaaagaaaacaaagtatgtgtcatgggttcagtagcattttccttttattgcagctttaccactcctgaaggccctaaaccccgttccagatgctctgactgggcaagtgcagttgaagaagatgaaatgaggaccagagttaacaaagaaatggcaaggtacacattttggaccaccttgaagtgttaatctgtggcgttttcagtaacacattaaatttgatatttgtcttagaacagtggttttcaaaggtctgggctccagaccaaaggcatcaacatttcctgggaacttgttagaaatacagattctcagacccttccctgggcctgcgaatggggtggggcctggccatcctgtgaaaagccctccaggcgggtccactctttcaagcttgaagaccactgtcctcttggtggtaatccttccaagagtggaagtaggtgcacaatggtgttactgctggattgcaggctggaggactatcagaactttctttcttttttttttttttttttgagacagtctcgctctgttgcccgggctggagtacagtgacaagatctcggctcactgcaacctctgcctcccgggttcaagcgattctcttgcctcagcctcctgagtagctgagattacaggcacaggccaccacgcctggctaatttttgtattttttgtagagatggggtttcactatgtttgtcaggctggtcttgaactcctgatccgcccacctcggcctcccaaagtgctgggattacaggcatgagtcactgtgcccggcctaactatcaggaacttactatagtcatttgttaccaccgaccttctgtatgcggtgctcacacaacccagcacagtagatggagtgctctctccagatgaaggaatacattgacacttggcttaggcaacaaacagctcagaaatgccaacatacaaggaaaggtctcaaacttggattctgtgaacctcttgcagttgcacacaagattgttgtgtgtatccaagttcttgcaaactaagctacttcgtcttcgttgactcattacctaatgcatccttaaccatgtttaatctcccttgattatcagtgtgttgatcctttctcttttgatgagttgtctaactcaaacccagttgcaaggactgggtttattcaaacccagttaaaatgtggctcataattggttgaagtattttacaagataattttagccaacaagtggctgataaacagggtctcaagaaaaatgtgtcttgcgtgtcagccgcggaacgatacctagactacctgttttcattttggcagccagtgatggtatttatatcagcctcctttgaaaagggacgggaatatgtgggaattggttattgaacatttgggggagttatttgtcatttcttctggtatcaaaatgtgtgggtggatgtatgccttggtagaagaaatgaactaggagttcacagatgagagtaccagtgtttttagtgaattattgcatttatataggtcttgacttcctcaattataaaattagaatgtttgacttgacttgtatagtttgtgttgcatgcacaagtcttagaacagttcttgcataccgatagcctagttgctccctcaagtcaccccttgccaggggttatctgcagctcttattcatgcgtattccacctgtccagattgtcctgtgagtggaccctatttgttcttcagatatctcatgggtctgtgcctgaaaattgtcctgttttggaaaacagcactgtttgggctgctctgttgattataccctttgtgatggaaagctacggcttttatttacttacttatttttttgagatggagtcttgctctgtttcccaggctggagtgtaatgatgcaatctcagctcactgcaacttccgcttcctaggttcaagcgattctcctgcctcagcctctcgagtagctgggattatagctgtgtgccaccacgtccggctaatttttgtatttttagtagaggctaggtttcaccatattggccaggctggtcttgaactcctgacctcaggtgatttgcccgcctcggcctcccaaagtgttgggattataggcgtgatccaccttgcctggccaaagctgcagcttttagtgcaacctgtgtaatttaaactgctggccctttagtgagccattactgacaggccggcttacttcctgacagtaagagcggtatgaaatgtcagcttactatgctttaaggagactaacagactacaaactagcaatataagagtatgaaaatggattttctgcatggcatggtggctcacacctgtaatcgcagtactttgggaggccaaggcgggcggatcacctgagatcaggagttcgagaccagcctgacgaacatggagaaaccccgtctctactaaaaatactaaaaattagccaggcgtggtggcagcaacctgtaatctcagctactcaggaggctgaggcaggagaatcgcttggacccgggaggcggaggttgcactgagccgagatctcgccattgcactccagtctgggcaacaagagggaactccgtctcaaaaaaaaaaaaaaaaagaaaaaaaagaaaatggattttcatcatacctgaaaaccagtctttctcatctgtggtactggagagaatgaggccctgcagcaaatgatttgcaggactaatctctgaatcgtacaaagatggtgttatatagccagtgctactctagatgcacgggagataaattacttcattaccttctggcgtccaaactgcactgaacacctcagcaaacttgggtggattttagattttgagaggaggcacagtaatacatgacataatttagatacctgcatgacaggccaggggtggtggctcactcctgatctcagtacttttgagaggctgaggcgggaggattgcttgagctcaggagttcaagagcagcctgggcaacacagacctccatgtctccaaaaaaagaaaaaaatttttttggagatggttgtggcggcacttgcctggagtcctagctgcttgggaggctgaggtgagatgattgcttcagcccaggaatatgaggctgtggtaagccatgatcgtgctactgtactctagcctgggtgacagagtgagaccccatctcaaaaaaaaaaagatactcacatgaacttggagctcaaggtagctcgtggtttcaacgtcagattgcgctagactccttttggagatgtcatacttttttttttgcaaaactgcgttctggtaatgactgcaatagaaagcagatgcctcaggaagttcatgaggaacaagagaaaagggggcacgtttggtctccaggattggagaaggtatgcagtgcccagtaggcatatgagtcccattagtaagtttggtgtttttaaaataatttatttcaatttatgttttgtttttctttttttaaggctgccaagttttagggaatgtaaatttttgttgtgtggatctcactacttaaactgaacctgacaaagatttcttttggcccacggagcttctggattgcataggatggtgtgcctgcgggcatcagggtggagcttcctcagacctggctgctttatttttatatcttttttaaaaacagcaatatttattttgccctcagatataaaaggaaactcctcatcaatgactttggaagagagagaaaatcatcatcaggaaggtaaaggctgtgtaaatgtttcttttctaatttgatagacctgtaatttgttaaaaaaaaaaaattgtgactgtcagaaatgctgactgtcgcagtagcatttattaatacctttttcactaatttgaaatactgtatctgttgtgtactaaattcccatacatgcagtctccggactatttaggattcatatggttgggaatctggagtgaatcttccattattgtgttttgacattttcttggcttaccttacatacatggtgatcttaattgcagggcttattctgttaatctgttgttttttcagttctgattcaaaggagtctatgtctactgtgccggctgactttgagacagatgaaagtgtcctaatgaggagacagaagcagatcaactatgggaagaacacaattgcctatgatcgttatattaaagaagtcccaaggtagtcttgtttcagtggcatgtcttgaacaagctgtgtggcattgcgtttctaaagagttgcttagattgggtagtacaaatgatgctggggatagttcacacctgctaagagctatttaatagggacttactggggcttatgacgtaaataaagaatggattggcaactggaaaactaaagacatgaagattttaaaaatcattttcatataattttgaatgttagataacattttatttcttaggagtcagcaatcatagatgtaagcttattaaaatacatgatggggaaaaatgaagttcaagttaaatattgtaaaattctaattggagaaaaaaaaattggcattgccctattgtctttaagcagcatgttcttgcctatcctggtccctcaaacacacagacacagaaggatataaagaaagctttagtgttttcctgaactttttggcaggattggggttgaaatttacatttctgggccaggtgcaatggctcatgcttgtaattccagcactttgggaggccgagaggactgcttgaggccaggagactagcctgggcaatataaggagacctcatctctacaaaaaatttaaaaattagccaggtgtggtggtttgcacctgtagtcccagctacttgggagacaggtgggagaactgcttcagcccaggaattcaacgttacagtgaaccattaatcacaccactgcactccagcctgggctgcagagtatgagactttgtctcttaaaaaaaaaaattttacttttggctgagtgcagtggctcatgcctgtaatcccagcactttgggaggccgaggagtgcggatcatgaggtcaggagatcgagaccaccctggctaacacggtggaaccccgtctctactaaaaatacaagaaatttgctgggcgtggtggcacacatttgtagtcccagctactcgggaggctgaggcaggagaatcacttgaacctgggaggaggaggttgcagtgagccgagattgcaccactgcactccagcctgggtcacagagcaagactccatctcaaaaaaaacaatttttttttttttttacttttttggaacatagctggcaaaggaatagtaagattcaatgtgatggtgctttttttttttccctcctgaccgagtcttgctgttacctaggctgaagtgcagtgttatatcatgtctcactgtgtattcatttttttgagacggaatcttgctctgttgcccaggctggagtgcagtggcgcaatttcaactccacctctcgggttcaagcgattctcctgcctcagcctccacaggcgcctgccaccacacttggttaattttcgtattttcagtagagatggggttttaccatattggccaggctggtctcgcactgctgatctcgtgatctgtctgtctctgcctcccacagtgctgggattacaggggtgagccaccacgcccaaccatcatggctcactgtagtcttaactcctggcctcaagcaatcctcctacctcaacctcctgagtagctgggaccagcggtgcatgccgccacacctggctaaacttttaaatttttatagagatgggagtctccctatgtcgcccaggctggtcttgaactcctggcctcaagtagtcctcccaaagtactgtgattacaagcgtgagccactgtgcccagcggatagtgatttttttgagaccgagtttcactctagtccaggctggagtacaatggtgcaatcttggctcaccgcaacctccgcctcccaggttcaagcgattctcctgcctcagcctcccaagtagctggaattacaggcatgcgccaccatgcctgggctaatttttttgtatttttagtacagatggtgtttctccatgttggtcaggctggtctcgaactcctgactttgggtgatctgcctgcctcggcctcccaaagtgctgggattacaggtgtgagccaccgcacccggcccggatagtgctttttaattttttaatttttttaaacatatttgttcattttgtaggatctcagttgattttttatttatttatttatttttgagacggagtctccctctgtcaccaggctggagtgcagtggcacgattttggctcactgaaacctccgcctcatgggttcaagtgattctcctgcctcagcctcccgagtagctgggattacaggtgtctaccaccacgcctggctagttttttgtatttttagtggagacagggtttcaccctgttggccaggctggtcttgaacttctgatctcaggtgatctgcctgcctcagcctcccaaagtgctgggattacagcgtgaaccactgtgcccggctttttttttttttttttttttttttaaggtggagtcttgctctgttgaccagactggagttgcagtggcatgatctaggctcattgcaaccatcgcctcccaggttcaagcaattcttctgcctcagccgctggagtagctgggactcaaggcataagccaccatgactggctaatttttggtatttttagtagagatgaggtttcatcatgttggccagcctgatctcaggctcttgagttcaagtgatttgccacacccagcagcgtttgttttttttttttttggaggtgaagtctcgctgtgttgcccatgctggagtgcagtggcacgatctcggctcactgcaagctctgcctcccgggttcaggcgatcctcctccctcagccccctaatagctaggattacaggcacaggccaccacgcccggctaatttttgcatttttagtagagacggggtttcaccatgttggccaagctggtctcgaactgctgacctcaggtgatccacccaccttggcctcccaaaatgctaggattataggtgtgagccaccgctcccagcccctagctgtttttttgttctgttttgttgttttttttaaatagagacgaggtctcactgtgttgcccaggccatttttaaattcctgagcttaagtgatcttggcatgacctcccaaaatgctaggattacaggcatgagccaccatgcctggtgatctataatatttaaaataatactaatctcatagtttggttaatcttcaggctaatgtggaaatgtgagtggcatgtgggcatgtgctagaataatctttctcctgtagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatgtatgtctttattgcattcttgtcctgtgattctctgattggtccagtgactggagcagctgcgcaccactgggacaggaggtctggtgccaagtcccccagcagctgttggggagcagagcagctgctgcagctcggtgctgagttcttctgtactgggagggaggcagctggaaggaagagtttgcttcctggattgaatttattttttcaagcaaagtcaatctgggaatacagtttttgtttgttgttttgctgtttttgttgttgtagttgtttttcccctaaaaattacaataatctctggaatttgttttttaaatataaatatcctaaaaagtatttgagtcatttcggctcaaccatgaaaataaaagttcttaattaaggaaggaaggctttctttctctattggctttttttttttgggagatgctctgtcaccgaggctggagtgcagtggcgtgatcccggctcactgcaaccttcaccttctgggttcaggtggttctcctgcctcagcctcctgagtagctgggattacaggcacgcgccaccacgcccagctattttttgtatttttagtggagacggggtttcaccatgtaattcctgaccttgtgatctacccgcctcagcctcccaaagtgctgggattacaggggtgagccactgctcccagccccgttggcctttaaacttgtgcctagttgaaatgtctcaggcctgaacttttgctgcatcatggcaatacctgctgaccaggaaggtagagagaatgatcgtgtacctccctccctctatgtggggtttcttctcagctcccctctggtcctgagcctctcgcttcctcagacacattctttaaacaaacaattagagtttctcctctgtgctgggaaattttttagagactggcatgtttgaaacgattgtaagtggctttaccagtttgtcctgacagatgtcatttgggttttttcccccagtgtgacaccattgtcccattctctgagtagaaacttggaaaaattagtgataatgcatagtatgttcatcacagtgctcatttctccccctcaaaaattgggcttatgagtgtttctgtttccaaggatgcttgtgtggtgagcccagcagatctttttgttgcttctcattgccatccgctttctctttgctggattgattgggctgggattaagtctgtcaaatagtcactgaaagctgacccctcagggagcctcgggcacactgtcagtgttgtggctgtaccatatggatggggtttgtctgtagcgccccgtctcctggctttgttaagttagtgcctgacgcacatgttggatcttgtttaacagacaccctgtagaccttgaatctgcagaaagcagctccgagccccagaccagctctcaggatgactttgtaagtactttggataagtctttcagcttgggggttgcaggtgaattgttaataacacatgctgccttataaactgaagtttggactgggcacggtggctcacgcctgtaatcccagcaccttgggaggccaaggcaggcggatcacctgaagtcaggaattcaagactagcctggccaacatggtgaaaccctgtttctacaaaaatacaaataatagccaggtatgatggtgggtgcctgtagtccgtgctactcaggaggctgaggtgggagaatagcttgaacccaggaggtggaggttgcagtgagctgagatggcgccattgcactccagcctgggcaacagagcaagactctgtctcaaaaaaaaaaaaagaaagaaaaccatgtgctgcgcgtggtggctcacgcctgtgatcccagcactttgggaggctgaggcaggcagatcacctgaagtcaggagttcaagaccagcctgcccaacatagtgaaacccagtctctactaaaaatacaaaaactagctgggtgtggtcatgcaggcatgtaatcccagctactcaggaggctgaggcaggagaatcacttgaacccgggaggcagaggtggcaatgagccgaaattgtaccactgccctccaccctgtgtgacagagtgagactctgtctcaagagaaaagaaaaccgtttttaaatgtatcagtttaaatactgtctcctgtcctgagacagccactatttgtggttttgtctaggcttttacaattctttctgtgcttataaactatgtacatggccaggcacagtgactagtgactccttcctgtaatcccagcacaatgggatgtgtgcacatctaaacgtcagtgtcttgtaaatggtacatgtggtttctctttgcagtgttattattaaaatctgtctcagttgcacgtgaagtgtacaccttgctgtgcattacatcacatgatttaccacataaggagtggggtgtaggaaggggcccctgttttcagggtgagatgaatgtcaaccgagccatgcttctgttttccaggatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctttcactgactggggctgttgccaggtgggccagctgccgtgagagctgacatgtttggagggtcagaattgtgtctgcctttcttgtgtctgaagcaagtggcactcagtgagtggcgctgggtaaagggccttctttatttttttaattttattttttgagagtttcgctcttgttgcccaggctggagtgcaatggtgcaatcatggcccactacaacctctgtctcccgggttcaagcgattcttctgcctcagcctcccaagtagctgaaattacaggtatgtgccaccacacgcagctaattttgtatttttagtagagacaggatttctccatgttggtcaggctggtctcgatctcccgacctcaagtgatctgcctgcctcggcctcccaacgtgctgggattacaggtttgagccactgcgtgtggccgggggccttctttaataggtgtcacatgtcacatttggtctgatgcttattcatcagcactggcatgacagccttccctgtctcttgggagagaccctgcagcaggataatcatcagtctgagggtgccctgctcccactgccttcacccttggaccgtggttgctgcctgcagacgtgaccactagtccacgccacagcgacctgtcccggagatccctccaagtgatgctgggctggtcttaagccagggatgggctcaggtaactttgttctaggagcttgaagagggcagaagctcttgtttacttagcttgtttatggagacctcaagcagtgtcaggtggagggtggtagacactggggttgtagcacatgccctggtgaggagacccagctctttcagggtggtaggaggtgcctgataaaaggtgacatctggggagggcagcaagcagaggccacgaagtgggagcactcagcattgacttcaagagtcctaaaatgtgggaggagttctgggggcctgactgcaagcctcagtcttgagaaggcagaggtgaaggtccttgttagatggtgacagttcagtggtgctgtggcctccatcatgactgacggagagcagctctcctgggtttgtcactaaggagctacttcccctaaactgtgagcaggtccttagcgatgagcagcactcagtgctcttaggctaaaattcagtggcttccaagcaaaaatgacatccagaagacagctggaaaggtgatctaagctaaagctgagggtgtggcatgaaatcctctgttaaccatagaaagttgaacctttctctctcttttcactggagtgcagtggtgtgccttcagctcactgcaacctccacctcctttggctcaagcaattctcctgcctgtctcctgagtagctgggattacaggcgtgaaccaccacacctggccaattgttgtagttttagtagagttggggtttcgccatgttggccacgctggtcttgacctcaggcgatctgccctcctcggcctcccaaggtgctaggattacaggtgtaagccaccgcgcccagctgttagaacctttctttccctcaataagacttcttgctcctctgcaggagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcctgggagcatttgcagcaggtgtcctaggtctgtccccgctgttcattgcggtgggggtgtgtgtgtgtgtgtgcatgtgtgtggtgggggctgggg

SEQ ID NO: 12606 - DNA, 8293 bp, Human
aatcatagacatctgctaatcaaagctgacagcatttccagatcaggctggttttcctaggactgtgaccttgtaacatgacatcagaatgactgaaaactggcacaaggatataatgtgcaaaatacctcagattattaacccactttgagcaagtgtgtcctatacttttcagggcttcctgaaaacttgaaagagaacttctgtaaactacccccagtatcctcagaagtcaagaataattatttacttgagaatgttgaatacaacaagagaaaaggggaagggaagacaagtatattaaaatgtcttcaaaaatatctttaatattttatgtaaaatttcactgtaggtaattgtttgtattaaaaaaaaaagtggatcacaagctaatatgtcaaaggaacagggaactttaatggatgcactgacattaggaaatgtgtgggaatacactgatctggtcaaatcttcagaactccccaaggctatctctctgggctgctacggttcttctccaaaaacatagatacatacaaaaacatagcttcatacatgcttggttggggtgtaaaatggtacaatcatcttgaaaaaatcctttggcagtgtctaacatttctaagtattttatccaagagtaataaaaattgcaggtccacacaaagcagcttttttcataagagcccccaaacaaactagaaacaacacaaattccagtaataagacatttgtgatatattagaatattactcaatgatttaaaggaacagactattgatacacacagcaacatatttatacattgtgggatattcatacgttttggtaaattcataccttggactacgcaggaattaaaagaaacagactattgatgcagtgacctgggcgtatctcaaaaacaggaagtgtgagaaagaaatactacacagtgaatactttataattccgtttatatgaaattcaagaataggcaaatctaatctatggtaatcgaaatgagaagagtgtttgcccctggcctaaggatggaaggattgatttaggaaaaagtctgcaggagctttctggagtgatggaaatgttctaactcttttttttttcttcttcttcttctttttcttcgtttcgagacggagttccactctgccgcccagactggagtgcagtggcgccatctgggctcactgcagcctccgcctcctgggttcaagccattctcctgcctcagcctcccgaggggctgggactacaggtgcccgccaccacgcccggctaattttttgtgtttttaatagagacggggtttcgccatgttggccaggctagtctcgaactcctgatttcaggtgatccacccgccttggcctcccaaagtgctgggattacaggcgcgagctaccgcgcccagccaaaatgttctaattctttattggtggctacacagttgtcaaaatttatcaaactgtccacctacgatatattataagcctgtattaaatgtaaattagaactcgattgaaatctgtgtgtataaatataaatatacacttatttacatttctaatctaatctgaaggtccattgcaacgaatcccgctccgctctgacccaagaactccgcactttctctccaccagcctttcaaatacctgaacttcatgccttcaagaggtggattccggcttctttacagcgcaatcactagcaggtcatttccgtctagcttgcagatttcccattactgacacaaacgctccctcagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggtatctggccgctccaggagcttctctccccaaccggcggagagggcgcagcgggccatggggccccgtgtaggcgccctccaagcctcgctttctccaggtccctgccgcgcgctccgctggcaggggggactcgctcccaagtttgcactttctctgcagaggcccctccgctcggaaggggacagaactccccgggatgttctttcctcctaggagctacgcctgaccactttccctctcttttgctctccttctgccccttcttcaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaagtaagtgccctgcgcgcacccaggactctcgcgctccttgcgccggcggctggtagcagcttcgccagtttcccacgtctcgctttctacaggaagttttagcctgggttttctcaagtgttaagcaaacctcatggttttcagtttcttaaaagtaatcacaaatttacaaccactaacacatttcctgtctcccaactgacattgatcataattcagtgcctgtgcggactcagggaaagatttgttccctcaccatggggtataataaatgcaagagaataacgtgttaggtacaacgtaagtgcttctctgtatttttcattaattccaaacctatgatttttatctctcctggagtacatcatttccttctgtcgattatccatcaatctgaaatatttttagtggattttattattgaagtgtgacttagctcattatataactctacttttgtcccgatacccaaacatgtgttggattagttgcgggacatggtggagattcataatactgttatattttaatttatttttaatttttaaattatatcggttaaggcctgtaagagaacatggggcttttccattcaaggaactgagccaggggaaaatgcgtattcatgtgaataagctttgattcactgcatatgtacaatcagagaacacccagagaaaacagagagtctttctactgaacttgaaagatacatcacagctgagtcagctctgaatacactgttagaaaaaaaaaaagtaaatatctggattcatgggagtattctgggtatttactatcccaacactaatacaacttctctccccccacaaaatgttgctgaaaatacagtgatggtttaataagaaggctacttttgactaacattgttctattaccctccttttcctagaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaagtaaatacgatttttatggtatttctatttcacttttttgaaaagacatttgggtggaaaaaactcaatttgatgcgaaattaacatgtgcattttcatgatttcacattacttgacaagttagtgacttgtcaagttcttaggactggaaagtgacaaagccatgattcaaatttttgctttctgcctcttctgatttgttgtttttgagacggactctcgccctgttgcccaggctggagtgcagtggcacaatctcggctctctgcaacctctgcctcccgggttcaagcgattctcctgcctcagcctcctgagtagctgggactacaggcgcccgccaccatgcccagctaatttttttttttttcttctttctctttctctttctttctctccttccttcctttctctcctttctttttctctttctttctttctttctctttccttccttccttccttccttccttccttccttccttccttctttccttccttccttccttctttctttcttttctttctttctttcttttttctttcgacggggtgtcaccgtgtaagccaggatggtcttgatctcctgacctcatgatctgcccacctcggcctcccaaaatgctgggattacaggtgtaagccaccacgcccagccctgaattgtttctttagaactatttctcagctactcaatttatgcataaaagattaaagtattcattaatgaatgttatgacctcagatttgtacacaataagttatacatgtgagatagtggaatatatacagaattaagatggtgaaacttgaaaatttctttctaaagttttcggttagatttctgtattcttcagtaattgcaaattgcagcacaaacatctccacacgtttctgtcctatccatttgttacctctcccaccaccacccctgaatccttgaaatgatagtctcttgagtagtatttaatgtttgcagagggagacaatacaggcatttcccccagacacagagatttttgaaaagttcaacaaacaaggaaaacttgctttggcagagaatttgataaagctttatagctgtactgtgttgaatatgcaaaatcttgagttaatgtggtgatggttactgtggatgttctcttgtttgtgtacatataaatgtttgctccagtggttacctggaaattagtatgcatatattattgattaataatggaatgagagctgttaaaaacattaaagcaaaactaccaacacgacaaaatttaccaaatcatgccacatattgtccttgaaacttaccccatttttacctaaccatatctggtatttgggtttaacttctttttacatttaaaggatacaaagatgtagcttcagaagaaattctatccagtttacaaaaatttagaattaccaaaatatagcatgtaagcttacctgcaatttgaagcacatctttttaaaggtttagtatgatattttggattcagactgaggcttctatgggattagattttcttcagttacttcagtaatcaccataatttaaaaattctggtattataacatttctaattttcttctcttttttataaagttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaggtagtgaatgttttcttattccacctttagataaactttataaataacttatcagaaaaattatatttttatttatccattttactaatagcaaattgctgtttctagactacttctacataagtatctccgtagtgttaatcagttttgtcaaaatgcttttactggctagctgcagtagacggtagctgtatcttcatatcttaaaggtaaaatattattaactgagtgtataatgagttttgacttcacagtccttaaaaataagatgaagtgagctcaataaccttatcagaaatagtgatttatagtgagcctacagactggagatgtatgattttcattgtcgttttattgattttagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaataaaaaagaaaaagcatttctttaagcattcaaacccaactgaataccaaatagtggcaaaactacacaaaagatatatacttattttcaatgacttcacaaattaatatgagaatgtcttttggggaatataaaggtgaaaaaattctgaagaaatctcaaaatgcatttttaaatttgttattactttttatttgaatagttttggagttacaagtggttttttattacatggatgaattatattgcagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatc

SEQ ID NO: 12607 - DNA, 35058 bp, Human
tatcgagataccctgaggtgtacaaaggatgagtcaaggtagcggagagagagttgaagagtgacagctgagaaacagagataggacatgtccaagaagtgccaggataacccaacaacacaggctgattgaggaaactgccagagattagacaaagtagactgaagagggaaagcaatgtttgttggagattttgctttagtttttgataaatatttcttagtcataccaattgttttaaatataattacgcccccaaaccaaatttctactcttattctggcaacagaataaaaatcaatatcaatgtttgatcattttcaaagaaactcagttcctatcttggttgaaatgcagtgacatccatatgacaattgagctcttcatgtggcactaatataactaagccctgagcacatcccttgcacttctatttagtgaagtcttttaaaaagtattttctttacagttgttaagtggaattactaaaaattacaatcagcagtattttctactcttttagcttattttttaaaatatttatctccatgcttttcaatattacacctatattgcttcttcttgatttttccattttaagatactgacttcctactatggaagttaaagattaagctctatttcctcctcctccatccccatcaagcatagtacccttctccaaagcccatccttctaaatgtaattctttttttgagggggaggggggatcaatactcagtttttttttgttttgttttttttttttttttgagacggagtcttgctctgtcacccaggctggagtgcagtggtgcgatctcggctcaaggcaagctccgcctcccgggttcacgccattcttctgcctcagcctcccaagcagctgggactacaggcgcccaccaccacgctcggctaatttttttgtatttttagtagagacgggttttcaccgtgttagccaggatggtctcgatctcctgacctcgtgatccgcccaccttggcctcccaaagtgctgggattacaggcgtgagccaccgcgcccggccaatactcagtatttatgtaacaataaatacaattactttcctttcttgcacaagattttgttttccctagaattaatagctgcataattcttacagccgcttagttttctgtgtacctgtcatgagttaaactccaaactctcggtcaaatctcctcttgattcaacgccagctggaattttgtcaatcccatccttctgaagcagtgtctcccaaagatttctgaccgaatctaatctagatgcgttgccgtctatgcctatacacagctattgttcccggagctctttcagtatcatcttgggatcttactattttctgtgtttgttatttattgtatttcctgcatttcataatttcctccttcttggcttattccctcattttggtggatcagatctacaggatcttcctggaggtactgagaaaggtaagataggtactattttttgtgtgtagtgatttagcacatctgaaactctattctattcacacactagattggtagttggatgagtattgaagactaaatcggaagtaattttccctcagagttttgaagacagtgccgtatggcttcctagattctaactgagcaatctgaagccactctgattctatagtctgtataacctggaagggtgtgggatctctttttcctcgatgttcagaaaattcacaatgatatgccttgacgtggatgctttaatatttgtgctgggtgcttagtaggatctttcagtgtggaaactcatctccttaacatctggacaactttctgaagtcatttattatttcctgcctttcattttttttttggtttggaactcctgaactggtcctgtgatgtgactgcagccgccaggcgcgtgcgcagtgtacactgcgtgcgcatacgcgagcccgttgcgcctgcgcgcggtgccgccgtcgcccctcttttcgcggcgttctccacctgcgcgggcctgaatggccttcaggagcacagtcggcctgaggagttgatggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccggggtggctctcccgccccggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccacccccgccaaaaaacaaacagataaatggtggcttggggaaacccggacgtggctgccaaggaaacgggcgactccgagggctgggaaagctcagcttggtgcacattcgctgccaatctaggttattggtgaagcggtgacgccaccctcctggtgtgaggataacaataactgtagcaaacagtcgctgagcgcttacccgcagtatttccaagtgcggtaactgagacaccgaggcatacgaaagctaagaaaatttgctggagttcatggtgttcacaaagcctcaaagcaagagcataacactgtgcctggcacatggggaacattcagtaaatgtcaacttcttttgtttttgatgaaattaccatagaccctagcgtaatgtttgacattgtaatatttatttccctcacacagcccctggcacgttaatttttttttttttttgagacgaagtgtctgtcttgttgcccaggctggagcgcaatggcacgatctcggctcactgcaacctcggcctcccaaagtgctgggattacaggcgtgagccaccgcgcccagccgtggttcattctttttaaagaaaaatttcctttcctttataaataaaaatcagaaggggtacaaatagttgtttttatcaggagccagtgggtcctgccttaaaaattaacgtgcagggccgggcaaggtggctcacgcctgtaatcccagcactttggaaggccgaggagggtggatcacctgagatcagaagttcaagaccaggctggtcaacatggtgaaaccccgtctctactaaatatacaaaaattagccgggcgtggtggcgggcacctgtaatcccagctactagaggggctgaggcaggaaaatcgcttgaacccgagaggcggaagttgcagtgagctgagatcgtgccactgcactctagcctgggcgacagagcaagacaatgtttctttaaaaaaaaaatagcaataattagtaggttttaaaatacttatgtgtgtgtgtgtgtgtgtgtgtgtgtgttttgttttgtttttttttgagacggagttttgctcttgttgcccaggctggagtgcactagcgcaatctcggctctccgcaacctccacctcctggattcaagcgattctcctgcctccaagcgattctcctgcctcagcctcctgaatagctggaattacaggcatgcgccaccatgcccagctaattttgtatttttagtagagacgggggcttctccgtgttggtcaggctggtctcgaactcccgacctcgggtgatctgcccgcctcggcctcccaaagtgctgggattacaggcgtgagccaccgtgcctggccgcttttcttcatttttattgttgttggttacattcactcagcacttttcacatgtggtaaatcttgctcattgttcttcagatacatttctgtaactgagccattggtttcagattcatgtgcaacattcaatattttcacttcaattgaaattttttatctttccaacataatctgtcaatacgcactgcctttgcacttatcagatataagaaatatgtatgttaaactaaggacaaatgtagcaaacatgtcatcagccactatttaccaagcttcagtcatccaagtgactcttggccatttttgccatgtctgaattcaactgtaatatttattgtaacatttacatttaaatcagtttattttttaaaagcctctttctaagcgttaatgttttttaaattgtagggtgtttggttgtttttttttttttttttttttggagacagaggctcgctctgttgcccaggctggagtgcaatggtatgatctcggctcactgcaacctctgcctcccaggttcaagcaattctcctgcttcagcctcccaagtagctgggattacagatgcacaccaccaagcccagctaatttttgtatttttagtagagatggggtttcaccatcttggccaggctggtcttgaacctctgacctcaggtgatccacccaccttggtgaaattgtaggttttaatttctagttacagttattactattttttaatactgattaaacacgtaagtaaaaaagtgaaaaatgtttgacctttattctacctctcacaaattactcctaatatttatactatactttgggaaacactgccacaggctaggtgataaggacattgccacaggtgatgccagtcagaattggccatttttatttcaatgcctagctttcaggtgtttaagtaaaggccttttgcatttcttttaacaacactctaaaagcgctttacatggtaatttaaataaaagcattttcaaagagggaacattgtaattattctggcgttttttgtgttaatatgaaaggatgtgtctgaaattgatttgagagaaatccatattataagcaaactatagattgttagcctgccattctttaaagcaagttttcagagctcttattctgcatatttagctaatggtacaatattcatttattttaaaattatttttcttttagggtgttactatcgttaaaccaatagtttacggtaatgttgctcggtattttggaaagaaaagagaagaagatgggcacactcatcagtggacagtatatgtgaaaccatatagaaatgaggtaggcactcgttttttctgtaactgttttacttaaagttgtctgtaatttgttttgcttaaagacaacctgtagttttttttttttttttttttttttttttgagatggagtcttgctctgtcgcccaggctggagtgcagtggcgcgatctcagctcactgcaagctccgcctcccgggttcacgccattctcctgcctcagcctcccgagtagctgggactacaggcgcccgccaccacgcccggctaattttttgtattttttggtagagacggggtttcaccatgttagccaggatggtctcaatctcctgacctcgtgatccacccgcctcggcctcccaaagtgctgggattacaggcgtgagccaccgcgcccggccgacaacctgtaattttttatagtaactttctgattataaaattggtccgttgtaggaatgttgtcaaaaagtttttgaaaaaatagagaactgtcatcttcatatgatactagaaatcaattttccaaaaatgtttcctaattaaaattaagataacaagaactatttatgctataaatacagtacaagtacatcttcctaacatcatatctaagttaacatagtatttaatcaggagtttcaggaataagcagctaatccttaaagtaataatgtggtaataagaatgtgaaagacagctctgctgtgtcatctgattgctagtaattttgtttcactgctgaatcttcaatgcctggaacatagccagtacatagtaggcatttaacagatatttattgagtgagtaaattattcctctatttaaaacccttcagagtctacccaaaaacttgcatgtgaatattgataccagtgttattcataatagccaaaaagtggaaacaattcatttgtctatcaactgatgaatggataaataaaatgtgatatatccatacaattgaatattatcaagcaataaaaagtaaagtactgataaagtaaagatgctactacatggatgaaacttgaaagcattatgctaagtaaaagaagccaaatataaaaaaggccaaatattatatgcttttatttatatgaaatgtccagaaggggcaaatccatagacaaagaaaatagataagtggttgctagtgggtgggggagaaagggtattgaggtaagtgctaatggatatggctttcttttgtgtgataaaaatgttctaaaattgtagtgattcttatgagactctgtaaatataactaaaaaccattggctaggcaaaatggctcattcctgtaatctcagcactatgggaggcccaagcgggaggatcgcttgagcccaggagtttgagaccagactggcaacatagtaagactccatctctacagaaaaaaaaggtatcattatagtaagattccagtttattttttaaataataaagttagatatgaatgtagatataagtaatttaaaaattcctaaaagtaaattaaaaagttaataaacattactattgaatgtgacttattgctttgcatttttttattcttctataatgaattatatattttaaaagccacttttgccaacagaaacccttttatttgccataactaatgaatatgcttctgtacttttaaaataaagaaaatgaggagtttttgtattcaacaatcttagattgctttaaattagttgtccttagctttatgtaatataattttttgtttgtttgagatggagtttctctcttattgccctggctggaatgcaatggtgtgatctcagcttattgcaacctccgcctcctgggtttaagtgattctcctgcctcagcctcctgagtagctgggattacaggcgccgccaccatgcttggctaattttttgtatttttagtagagatggagtttccccatgttggccaggctggtctcaaactcctgacctcaggtgatccacctgccttggcctcccaaagtgctgggattacaggcgtgagccaccgtgcccggcgtatgtgatataattttgttctttgaaattgactatagatttgccttatatttctgtaatagtaccagatatgtactgttgttttaatggaaaaaaatcaaaattgatttagaatattatctatagaggtgtattaaaacaagatttgccaaaaaaaaagttaatttgggacgtgtatttctatacattacaaatcataaaagaattcaacacaggcttcctttttgtttttttaaaaaaagcaaaataggccaggtgcggtggctcacgcctgtaattccagcacactggtagggcgaggcaggtggatcacctgaggtcaagagttcgagaccagcctggccaacatggtgaaaccccgtctctactaaaaatacaaaaaattagccaggcatggtggcagccgcctgtaatcccagctactcaggaggctgaggcaggagaattgcttgaacctgggtcagggaagttgcagtgagccaagatcatgccactgcactccagcctgggcaacaaagcgagactccatctcaggaaaaaaaaaaaaaaagcaaaataacttcccaggtgtagttcatgttttttagaaaattagattccataaaatttgaagggaagtatgttttttataaaactaagtatatacgctcagtgtattttttttcctagttttcatttgtagatcataaaactaactaattccttatattttaggatatgtcagcatatgtgaagaaaatccagtttaaattacatgaaagctatggcaatcctttaagaggtacaatatagtcttttgattcacaatatccaaagttaaaaatggctaggaaactaaaccgataatttactatttttttctgtctttagttgttactaaacctccatatgaaattactgaaacaggatggggtgaattcgaaataatcatcaaaatatttttcattgaccctaatgaaagacctgtgagtagcattaatctttgtaaatataaaatagatttcttagtaaatgtgaacatgtaataatacttaatgaatagtgttcattcagatgtgttttatgtaaatttatggcacagtgtatcttgccatgagttaagtttttcatttttaaatgtagcgcctttcaaaatccttttttttttcaagtatggaaaaaaacatataatatgaacatgtattggaaagaaaccatggaaatcagatgactactgcagcaaaaaaacttaaaactattattatcattcggttattagtaataaataagttgagcccatatgctgtgtaaaatagtttttatagtttttggtagttaaaccctaagaaacagtgtttttgcttttttaagctgtcatcagtactagcgcttcattttatatcttatttatgagtctttatttttatagccactggctttttcatcttttgatctcttcttatcagattgttgcttgataatgtaaaaaaaaaatccctccaggcttttgctttgatccttcagcaactttgttaggttgtgataccctcattttagagatcaggataccaaggctcagaggtcaagtcactgctcaaaaacactcagttaattatggtagagctagtttttgaacccagatatttgcattcatacctttttctagtattttttcttttgagtaaaaccactaggcctttttttttcttaagcctgtagggtcaaaactcagtaatggctctcacattccacatatgtggctggggtttaactccagtttcaaggctttcacattcatcaccattttatcttgttagaatcacatcagtcttttagcaccaaacatttacattttaattatcagattatattttttaaactgtgtatgtatttttaaaggagctgaatatcacctggaccagtatttcagcaaaccggttcctaactggctgcatcagaaacacctgaggtgcttgcttatttatttattaatttttgtgaggtgctttttaaaaattcaagctcctaggcctcaccttttggagagtctgattcagtaggtttggaatggggccagcaccccaggtgattttgatgcacaatgagaattgggacccaatgacgtagacttactcttttcttcctacgtaggaatttatttaggcaatatctcaaatgagaatctagtttgggcttgcatatctccaatatggagaattaacttatgtcactaagtaaaacatcctattcaaggttggggtagttttagttttaagaaagctgtacttcgttacgcttccctgaactttttactgattactattcctaccttagttttcttttctcatgagtaagcatccatagctcatttaaacattttttgtgttttcatgtgatgaagtttttagatctcctaccatctgtgttgcccttcaggaaaacacactcatgttatattttgtttggcaataattttttttttcttttgagacagagttacactctgctgcccaggctggagtacagtggcataaacacaactcactgcagcctccacctcctggcctcaaacagtcctctgcctcagcctccccagtagatgggaccacagatgcatgccaccatgctgagttaattttttattttctgtagagataggggctcgccatgttgcccaggctgatctcaaactcctgggctcaagcattcctctcgccttgccctcccaaggtgctgggattacaggcatgagccaccatgaccggtcaagaaattattaaatattatatctgctatttgtaagatattgtttaagggattgagaaggatacaaaaatgagacactgaccttaatgagaatagtttattagggaaaagagagcatagaatttagcagatgttgagagggagagagaagcagctcatatgttactagagtagaagctctttttaactttgtaagattgctgggttttcatttttattttgagaatatgctgccttacctccctgtctcctcatctgttaccccttatccccagttggaaaataaatctatgaaagaaatcattgtaccctgtaacctcattatgagacagctcttgaagtcactcttagaaaggtatataacctattgcactgctatagtgattaatctgtttaatagattcccatatagatttacataggcctgaattttattctctaaaaaatattatagggttttttagtattattaaactattgtactttttcaatagttagctcttacagaaaatgtccagtgaaggtttatttaaaatatctaagaaagacaagttggttggaagacaacttgtgatttacttctgctacccagtaacctattatacagatcaagccactataaaaagaatggttgtttctaaaagcaaaatgtcaaattgagttttcattcctagaaatagggatttctaggcaagtataggcagtttcattgttctaagaattttcaaacaccactcaaaattacagacatctgtcttgaaatgtttttattgcctatatccgcatgaatgcctctggaagtctgaataataaatttagggaaggacagttttacaatgtaattgtaagaatttcttaattgtaaaagtcagttgtgcacatggttttaagagaagatttttgaaataagtgtaagtcttctgtgttagttttctggtaccataaactgggtggattaaaacaacagaaatttattcccacagatctgaaggctagaagtctgaaatcaaggtgttggccatgttttttccaaagcctttaggggagcatctttccttgcctcttccagccccagatgttccttggcttttggcaacatatctctaatatcttcctccattgtcacatggccttatctttctccctggtctctgtgtcttcttctcttagaaggacaccagtcatattggattgtggtccaccctaatgacttcattgtaattacacctgcaaagaccctgtttccaaataatgtcacatccacaggtgctgagaattagggcttcgtatcttttgcctgcatttatagtcccagttacttgggaggctgaggcaggagtatcatttgagatcaggaattcaagaccagcctgggcaacatagtaaaaccccatctcaaacaaaatataccttttgcagggaggtcacaattcagcccataacatctttatcccatctttgacctcttttccaagaaaactgctttttaacagttacctgttctcaattcctctagaaattactcactcctgtgcatctcatatatttaaatccctaatactggatttctcagcttcagatagtatctttcagtgcctaatgattgattataggtgatcctttttcgtcctctttccaagtttctttttttcattttgccaaaggaattttttcagaaaggatgcctgagaaataaactttcagagatattgcccatctgaaatgtccttattttttcttcatagttcattgttggggagaaaaattctaggcactaaaggtagatatgctttcttgtctatgaatggagagagaagagaaagtcaagaggcctagctaccccatagcattcttgactttgatacttgccagttctgagcttggagcactgtagggctcctgggagctctggctcacacctcttaggcagttttcttaagttttcaggttgtggtttttctctggtgtcattgtttattatccttcttggtagactcatctgctttctgtctgttccagaaatttgttaaattatttgctttaaataatttgatatgtaattcatgctctcttattttgctgttattttagtagaattctgtgcatttccctcctcccctttctacattcttagtgcatcatcttgagcctggaagatgtcctttaagtaggatatttccacttgctgagccatgtccagggaaatctgacattctgttaattgagctagattgtctttagggggagttgatggtgcttgtttaaattcagttgcaaggaattttatattttctgactttttcagtgtacccttccttgctccctatttcatgacttttttgaagagtaccattctcttacaattatgctagctaactttttagaaaattatttggggtctggttttcagaacttcaacatgaagtctgatgttttccgaactagattttattttgctgaaataatcacacattgtgctacaaagcttttcctttgatgtcttactatacctgtttttaggtatttgaagacatgttgctcttgccaaagtgaattattactgaccaactttttatttatttattatgtcatttatgtaataatcttatagatccccaaagaaattatcttgccctcactgaactttttcattccccacagtaaatttgtaaactctaatcttcaaagcagtcacaattaatccacttgtgtaagtaaaagaattcatgttttagtgatttctcagtttaatttctatagctttatcttgtgttatttttagtttcctctctagagattcttgaacagattcttaattaccctctaaagagtattcatgttaggtagatatgaatggatctaataggaaaataaaggtacagaaaatttgggtgatttgctgcaataagttgcagttgaaacaagatcatgaatttgacatgtatatacttattccagtctctatttcagttaaaaaaatgccagtatcttatgatgataaaaaccattgcacagatttgacatctgtttctatttcacaggtaaccctgtatcatttgctaaagctgtttcaatcagacaccaatgcaatgctggggaaaaagacagtggtttcagagttctatgatgaaatggtaagaagattttataatgatagttttaaaagcatttgaagttggagaactttgaagttattgggtttttgttcattttatcccattagatatttcaagacccaacagcaatgatgcaacaattattgacaacatctcgtcagctaacattaggagcctataagcatgaaacagaatgtaagtgccatgcattcataattctgaaaaataacgtattctgtaatagtgaaagggttgtatgattcgtgccttttacactttaaaaaaatgaaataggtaagttttttaggtgttaaaaaacacagtttgtattacagtggaacatgtaaaaaggatgttttaaattgttcccaagtaggcctgctttcaagaagggtgaaagacagcctcttacattcgctgaagtactgtttgtctgttttattccctaattacatttaagtatagttttttattagtcttgcttagcctatcattttctgtttactagtctttgctaacaaaatctgtgtgaagaaccttgcaaaccataattatacttttatatactgtgaactagtttatcttatatttttgctgatgtcattttacatagtttcagattaatgctcaagtgttgactacctgaatgccacattgataatcggtcatgttgtattttctctctaagctgacatggtctcagaattctgtacgcattaatctgtgcatctattctcagtcatttgcaattggcatttaatatgaaatctatttgacatccctgtgttaacactgatgttactgttcagtcatttctttgattattcattcattacaatatatagtgagtaccagttaatgccaaccattgttctaggtgctagctgctgaggttagagcagtgcctgaatcagacaaaaagccctatcgtcatgggtcctacattctagtgggaggaaaacaggtattaaataaacagaacaaggaagtataaggtagtgattaagtgctatagagacaaacaaagtggggcagggagcatctttggtgggacgagatggttggagttttagatactgatatcaaaatgtcagtcaggaaatgctttctgagcatttggagacctaaaggggtaaaggagtgatctaagggaaggatattatatgtagagggagcagtgaggacaaaggccctcaggtaagtacatggctgaaaaacagcaagaagtccagtgtgactagagtagagtgaacaagaggacgaggagtgggagatgagatcagagaagttaataggggactaggtcatatagggacttgtgggtaactatgagggcttcagattattaaactgagatatgaagtcatttgtgagttttgagcaaaggaatgacatcagatttaacttctttaaaatgtttaattttgtgggtatattgtaggtatatatatttactgggtacatgggatattttgatacaggcatacaatgtctaaaaattacatccaggaaatgagatatcgatcacctcaagcatttaccctttttgttacaaataatccaaatatactcttttagttatttttaaatgtacaattacattattattgactatagtcaccctgttgtgctatcaaatgcttaatttattcattctttctattttttgtaccaataaccatcctttacccacctacccactacccttcctaccctctggtaaccgtcattctactctgttttctgtatctcatgagttttttttttttttttttttgagacagagccttgctctgttggcctggctggagggcagtggcatgatctcggctcactgcaacctctgtctcccaggctcaagtgattctcctccctcagcctccctagtagctgggattacaggtgtgtaccaccacacctggctaattttttttatatttttagtagagacagggtttcaccatgttggccaagctggtctcgaactcctgacctcaggtaatccacccaccttggcctcccaaagtgctaggattataggcatgagccaccacacccagcctagttgttttaatttttagctcccacaaataagtgagaatatataatgtttatctttctgtgcctggcttacttcacttaatataatgaccttaagttccatccatgttgtttggaatgacaggatttcattccttttttatggctgaatagtactctcttgtgtatatgtaccatattttctttatccattcatctgttgatggacacttgggttgctttcaaatcttggctattgtgaatagtactgcaataacataaacatggaagtgcagatatctttttgatatactgacttattttcttttggatatatacctagcagtgggattgctggatcatatagctctattttttgttttttgaggaatctccaaactgttggccatagtggttttactaatttacattcccaccaacagtatataagggttcccttttctctgcatcctcgcctgcatttgttattgcctgtcttttcgataacagccattttaacaggcatgagatgacatctcattgtagttttaatttgcatttttctgatgatcagtgatgttgagcaccttttcgtatacctgtttgccatttgtatgtcatcttttgataaatgtctattcagatcttttgcccgttttaaaatcagattcttaaggagttgttcgagctccttatatattctgattattaattctttgacagatgggtagtttgcagatattttcttccattctgtgtgttgtctcttcactttgttgtttcctttgtggtacagaagttttttaacttgatgtgatcccgttaatccatttttgccttggttgcctgtgtttatagggtattacacaagaaatctttgtccagtccagtgtcctagagagtttccccaatgttttcttttagtagtttaatagtttgagatcttagatttaagtctttaatccattttaatttgatttttgtatatggcgagagataggagtctagtttcattcttctgcatatagatatccagatttcctggcactatttattgaagagaccatttttttcctcaagtatatattcttggcacctttgtcaaaaatgagttccctgtaagtgtgtggatttgtttctgggttctctagtctgttccgttggtttatgtgtctctttttctgcaagtaccatgctgttgtggttactatagctctgtagtataatttgaagtcaggtgattcctccagttttgttctttttgcggaggataacttaggctattctggatcttttgtggttccacataaaattttaggttttgttttttttttttctatttctgtgaagaatgtcatttgtattttgatagggattgcagtgaatctgtagattgctttgggaagtatgggcattttaacaatattgattttccagttcatgaacatggaatatctttccttttctgtgtgttctcttccgtttctttcattactgttttatatttctcattgtacatatctttcacttctttggttaattcctagttatttaatttgtagctgtggtaaatgagattactttctttttttttatttaattttttagtatttattgatcattcttgggtgtttctcggagagggggatttggcaggatcataggacaatagtggagggaaggtcagcagataaacatgtgaacaaaggtctctggttttcctaggcagagggccctgctgccttcccgcagtgtttgtgtccctgggtacttgagattagggagtatgctgccttcaagcatctgtttgacaaagcacatcttgcgccgcccttaatccatttaacccttagtggacacagcacatgtttcagagagcacggggttgggggtaaggttatggattaacagcatcccaaggcagaagaatttttcttagtacacaacaaaatggagtctcctatgtctacttctttctacacagacacagtaacaatctgatctctctttcttttccccacatttcccccttttctattcgacaaaaccgccatcgtcatcatggcccgttctcaatgagctgttaggtacacctcccagacggggtggcggccgggcagaggggctcctcacttcccagacagggtggccgggcaggggcgccccccacctcccagacagggcggcggccgggcgggggctgccccccacctcccggacggggcagctggccgggcgggggctgccccccacctcccggagggggcggctgccgggcggagacgctcctcacttccctgacggggtggctgctgggcggaggggctcctcacttcccagacggggaggctgccgggcgtaggggctcctcacttctcagacggggcggccggtcagagacgctcctcacctcccagacggggtggcggcggggcagagacactcctcagtttccagatggggtcgcggccgggcagaggcgctcttcacatctcagatggggcggcggggcagaggcgctccccacatcccagaggatgggcggccgggcagagacgctcctcacttcctagacgggatgacggccgggaagaggcgctcctcacttcccagactgggcggctgggcagaggggctcctcacatcccagacgatgggcggccaggcagagacgctcctcacttcctagacggggtggcggccgggcagaggctgtaatctcggcactttgggaggccaaggcaggcggctgggagatggaggttgtagcgagcagagatcacgccactgcactccagcctgggcaacattgagcactgagtgagcgagactccgtctgcaatcccggcacctcgggaggccaaggctggcagatcactcgcggtcaggagctggagaccagcccagccaacacggcgaaaccccgtctccaccaaaaaatacaaaaactggtgaggcgtggtggtgcgcgcctgcaatcccaggcactcggcaggctgaggcaggagaatcaggcagggaggttgcagtgagccgagatggcggcagtacagtccagcctgggctcggcatcagagggagaccgcgcagagagggagggggagggggagacttctttcttgatttcattttcagattgttcactgttggcatacagagatgctactgatttttttgtatgttgattttgtatcctgcagttttactgaatttgtttatcaactcttaatagcttttttggtggagtctttaggtttttccaaatataatatcatctacaggctgggtgtggtggctcacgcctgtaatcccagcactttgggaggccaaggcagatggatcacctgaggtcaggagttcaagaccagcctggccaacatggcgaaacccttctctgctaaaactataaaaattaaccgagcatggtggcatgtgcctgtaatcccagctactcgtgtggcagaggcaggagaattgcttgaacctgggaggcggaggttgcaatgagccgagattgtgtcactgcactccagcctaggcaacagagtgagactctctctcaaaataaataaataaataaataatgataatatcatctacaaacaaggctaatttgacttctgctgaattttatcagatcctttttcagcatcaattgaaatgatcatatggtttttgtccatcattctgtcgatatgaggtatcacattgatttgctcatgttgagcgattcttacatccctgggataaatcccgcttggtcacgatgaatgatctttttaaggtgttgttgaattctttttgctagtgttttgttatggatttttgcatcagtgttcatcagggatattggcctgtggttttctttttttgatgtacctttggttttggtgtctaggtaatactggcctcatagaatgagtttggaagtattattttctcaattttttggaatagtttgagtagggttggtattagttcttcttcaaatgtttggtaaaattcaacagtgaagccattgggtcctgggcttttctttgctgggagactttttactacagcttcaatcttgttgcttgttactggtctgttcaggttttggatttcttcatgattcaatcttggtaggttgtatgtgtctaggaatttatccatttcttctagattttctaatttattggcatataattgctcatagtggccactaatgatcctttgaatttctgcactgtcagttttaatgtctcctttttcatcctttgagttttctcttttttcttaatctggctaaaaatttgtcagttttgtttatcttttcagaaaaccaacttcttgtttcattgagcttgtattttttcttcatttcaattttatttatttttactctgatcttttttcctctactaactttgggtttggtttgctcttgcttttctcattttttacaatacatcgttagatattttatttgaagtttttcctctattttgctacagacatttaaagctacacatttccctctgagtactgcttttgctgtgttgtttccattatctgtttcaataaatttttcagtttccatctgtccttccttccttcctttcctccttccctcctttctttctttctaacttttttggagctggggatctcgctgtgtttaccaggctggtcttgaactcttgtcctcaagcgatcctcccacctcagcctcccaaagtgctgggattataggtgtgagcctctgcacctgacccaatttttcaattcttaatctcttcattgacccactggtcattcagaagcatattgtttaaattccatgtgtttgtatagtttccagaattcctcttgttattgatttctaattttattccattgtagtcagagaagatacttcacattacttgcttttttaaaaaaaaatgttttatgacttgttttgtggcctaacatatggtctttatccttgagaatgatccatgaggtcaggagaagaatgtgtattctgtagccatttgatgaaatgttctgtaaatacctattaggtccatttggcctattttgcagattaagtccaatggtatttttttgttgattttctgtctggatgatctgttcagtgctgaaagttggatgttggcgatgccaggtattgttgtattggggtctatctctcttaaactctaataatatttgctttatgtatctgactgctccactgttgggtgcatatatgtttacaattgttatatcctcttgctgaattgactcctttattattatataatgaccctgtctctttttatagtttttgttgtgcaatctgtttgtctgatgtcagtattgctactcctgctcttttttgattttgcatgcaatatctttttttttcatttgcatgcaatatctttttccatccctttattttcagtctacgtgtgtctttataggtgaagtgtgtttcctggaggcagtacatcactgggtcttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttctggtggtatattttaatttctttttatttttgtgtttctcttttatgtttctaggtttgagcttaccatgaagcttgcaaataatatcctataacccgttgttttaaactgatgacagcttaacactgattgcataaacaagcaagcaaaaagaaagcaataaacactttatattttaacttcatctccccacttttaactttttgttgtttctatttatatcttattgctatctatgtcttgaaaaattgtagttattatttttgatcggttcatcttttcatatttctacctaagacttgtgtagtttacaaactgcaattacaatgtaataatattctttgtttttctgtttacttgccagtgagttttgtatcttcagatgatttcacattacttattaacatgcttttctttcagattgaagaactcttcagcatttcttgtagggcagctctggtgttgatgaaatctctcagcttttgtttgggaaagcatttctccatgttcgaaggctattttcaccagatgtactattctaggacaaaaggctttttttccttcagcactttaaatgtcatgccactttctactggcctataaagtttccactgaaaagtccactaccagatgtattagagctccattgtatgttacttgtttttgtgtttatttcctcttgttgtttttaggatcctttctttatccttgagatttatgagtttgattataaactgccttgaggtagtcttctgtgtgttaaatctccttggtgttctataaccttcttgtacttgaatattgatatttttccctgaatttgggaagttctctattattatccctttgaataaactttctactcctctctctctctatctcctctttaattaaggtcaataactcttagattctacccctaccctgcctttttattttgagacaggtcctgactttgtcacccaggctggagtgcagtggcatgatcttggctcactgcaacctccaccttccgggttcaagcaatcctctcacctcagcctcctgagtagctgggacccacaggcacatgccaccactatgcccagctaattttttttttttttttttttttttttttttttggtggagatggggttttgccatgttgcccaggctagtctcgaactcctgggctcaagcagtcctccctccttggcctcccaaagtgctgggatcataggtgtgagctgctgcacctggcctggatttccccttttctaggttattttctagaacttgtagatgtgcttcattttctcttgtctcctctcactgtgaatttgcaaatagcctctcttcaagcccactaattctttgttctgcttgatcagttctgctattaagtgactgatgcattcttccatatgtcagtggtgttttcaactccagcatttctgctcgattcttttaatttccatttatttattaaatttatgtgataggattctaaattctttatctgtgttatcttgaatttcttttgagtttcctcaaaacagctattttgagttatctttctgaaaggtcacatatctctgttagagattggtcactgatgccttatttagctcgtttggtgaggtcatgttttcctggatggtcttgatacttgttgatattcatcaatgtctgggcattgcagagttaggtttttattgtagtctttgtaatctaggtttgttgtacctgtccttgggcaggctttccaggtatttgaaggaacttaggtgttgtgatctaaatttttggtcactgcagccatatctgcattaggggataccccaaggcccagtaatgctgtggttcttgcagatttgtagggtacgactttggtggtcttggataagatccagaagaatcctctggattagcaggcagagactcttgttctcgtcccttactttctcccaaacaaacggagtttctgtttctgtgctgaactgcctagacctgaggagggatgacacaagcacccctttagccaccaccactgggactgccttaggtcagacttgaagccagcacattactgggtcttgcccaaggcccactgtaaccgctgcctggctgccacctatgtttgtgtgaggccctaaggctctataatcagcaggtgatgaagtcagccagtatcaggggaaattcagccagatatcgggtgaaattcacccccaatatttcacgtaggttctttcctattttccctaagtgccggccagtctgagaaataaagggacagagtacgaaagagagaaattttaaagctgggtgtccaggggagacatcacatgtcggcaggttccatgatgccccacaagccacaaaaccagcaagtttttattagtgattttcaaaaggggagggagtgtatgaatagggtctgggtcacagagatcacatgcttcacaaggtaataagatatcacaaggcaaatggaggcagggtgagatcacaggaccggggcaaaactaaaattgctaatgaagttttgggcacatattgtcattgataacatcttatcaggagacagggtttgagagcaggcaaccggtctgaccaaaatttattaggcaggaatttcctagtcctaataagcctgggagtgctacgggagactggggctaatttcatccctacagctgcgaccgtaaaagacagccgcccctgaagcagccatttcagaggcttaccctcagggacacattctctttctcagggatgttccttgctgagaaaaagaattcagcgatatttctgtcatttgcttttgaaagaagagaaatatggctctgttctgcccggctcaccggcagtcagagtttaaggttatctctcttgttccttgaaccaattgctgttatcctgttcttttttcaaggtgcccagatttcatattgttcaaacacacatgctctacaaacaatttgtgcagttaacgcaatcatcacagggtcctgaggtgacatacatcctcctcagcttacaaagatgacgggattaagagattaaagtaaagacaggcataggaaatcacaagggtattgattggggaagtgataagtgtccatgaaatcttcacaatttatgttcagagattgtagtaaagacaggcgtaagaaattataaaagtattaatttggggaactaatagatgtccatgaaatcttcacaatttatgttcttctgccatggcttcagccgttccctccgttcggggttcctgacttcccgcaacatctctccctttctttttatataaatgtgccatggtgatgaaggcttgttcattctcttgatttttacccaggattctttgactggtccggcacactaaaaacaagctgattaaacagagaaatgtaattccacaatttactacagtggagcccccaatagacttaatccaagtcgtggggtttaatccataaagattttctgccacctgatctaacgcctcagctccaggcacaatggataagtgagcttgagaggcttcaaaaatttgtttctttaatttagttatgtccaatgataaattatcttccctacccagaaggcgtcctttgaccatttcccatgaataatcagtctcattataggaataggggatgatacagaaatccaaagtattccagttgcactgcatttgcatgcgatgttcgagactcaccacccaatctccaagccaaataacagactgtcttaaatcattaatttgattagcttgtgtccatcccttaagggcactgagtttccctgggctgcgggtaggtccagagattctgtccaggagccagggcctggagttggaaaccttaggaataatcctggtgctctgttttactgtggctgagctggcacccaggctacaagacagcatccttcccattcttccctcccctttttccaggcagatgattctttccccgtgtccaccactaccacaggcccacaaggagttctgtcagggtaccacaaatgtttacttaaggcccaagggctcttcagtcagcttgtgttgaatactgccaggcctgggactttcccttcagggcagtgggctcctcttggcctaggtaggtccagagatgccatccaagggccaaggcgtggaattggggagttggtaccaaagcttaagacaaagtcccctttactctttcctgtgtgtggaggctgtcccagtaattcagatttggtagaatggtggcttggaccagagtgatagcaatgggagaagacattagattttggacctgatttgaaaataggtacaggaggatttgctgatgttttgaataatgaggtattggagaaagaaaagcaaaggatgacttacatggttttgggcctgaggaactccaaaaaagtcattgctttttacacaggtgggaggtcttggaggaacaggtttttgcaattcagagtacagctttggcggccaggtgtgatggctcatgcctataatcgcagcacattaggggggctagcatgggaggattgcctgagcccaggacttcaagactagcctgagcaatgtagtgagaccccatctctacaaaaaaaatttttttaattttctgggtgtggtggcacattcctgtagtaccagctactcaggaggctgaggttgggggattacttgagcccaggagggcaaggctttaatgagctgttgtcatgtgactgcacgccagactgaacaatacaacaagattctgtctcaaaaaaaaaaagtgcaagtttggacatgatgggtgtgggatgtctgtaagacatgtaagttgagatgttgagaaggatgttgcaccatggcattcaaagagaggagaagtgtaggctggagacataaatttgaaagttaatacaattataaattatgagaccaaatggtatcatcaaaggagtaagtgaagatagaaaagaggtccaaagactgagagacctgggcactccaaaatttaaagattgaggagataaccagcaaagggaatgaagaacaaacagcaaatatggagggagaaaaactaggtgcatgtaatgtcctcacaggcaagtgaaaaaagtgtatcaggaactagagagtgtctcatactgctgataggtcaagtaagatgagggcccagtaattggatagagtaagatggagctccttgatgactttaacaggagcagtgtaaggagaacagtaaggtcagaagatgacttgaagtggataagagaacatcagataagataaattggagacagacactgtgggcaactctgtcttgaagcctggctgtaaagaggagcagtagtctttgaagcagtaacagaagcaagatacggggtcaagagggtattgttttcagggggaaataaactagtatatttgtaggctgaaagggagtgatgcaataaaagaagaggtagagggatggtaatgaagtggggagggaattgctgtttaacaattagtggttatagaagtgttttgtttatattttcataaaacacttgattaggacttaaaagatctgggtactaattataattttgtgacttaggtagtcattgaaaatttgtatgctttagtttctttatctgcaaaaatgttatgaacataaaacagttaagtatatgatcactttgaaaaggtgaaaagcactactgtgcttcattattgatcactctcttctttctctcataccatgaaatgtgcccattcatggcagaaaattctcttttaaaattcaagtgctcacatttttctgtttttgacaaaactatcatcatttatttatgtataacaagtagttataaataatatgttttgtgaaaaggctataaatctgtttcaatgtgttaaatcttacgtatggagctgtataaccttgggaagtttttatcaataaattaagttttctgtgtgatctttagttcattttcttaacagtaccaaatcaataaggaagaaaagtctaattccataaatggtgttggcataattggtaagcttttgggaagaaaacttaattttgatcatcacttcatagtacttaccaaaacaaattccagtttagttaaagatatttaaatgtttttttgaaaatcagccagcctgttttttgaaaaattagattactggctatcctggctaggaaggactttccaaatttaaagtgttaggaaaaatcacattaaaataaggatagactttattaagtatatttaatttctgcatttccaaaaggcaaagaagaaaagtttgcagaaaatatggcaaagaattaatgtttttttaaatgctaaaattgataaatagaaaaacctgttaaacctcagtagataaatgggcagaaggtatggacagacagatagaataagagatcaccagtaaataaaatgataaaatatctggccctgctaataattttaaaaatgcaaaccaaacagtagtgaatgactatatttgtcctattaaattagcaaaagcatttttttttcccctagagacaggttctcgctctgtcactcaggctgggttgcagtgtcatgatcgtagctcactgtagcctcaaacttgggggctcacatgatcctcctgccttggccccctaacagtagctaggactacaggtatgtgccaccatgtctggctaattttttttttttttgtaggggcaggtttctccacctcagactcctaaagtactggtattacaggcatgaatcaccatgccagccaggaattttaaatagttgtaccgattaagagtaaactttgcactctcatgaattgttttgtgagtataaatttagctctttaggaaagctatctgggaatattaatcaaaggtctaaaaaatatgtatagttttaataatctgagggcatatgatagtcaatatttagtaataataaaatgccagacttattcagtgcttactatttgtattcttctgagtctgtacatgtataaactcacttaattctataacagctttattaggtaatatttagaaaaggaaaccgaggtataaggaggttaagaaacttgcccagggtcacacagctagttagtagtagaatcagaacttgatccctggcagtcctcagaacttaggctccaaaaatttaatagtatttttatagagagaatatttattatggagtatattggaagtttaagcactaatgatctagctttttagttgcttcttcaagaaatagtaaaaatgatagtgaacacttagtgagagcttactatgtacctgacaagcactttccatttcttaacttatttaatactctaaaataaccctaggaggaagatactatgattagcaccattttgtaggtaaaagctctagaaagatttgataacttgcccaaaattacccagtagagcctgcattttaaacccaaaatctgtccacttaactaataagttgtaaaaagcctgatagtctgtctcctaaccagtatgctgaactgactttataaaagtagtaattctttggatttgttttctcgaaattgagcttcattgggaaattaaaaacagaaacttttctttttttgtataagcatttaacacataggaagcagaacactggaacaagctaaaagaagttttaaaatgttttcccccaggatctcattgctaattaactcatgtcttcttccaaacatctagtgcccttcgcagtcttacaagttgtcaaaaataaaagtatcatgaatcaaacaacaaatctatgttatatctacagtgaatgctgtccttctgacaattgagttaatcaggtctccctggctagttttaaaactaccgcttacagctatacaggactccttgtctttatgctgcttcctgggcctgtatgcccacttcatttacctaactcctttctcattgtttaaaattcagtttagatgttactactaccaagaagccctccttcataaaactcaccctttctacttgatttgaatccagtctactcttgtcgttccctatgattacctcataacattagtgcatttttttcttacctgtttcctgcctctgtaccccagcatctaacaaagcgcatatcattcagtgtgttttttaaattgatgtggggagagagggtataggggaatacaaatttctgcatagtaaaaagcactgggaacaaagtctaaagactgacaggccatagaaaaatgtactcatgtcacaaatgactagtttcttaacatacagtagtccccctttatctggagaggacacattccaagaaccccagtggatgcctaaaactacagatagtaccaagccctatatactgttttttcctatacatatatacctatgataaagtttaatttataaattaggcacaataaaagattaacaacactaattaataaaatagaacattataacaatgaactctaataaaagttatgtaaatgtgtgctctttccccaccccaccccccaaaaaaatcttattctactttttactcacctattttcagaccgctattgacagtggctaactgtaagcatggaaaatgaaaccatggatgaggggggactactgtataaagctgtatatagctcttacaaatcaataagaaaggccaataacccaataggaaaatgagcaaaaggaaaacagatcatttgtagaaagggagaaatgtctcaaacattataaaaaagatgagtcagccccaatagtaataagatgaatgcgaattacagaaatactgtttttaacctttcaggttaggtaagaccaaaaagttgatgcagtagggaaacagacacaatgctaatgggattataaattggtagatccttttgagttgcttgatgttcttccagaattacaagtacatatatattctgtaacagttccatttccaggaatttatcctacaaatatactaaaatgattatttacagcatacacattattgcattgtttgtaaaagaaaaaaatggagatactctgagtgtacatcaatagggggcagactaaatgaattttatttatccattcaattaggtcctctgtagtcattaaaaagaatgagacagctctgtgttatagggtgagcttccagatataatgttaagtgaaacagcaaggtgcaaaacaatgtgtatagaatgataccacttgtgttgggaagaagaagaaactgcacttgggtatatgctttgtatatcagcagactatttctgggaagatatcagagaacacaacagtgattatctctgggaagaagcactgattggtcatggcaggctggggaacaagtgtagtagaagggcatattttttcactgtctactctttaatcttttaatttgtaatcttgtgtgtactacctatgtataaaaataatttgtaaaagaatgaaaagaattacaaagtaaaatatgaattgttttgacaatcacaaaaagcaagtcaccagcaatgagcaaaataaggaaagaactcattaatattcattgaatttttttattttttttatttttattttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccaccatgcccagctaattttttgtatttttagtagagacagggttttaccgtgtattgcatgttttttatgtgctagatgctttacatataattacttcatgtaatcttcgtaaatcctctgagaaatacctagttttagctgtatcgtacaaagagattgatggagccttagaaatgttagcattcggctaataaggaagcaagggtttatttgaaatcagatcttttctgtttccatagttgggtttttttcccaccaaaccatctggcttccaattagtgaccatcttttattagtgaaagtaagtataagtgtactttaatagtgagcagcagttaccaaaaatgtccacaagatggaaatgttagacacaagcagatatttttctttgtaaaacatcatgctacatatccaagtggcatatttaaatagatgtgtcctgttttgcagtaacatttctttagtactttgttatagatagatagtttcagatatcacttaatgtttctcttttctcataacaatagttgatagggctttttctgtaccaggcagtattctgggtactttacataaattaattcattaagtcttctcaacaggctgggtgtggtggctcacacctgtaatcccagctgcttgggaagctgaggtgggataatcacttgaacccgggagtgagagtttgcagtgagccaagatcacaccactgcactccagcctgggtgacagagtaagatcctgtctcaaaagttttctcaacaaataatattatgaagtatttgccattatcatttctgtttcataagtgaggaacataggtgaaatagcttacagtgtcacagctagtaagtggcagagctgggattcaaattttagcagttattgccacctatttgaaaaaaagatattggcttgtattgatagtgtgattttgtttataagtttcacctgggccgggcctggtggcttatgcctgtaatccccgcactttgggaggctaaggagggcggattgcctgagctcaggagttcgcagtcagcctgggcaacacggtgaaaccccgtctctactaaaatacaaaaaattagccgggcatggcagcatgcacctgtagtcccaactactcaggaggttgaggcaggagaattgcttgaacctgggaggcataggttgcagtgagctgagatcatgccactgctctccagcctgggcgacaagagcgagactccatctcaaaaaaaaaaaaaaaagtttcacctgtatataaatttaagaatacttgtagttaacgcttcccccccacccccacccattaagacagagtctcactctgtcgaccaggctggagtgcactagcgtcatctcagctcactgcaacctctgcctcccaagttcaagtgattctcatgcctcagccaccagagtagctgggattacaggtgtgcaccaccacgccctgctaattttgtatttttgatagagacgaggttttgctatgttggccaggttggtctcgaactcctgacctcaagtgatccacctgccttagcctcccaaagtgctgggattacagacataagccactgcgcccagtcacctctcattagctgatgtatcttgggtttgtgtgcccccttatttcaatcttaatatgtgtatggaaaaaaggacattatgtcttaaaattttaactgtgagttggtgaccagaattttatttttagttgtaggaaacatcttagatcctctcttgggaattcagacattcttcccctcccccaacctgcacccatgtttaatgttgtaattcttaagttatccacatttcatcatggaaacattgtcgtcaggaaatgccatatttattaccctgtcatatatcttaaacatgtgagaaaaatactttagtaaaagtatttgttttctttagttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctccctcctgatgtgtttcttcctctttgaagactttctggaactccctcaatacagttaaagtatctttatagtattgtgacatcacatctcttattggcactcattgtcgcatgtagaagctctttgatggtaaagattatatcttaagttttgttctgcctatatcatagtgtcattattcttcacatacaaatatattaattcttaggggccaggcatggcggcttacgcctgtaataccagcactttgggagtccaaggcaggtggatcacctgaagtcaggagttcaagactggcctggccaacatggtaaaaccccatctctactaaaaatacaaaaattagccaggcatggtggcacatgcctgtaatcccagctacttgggaagctgaggcaggagaattgcttgaacccaggaggcagaggttgcaatgagctgagatcacgccactgcactccagcctgggcggcagaatgagacttcatctcaaaaaaaaaaaaaaaattaaatctttcatagagacatatgggaagcagctgcagctgtgcattagcttcatgcactactcctaccctctcctctttagcctcttctgttcaaatccacacagcaagtcctctacttttagactcatctacttttaacattcattaatacctaatctttaaaggtatgttggctgaaccatcttggcaacctaggaacaaaaatacttttttatctgtctgccctgatggattggttactttttactttgtggctttattttttaaagttgtgacttttgcaattattatggaggatgtacaaaggcctctgtggtctgaaatttcggccagagccctctggggcttgatggtggtactttcaattgtgccaggcatcattcattttctctgcaccttttatccccatgcctacctgccaggcttatcatgataagatttcccaagtatcgcatagggcctggggatagatcaggaaaataacatgagggaaaagccccattctacttgaggagttggcacaggcaatcattattctagtcagctgcccacgaatgtattggttcaaatgtattggttcataaaactaaagtccatgtaggtaggtctgacttcatgcatgcatacaagggttcaaaatatgtggtcatggctcaatcttactctctattggctcttatttctttgttggctttaatcttggtaggatttcactgtgacattgcaaagaactcctgtaactcaataaaaatttttttaatgggcaaaggatttgaacagagatttctccaaggaaggtatcaaaatggtcaataagcatatgaggagatgctctgcatcattcatcattaggaaaatgtgaagtgtatcgcatttcacttcacatccaccattgtggctataattttaaacaaaatacccaaaaaagttgatgaggctatagaaaaattggaaccctcatatattgctggtaggaatgtaaaatggttcagccactttggaaaacagcttggcaattcttcaaaaagttaagcataattatccaatgacacaacaattccactcctagatatatacccaagagaaatgaaaacatgttcacacaaaaacttgtacatcaatgttcatagcatcatgcatgactgccaaaaaggaaacaattcaaaatgtccatcaactaatgaatgcattttttaaatgtggtatctccatatgatagattttcccattcttttataagtggaaagagaatatttcccaagggataatttcttcatctagacaataagaagaattaaagaaactcagctaattaggcagctcacttcttgaaagaagatcaaagtattagtttcattttttctaaccaatgtaggtgtttggtgctgttattcatattttacagataggagattaaggaactatagcttggtgttgagtcaaccagcagtgactcagatgagtaatctgctatgggcttttct

SEQ ID NO: 12608 - DNA, 77626 bp, Human
  misc_feature (1)...(77626): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggtggggagggtttctctgtccgagggtgaatcatcagaggctatatgtgtgtgatttctccgatgctgagtgcaggccgtttctgccttctctgaccctgatagagatgtgtgtttgtgttcaggtgtggcctggcatggtgggcccacaatggactttggccttgccctccaccagcacgctgtttgggccctgacccctcagcttgtgtttctgtatcagcatgacagggacaagggcacctgccttagggggacatgttcgaggctgagaggggatgctgggcagaccccagcagatgggacggcttttttcctggggcagtgttcagcctggggaaggggcaggatgggcctctggagaagggtctgcaggccgggcagactggctggtacagggactgcctgcaagcccagaccagactcttcctgccccaagtggccgaacccaggaactgttcttgtcttgggagcagggactggcactgggctgggtgcagccatggcttcccttgtgtgtccaaacactaccccaggggacaagtcccagtcaaggccacacagcagggccggggattggtgctcctccacgtgtctggtggcaggagccccgtcctgtctcacaggtgaggcacaggcaggcaaagcctcccatgggcgtatgaggcagctcagcaggggcgagggggcaggagattcagccacagtctctcccgcgctcatggtgtcacagaggaggagacggggcttgggtgccaagggggtgctgcagccaggggacaagacctgagggctccccccatgttgtcccctccttgtggactatttgagcgcccttcatgtgtcagtctaactgtgaggagctcatgccaaagcccaggcattagtttaggaagggccaactctgttgacagagggtctggggtcagcctggaatgcaatggcctctgatgtgatgccgccctgcactgagcctggccgggaccagcgcagtccgtccatccgcctgcctgcccctggctgtccgtcctcccagacagggctggagctttgcccagctgggctgcaggggcacagccaaagtcaggctggtgtgacccatgacaggcttgttgggggccagtgcttctgatctgtgagcccctgggacacaagcctacctgattcacagctgcagcaaatggagactcacgtggagtccatgtcctttgtggggggatgctgagagggggtcgccaaggaggggcgccagagttgcgcgtggctgcccaagcccctcttgttgcattttacctcatagggtgtcgcaggccaggtctgtccatttggtggtggggaaagtgagtcatggtccagacaaaccactttccaggggtcacacgattggggtgggggccctgcatctgggcaggtgctgagcactgtcctcagacagcagtgctgttgctgctgaaaacggcccctggccccatgcccacccgcataggtgcctgagtcccctctctacgcagtgtgtgttgctgaggatgggctgcctgtcccgtcactggctgaagagcaggggtgtgttttagggaaaagggccagcacattcctgttgtgagggttgcactgtggggactcatgcaggaagatgcaggctggggacctgtcctgccgaggacctcccagtgacaccccctccccctccacgcagcacatctccatcccccagcctgactgccccgcagaggcgcggacgttctccttctacctctccaacatcggccgcgacaacccccagggcagcttcgactgcatccagcagtatgtctccaggtgaggcgccgccccaccccagagcaccccgccggctcttgaggtcaccctgccacctctggcccagggttgagatgtgccccattgaaaccatattgcctgagatggtgttgacagagtccattttccaggccaggtggtgggctgggggcttgggccctcaacggatcctccctgcattgtcccagctgctgaccccagctcctggccttgtcttgcagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggtgagcagtgggtttggcagggctgtagggcagccgggcagctgccagtgtcgggagacatttggggcctgtccaggctgggcactggctgtgccctgcacagaaatgatgggtcaaccgaggagtcggtccctgagcaggacgtgcctggaccagagtctgggttgggaagagaggtatggccacatgggcctgggggctatgtgagggatagggggttgggttatggcagctgctggcttgtgaagcctgaggtggacaaaggggcctgagaactccaggagctgtgagttggtggtccctgctttcaggctgcagccttggggaccttcacctgtcagggagatcaacaggctccctgaagatgggcatgcagcctagggcaaggcccatgtctgtctctggaggctgcccccaccctcacctgaccagccagctcctgcccaacgccaccacagccggcaacaggcaggaaatgagcctcacaggccctgttgccagcgacccagcactgcaggaaagctctggccactcagcatcaacttggaaacggtttcagcagttgagaagccaacaggccttgacagtgggaagcacagtgctgtttgtttacagagctgcagcaccccgcctcttagtccaggcagagctccaggagtcatgggaactcattacggcaggagtagggtgccgggcttcagggaggagggagatggctcagagcagacgacagccttgatggctttttgagttttatctttaagaaaaggcgggggcatttcaattcctctctctcctccttccgaagaaagcacgtgatttccctttgctgagcagaggggttccctctgagtgaaaccccagatgtgggtgcaggggttggtcttcctggtcaacactgagtccgggtggacatgtatggccagggagcccgggttgtccatgatgttgaggccctgggctgtaagccccaagcacagggctgctgtggggagaacagttgaagagacagcgtgttttgttttttgttttttctttttttaaagacaggacctttctctgtcactcaggctggagtgcggtggcacaatcatagctcactgcagcctcaaactcctaggctcaagtgatcctacctcagcctccagagtagctgggaccacaggtgtgtgccaccacacatggctaacttttagattttttgtagagacagagcctcgctatgttgcacaggctggtgtctgactcctgggctcaaatgatcctttcgcctgggcctcccacaatgctgggattacaggcatgagtcagcgcacctggccccatatacatgttaataaatctgtgggtccttcagccaaaaacttgatcagaaatgtatcttagcacaccactttgggtacagtgagggtttttttttttttgagatggagtcgcggtctgtcgcccaggctggagtgcagtggcgcgatctcggctcactgcaacctccgcctcccgggttcacgccattctcctgcctcagcctcccgagtagctgggactacaggtgcctgccaccacgcccggctaattttctttttttttgtatttttaatagagacggggtttcaccgtgttagccaggacggtctcgatctcctgacctcgtaatccgcccacctcagcatcccaaagtgctgggattacaggtgtgagccaccgcccctggcccagtgagggtttttgaaacagtttatgttctggtaggggtctgctgtctgtttagatgtgaatgtggccagatgcattggctcacacctgtaatctcagcactttgagagtccaaggcagggagatcacaaggtcaggagttcgagaccagcctggccaatatggtgaaaccccatctctactaaaaatacaaaaattagccagttgtggtggcgtgcgcctggagtcccagctactcgggaggctgaggcaggagaatctcttgaacctggaaggcggaggttgcagtgagctgagattgtgccattgcactccagcctgcgcaacagagtgagactctgtctcaaaaaaaaaaaaaaaaaaaaaaaaaaagatgtgaatgtgcgtgttcctctgtctcacagtgcccccctcaggttgctcctcctccctgtcaatcagcctggccctatatgggtgagtccagccctgctgtcaggaccccactgaacagaccccagaggtgtgagcactggccctgggtattctgaaagcaaggctttctgggttaatttgacagatcagattttgagagataagatcagagtgatgttgttacgaagagcttttgggggaaggatttgaggcactgttgagcttgctcggccgaccctgttcccaaggatgccggggcatcattgttcaggacagagcaggggagcagcgtgctggaccctgcccacgtctctgcgttggggatagaggggaacctgctctccccagggctctgggcacagccacgcctgccagaggagagcttgaccaggcctaaggctggggtgccacttgcacctcagggtcttcagagcagctgctgaaagtggctccgacatctttactgactttagaaaaacaaaaatggcagccacatggggccagcataggactctgaagtgcaggcttgggagtgactgcctcttgcagttcagggacccccagtttaacatcagaagggtttacaaacagcccctgcctcaggttgggcaggatggctctggtttataataccagcactttggaaagctgaggtgggagggtcctttgggcccatgagtttgagaccagtctgggcagcatagtgagaccccatctctacaaataatataaattagccaggcatggtggtgcacacctgtggtcccagctactccagaggctgaggtgggaggatcgcttgagcccagaagtttggggctgcaatgagccatgattgtattacactccagcctgggtgacagagcaggatcctgtctcaaaaaacaaaacaatccttccccccccgccccccgcccaaacacacacacacacacacacacacacacagcccactagagtgatcaggtgatttcatacacgcacacacacattgcccaccagagtgatcaggtgatttctcacacacacacactgcccaccagagtgatcaggtgattacatacacacacacacacacacacacacacacacacacacacacactgcccaccagagtgagagtgatcaggtgattttgctgtccaggatttaggttgcctgtgatgaagtaagtaaggctctaacacagttctgccgcctgcacctcccacttctgaggctgggtgccctgcaggtgcctgccttgggcagcaggtggcgctcttggtcgcccagggtccccaaggagcaagctggcttttgctgtggttggtgtggtgcctcccaccagcactgtctatagtctcaaacctctgggcacctggtcagcagcactggcttaggacacggcagcgccctctctgttccctaaagcttggattcttgttgcaggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtgggtgccgccccgatgtcttgtctttaccagtggtctccgcagatggtcttgtgcgggtgggatgggccagagcatggagactgggattgggactggcaaggaagagcccttcctggggtctctcacaggttcagaacctgcctgagagccagggcctcctggattagaacaagcttagggggccatggatgcgtttctgggcatggccccgactgtccagggttgagaggtggactcagcatggagcccaggccctccttcactgtctgctgacacacgggccgtggggcctggcacagtggattcaggcttcagttgcagacgatttgtggactcaaggcctggggaaggaatctacacgtgcctggcagagcctggcaggcctcagtgtgaatcagctgcctgccgccctccacctgcgcctccgggtgaggggcttcacgtctcagaccatcaggcttccatctgtgacctgcagtgcccctccctggggttggaggctaggccatctggaatgtggtgctggcgagtggagcctgctcttgagaaacaccccgggcattggagcaggtgcgatggccctgactgccttccacccccctcacccatggaggttcctgaggctccaccttggcttcctggggtccctgggaaggggagtgactcgcactggcttcagaacattagccaggctatgcagatgcagccttgaggtgaactgaggatgggtctcctcggatcgctgctgtggtggaggaagagacatggctgagcctcttgcaccttttaggatgatggaagtgggatgttcggggtcacatccagcacctcaggaacacaggtgatgcctgcagcaaaaagcacatgctgtggcatgccgggatagcagctgtataaaggacgttcttccatgtttacggagctcctcataggcgtccctctcgggtgcgcggctggtgggaccctgttccacattccttgggaggatgtcagcctggccctcgtccacccccatcctgctcccaaggctagggctggcatggtgccagcaggagttgctgaagggagctcgatggagtcatcagatgtgggacctgcattggcctggccaggaggtgtctgtgctggtgcctggcttctccaggtgactttggttcagtgcctcctgggagcaggcctggccagcatctgcaggcagattgtcccttcctgtgccactgtgacttcccctggacagctcgtctgcttcttgcttctatattcattatgcagctgcttccccccaagcagctgtgggggtcagcaggacactgttggcttgtagaagaggagggggatgtgcctcacccagactggtcatttccagcccctcacaggccctcagacatgctgaggaatggcagtgacaaaactgcatgcctcaaaggtgcttggccctccctctgtggaaaaatctagagcagagatggaaggtgtccacctctaggactggctgagccccagggaaacccgcaagcctatccttcaaggggaggggtgttgacggctgagtaatatttagcaaagcctgtcatgagccataaaaatattcagcctttgacctactaatctggcttctgggaatcccgtcgaaggaaactgttgccaacctgaaaaaaactgcacacagtaatgtctgtttatgctacagagaaactggcagcagtttgggggtgggatattactcaactgttaaaaatgctccccatgggctgggcgcggtggctcacgcctgtaatcccagcactttgggaggccgaggcaagtggattacgaggtcaggagatcgagaccatcctggctaacatggtgaaaccccatctctactaaaaatacacacacaaaaaaattagccgggcgtggtggcgggtgcctgtagtcccagctactccagaggctgaggctggagaatggcgtgaacccgggaggcggagcttgcagtgagccaagatagcgccattgcactctagcctgggcaactgagcgagactccatctcaaaaaaaaaaaaaaaatgctccccatgggatacgctgtgacgcagagccatgtcagatgcagcagaaaacagtgactgctatgcctgcagcaagatggagaccagagtgccctgtaggccagcacgcagcacccactcagggcagtgacctggagcttcctcagatccctctaaggcagacgttctgaatccatctttgttagcagtctgggagacgaacttagctttggtcaaccggcaacagcaaggcaggctggttgtagggaaggtgggctcagacgtggccccagaggtacccctcacccagcatccccagccgtggctgactcttccctgggagttgtgatcagaaatggggtggagcccagcgcggtggctcacgcctgtttccagcactttgggaggctgaggtgggaggatccttgaggccaggagctcgagaccagcctatgcaaaatactgagatcctatctatacaaaaaattagctgggtatgatagtgcatgcttatagcccacctacttgggagactgaggcaagaggatcgcttgagcccaggagtttgcagctacagtgaaccttgatcacaccactgcactccagcctggaagaaataggagccaggtgtggtggctggaatcccagcacattgggaggctgagatcagaggatcgcttgagcccaggggttcaagacaagcctggacaacatagcgagatcccatctcttaaaaaaaattagctggagtatagtggtgcacacctgtggccccacctacctgggaggctgacgtgggagggtcgcttgagcacaggaggtctaggctatagtgagctaagatcttgtatcaaaaaaggaaaaaaagcaggctagaggggccagggggcaggtgatggggtctcagtactgcaggtggtagccctcccctttttggagccagcctggccccagcacctctaagacagttgagtctggacctgccttcatgaccctcattatcccttctgcaccctgaggattgtgtgcgggggaactgggggtgggagacatcacggatcggtagtgggccatcctctttcctctcctctgtctctgtctgtctcccactgtctctgcacaccctcccaaacccactatcagatcttttttctctagtcccccgtctctctcaggattcccacaaagtgatggctggctctgtcttgcaggtggccaacatgagtgctaaggacggcacgtgtacactgcaggactgcatgtacaaggatgtgcagaaggactggcctggctactcggagggggaccagcagctgctgaagcgggtgctcgtccggtaatgccgcctcccatcccccagcatgtccccacccgcatgaaggcagccagagcttacccagaggatgctggggtggtcttgtgtggtcctgaaggccacagggcttgggagcaggatggaagggtccaagtaggcctctctggccatcctccctactgcccacgtggtgccccagggtgtcccgtggtgggggaaggccacgctcacagagtgggacggaggtgtgagtcactggccccgaccttggaatcttcagacaaaaggcctcagtctgctgagaccctcctcagctgtccccaacttcccttcatgcttccctccacaacctgggcatccccacagggcctgggaagttcactgactttttgaaaagagcctctcaagaacctgaagtagagagaaataaggccaaacgacactcccggcagggcaggcgtcattaagcagcgttaattaaatgcatcccctcaggctaattgggacccagggtcagaagtggcagcagctcaggggagcagtggttaaggaggcaggcggctaatgacttccttctccactgctgccagctaggggagctcgggctgtgaagcaggtcaatctgctaattagtccgtaagtgatttctcagggactcggaggtatttatgagtttgtagttgttttttggaagttcagctgtttaaagcagtaattgcctctggaaagcagaatgaagttgggggtccactctgctcccctgagagggtagtgcctgcctgtccaccctgggtgtgcaggtcaggggcctgcggggcactgccctggcttggcggcaggctggcggagggcacagtcttggcagaagacccgcccccatcctcataccctgtgtcctctcccttggccccctgggttcctcagacccttagggcactggaaggagaactgcccagagctagtggagtgaggtggagaaggctgggctgcacctctggggcgtcggggagcttccccgggatgcaggctccagagccgcctccagctcccctgattcaaggctcatgttccgtctgctgagtgagcttgctgggctcatgccagccccttggcactctgctttcactctgggccggcatggggatcagcactgccttcacaagcttccactagcgtgcagggggcagggttgatgtccctgggccataaccacatagaaggtgacctgcggtgcccctctgcatagctgtttttttttttttttcctatttagcaccccatccctaagaaagccccatttatagcagtttttgacaccatggcttcgtgtatatcaaagcagggccttggagtatttgttaccagctgggctagcccagtgcaggccgttagcctagtgcaggccgtgagacagatgggatgtgggggcccaagtcactgcaggagcctccccagctgagctggcaccacatgtggcttttgggggtggtttctccactcatgttctctttgttcatgatgtccaaacccgatctgtccctggtatccaaatctcctctcatcactgtccatgggtcaggggtcctgcaggtccccccaagagttcctgattcctctgcccaagccacacactgcctggtgcccttacctccaacctgagccactcccctctcctgtgagccccatgccagagtctatatactcctccttcctgctcctccctggtgccaagggagcacagctcctggagcacctctctgaggacagggctccaggaggactgctggccacatcttcatgcccagacgatggtcctgctgagccggcggttgatcacatctagacttgtagagtccaagatgctttccctccacgttgaaggtcagaggcttcccaccccaaccctgtgctggtccacagagccaggggctggccaggtacctactctgggatggtgggcaccacggcccccgcaggctgaaaacttgccttatccgtctatccgtccttctgtcctgtgtgtggtagtggaaaggcctatcctactgcacaccacctcaaactgctcttggcaggctgctagagtctgtcctcctcttcctggttttcatctcttttttttttttttgtgatggagttttgctcttgttgcccaggctggagtgcaatggcgcgatctcggctcacagcaacgtccgtctcctgggttcaagccattctcctgcctcagcatccagagtagctgggattacaggcatgcgcaccatgcccggctaattttgtatttttagtagagatggggtttctccatgttggtcaggctggtctcaaactccggatctcaggtgatccgcccacctcagcctcccaaagtgctgggattacaggcgtgagccaccgcgcccagctggttttcatctcttgctcttttttattctccttttaggagacttctttgacatttctcatcctgtctcttaatttactattatttgtagtttctttttttttcttgagacagagtgttgctctgttgcctaggcaaagagatggggtttcaccatgttctccagactggtcttgaactcctgacctcaagtgatctgcctgcctcagccacccaaagcactgggattacacgtgtgagccaccatgcaaggcctattatttctagtttctaagagtcttccccattgcgttttcgtaggagcatgttcttttttttttttttttcctgagacagagtcttgctctgtcacgcaggctggagtgcagtggcatgatctcggctcactgcaacctccgcctcctgggttcaagcaattctgtgcctcagcttcccgagtagctgggattacaggtgcccgccaccacgcctggctaatttttgtatttttagtagagatggggtttcaccatcttggccaggctggtctggaactcctgacctcatgatccacccgcctcggcctcccaaagtgctgggattacaggcgtgatccactgtgcctggcctaactcatcatgttcttatttaatggaaaggatgtctttttctttctttctttctttttttttttttttggagagggactctcaccctatcgcccaacctggagtgcagtggcgcaatcttggctcactgcaacctctgcctccccggttcaagcaattctcctgcctcagcctcctgagtagctgggattacaggcatgcaccaccatgcccggctaattttttgtatttttagtagatctggggtttcaccatgttggccaggcttgtctcaaactcctgacctcaagggcctcagccttccaaagtgctgggtttacaggtgtgagccaccgtgcccagccaggatgccttttttttttttttttttgagactgagtctcactctgttgcccaggctggagtgcagtggcgcaatctctgctcactgcaacatctgcctcccaggttcaagtgattcgcctacctcagcttcccgagtagctgggattacaggcgcctgccaccacgaccggctaattttgtatttttaagtagagacagggtttcaccatgcaggccaggctggtcgggaactcccaacctcaggtaatctgcccatctcagcctcccaaagtactgggattacaggcatgagccattatgcccagcccaggatgtcatttttaacctactctaaggatgtttattttatttatttctttatttattttgagacggagtcttgctcgtcacccaggctggagtgcagtggcgcgatctcggctcactgctagctccgcctcctgggttgacaccattctcctgcctcagcctcgcgagtagctgggactacaggcgcccgccaccatgcccggctaattttttgtatttttagtagagatgaggtttcaccgtgttagccaggatggtctcgatctcctgacctcgtgatccacctgcctcggcctcccaaagtgctgggattacaggcgtgagccaccgggcccggcctctaaggatgttttttaaagaataacagctttattcagatacagttcatgtaacacaagtcatccatttaaagtgagcagctcagtaacattttgtacgttcataatattgtgcagccaccacctctgtctagttccagaaaattttcatttccccaaaaggaaaccctatccccatcaggagtcattctccccattccctcccatgctcccagcccctggtaactactaatctgctttctgtctctattgatttgcctgttgtggacatttcagatcaatggaattatacgctgtgtggctgacatgtaatctgtggaaacctgtagctgtgaggaatgttgaatcaggaccgggcgtggtggctcatgcctataatgtcagcactttgggaggcttaggtgggaggattgcttgagcccaagcctgggctcaagttctagacaagcctgggcaacatagtgagaccctcatctctacaaaaaatgaaaaaattagccaggcatggtgttgtgctcttgtgatcccagctaccctagaggctgaggtgggaggatcacttgagcacaggagatccaggctgcagtgagctgtgactgggattagaggcgtgagccactgcgcccaacctattttctgttttttttattccagtcatccctgggtgtgtgtgaagtggtatctcgttgtttgttttttgtttggtgggtttgtttgttcattattgctccttgcagggcagggctaacccataggcagtgtgcccagagtagccagtgtctcgttgttttgatttgcatttccctgatgacacatggcattgagcatcttgttatgtgcttttagccatttgtatagcttctttgaagaaacgtctattcagagcttttgtttttccaaggacacgaaaactggcattttttatttatttattttatgtttttgagacggagtctcggtcttgttgcccagactggagtgcaatggcatgatctctgctcactgcaacctccgcctcccgggttcaagtgattctcctgcttcagcctcccaagtaattgaggttacaggtgcccaccaccatgcccggctaatttttttgtacgtttaggagagacggggtttcaccatgttggccagactggtcccgaactcctgaccttaggtgatccgcctgccttggcctcccaaagtgctgggattacaggcgtgagccatgggcgcccggcctgttgatttattttttaacgttttcatctccctgtggagtctcttttcaaatgtattttcgtgttcctctgttttgaggtctgacgtttgttgcctggaagctgcagtgcagccgttggggacactgcacagcttggggcctctgaatcccgatgtgccctagtcctgggccctgtttcttcttctcctgaggccacacatctggccatcctgttgtccagctgtggcccaggtaacttcccaactgcctggaggagtggcccgagcctctttgctgcctgacagccctgggctcactgtcctgcagccccaccagcagtgatgaggatctggagtagagctgtgggggatggccctgcagcagtctgttgtcccctgaggtcgtggtgcctcttgctctgggccctggattctctggatcctgcagcagtcaccactcatgcttctgctatgctttccggtgtcttcactcctccttttgtctctgccttgcctgtccagtggatgcaaatgcctgttctcagttttctgtctttaactgggagttctgtttatgtccacatggctctcctctcaggccaccagggaagtgacacctgcagtggtctgtagcctagcccatttgttagggagatgggctctgggtgtcactggctggcagaatggccacggccctggacttaagtctctctgcagggcctggaggggcgctaggctgccctgagatggcacagcccccgggaattgaacagttgggtcagagaggatacccataagctgcagggttgctggcgggggtgggggattccacttgcccagatcacatggagcgggagaaggggcatgcactggggtgtttcttcccttcttccccagctgcatcacctagtcaagctggtggccactctgccgccctccagatcctgctgtgacctgggcttccaggaaggctgtctcatcctaggccagggccctccgttctcttctgcattttggacagtttctgcagtgagcgttctgaacaggatgaacagctgtctttaaaagcagggtccagcaccctagcgtgtgtccctggtctctccggtagcaggcacctacacaaagtgatcctcctctgggctcagggggacagtgagtggggaagtcctcctttgggtgaagtcgggggcaggatggcctcaggcccaggctcctgtgaccccttggccctgctctggatttgggaggaggggggtcccttccttgaggcatctccaccgggcccccatgtggatacaggcctggggcccctaggccccctcagcaccttctgacctagccctgcctctccttcgcaggaagctgtgccagccacagagcactggcagcctccttggagaccctgctgcctccagccccccaggcgagcgtgggcgctcggcctcgcccccacaggtaagtgaggcatgcctggggtgactgtcccaagcacctgcagggcactctgtgctgcatcagtaacccttgtcaccttcctcaccagctctttggagcatgagctgctccaagttgagccgcctccctccgcccagggaccaagggggaagctgtcgggttggggttgggggcagattcctgccagtgtggccgcagcaccccagtgtcacagtgcggaacctgggacggggggcggctccctgatgtgggctcaaccctgggcttcctgctcctgtgtcacagttatcactggggaagcatgctgagcacagcagcgctttagaccagtccccaggggtggcccgctcacacactgggccctgccctccccctgcatcgatcccagcaggctgatgggccccagctgaggccaccctgagcggcacctgggacctgacttggtgctcgggcgcccccatgtggccagcgtgggccttgcaggcggcgttgggttttctagccaggccaggggattgcctgttgctgctcagccactctgtgctcccctctaaaatgatctctgctcctctccagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtaggtgcccaggcaggagggcgttgccggggctctaagtactggccccacacccgcctcaccctcatggggtgtcgagggggctcaagctgtagaagccaggggaggggaccctgttgccccaggccccatcagatttgccctgtgtgcctggcacctggcaccctatgttcctgcacctggtcctctccctgcctgtctggagtgcccggtgccacttgcagtcaatgtgccaggccagcactgggggccggaggcccagagccttgtggggaactgaggccgcagaaggggctaacatgcagagaggaatggggcccaggccccagctctgactgcagggaagccccaggagccagggccatgctgaggtctgctggggttcagggaagacagtgggggcccaggcaagccagccctattcagggagaggcagcacaggtgcagatgggcagatcctggtgggagagggatagcacctggacctctgtaggcaccgtgcgactgttgtggactgtaggtttctgctgtggggacagggcctggcaggctgggattggggagccaggagacctgggcggctccgagaccacagcccaggcacctaaactgagcagcagtagcacccgcctagcaccgtggccatgagcctgcgcagctgttcatttataggaaccagcagaagcagtggccagcgtgcagcggctgttccaccaccatgtgcgacaggggctgcagtggtcccatgtggcgatggcggccagttgcagatggccacttcgctctcggcgccagctggcccagggcagcccaggtggtgtcacctgctgtgcttttgggttgtgtctctggggaggaggctgagtcaggggattcctgggatgagggtgggagcccttctttcattatagctttgcgttgctcagagggccatgccccgtcccctgctgtggctggagagcaggtcctcacaactgtggctgggtcttactggataggaaggaagactttcggggttgggtcagccctgcctcgtgctgggcttcccacctcccgtgggactgcatgtgggggccgacggggagaaggtggccttactccctgggcagcctctctgaccagggccatgctcagggcaggactcctgattcccaggacacacccacaccccacagccagacctgggccacgatcaaatggcaggatctgccatttgagacccttggcccggctccagggtccacagaccactctgggctgtgtcccttccttggatgcccagtgcctaggtgccaagacaggcctggggactcaaggtggtttcctgtctggcctggtgcgtgttggcccctaggcagttcatccccggcccaggggctgtcatctctaccacaggtgagaaaatgcaaagcaggggtagatgtcccaagcaccaagaaaaggacagtggaggcaccagaagctgagcctggtgctggtggtccatgttaccagagtcctgaaggtggtacttgtgcagggcatgtcttagctgtcctgtgcccgtgcccaggacaagcaagtagagagacgtgggctgtgaaggggagagatggggagaggagctgctgtgggggtgttctccggggccccgaagcagggaccagcttggccggccccacacagccagagcttgagtaggagtcgggggccgctgaggtttgccaagggctggactttgaaggtcccactggtaccaggttgagctgaccctgagccttgatttccccgtttgtcatcctagctggtgaagatcttggggcatgtcaaatgaggtaatgttgaccagcctgacacatggcagttatctgttgtagaatacccacggagtccactgcgtggcgggagcatgggcttggccttcgcagctgcgccttgcctctcacttccttctggcccggaccagggtcagacccattcaatacatgcccattgagttgcgtccctgggaaggccacagcctcttaaagacaacccaggtgggggtggtggtgatatggaagacagtgtctggcccaaagtggggagtgttagaaactttgtggggagtgagcttcgtccacttttgggaatttggcagcagagaagctgctgtggtcagcccaggtgtgttacactgagagagagggctcagcaaactggagatcgcagactcctgctctctcaggggatagtgcagagggcccctgaaaatgtgcactagggccaggcacagtggttccgcctataatcccagcatgttgagaggccaagtcaagaggatcacttaagtccaggagttcaagaccagcctaggcgatataggcaagcctcctcatctctactaaaaagtaaaaaaaaaaaaaaaaaattcgccaggtgtggtggttcatgcctttaatcccaacgctttgaaaggccagttcaggaggattgcttgaggtcaggagtttcagaccagcctgggcaacacagtgagaccccatctctacaaaaaaattttgtaattagctgggcatggtggcatatgcctgtagtctcacctacttgggaggctgaggcaagaggatcacttgagcccaggagttcaaggttgtagtgagccatgatcgcaccattgcaactccagcctgggtggcagagcaagaccctgtctctaaaaaaaaaaaaaaagtgtattgaggatacatctgaaattgataaaatcatttctgtatcggaaagaaagccactgcaagaaggtctagaaaacgcactaaattgtagttgtggtcttaggcgacgcgcacttcagtcttcctgcccctcccctccctgatttccagaccctcaggggtgttgtcttatgtggccggggcaccccaccacatggctcaggagcaggacagctgcctggggtgccatctagccatcagctgtgctgctttgggcaggcccctgaaggggcgaagggctgagcgtcatcatggacactttgctcatggatggccgattggggtggcccatgggctcctctggctggccctgtcctggagctgccttgtggagcgtgcaattcagtgtctagtggaaaggacgggatgatctgggtggggcacagaccaagggcgtggaactttgtcagcagcaagagatgcaggccctgctggccatcttgtctttgtcctgtctggccagagactgggatgccccagagactcaggtcaagccaggggtcatttgttttcagcttagtgacctttgacatgcagtcagtggaggcagcaagggcctggcctgggggaagctctgaccggttgtgcaggctttggccctgcagttccctgacctgtccgctgtttgccaagaatgtgactgtggtgatgcctgggtgctctgtgtcctgcagggctttgccctggacacgcaggtgcacgctgagctctgctcaccacctggagggcacgcccaggtccagcagcccacagttgccaggtgcgaggggctcagcccttgcacctgccacacagtcatcccctctgctatccctctatgtccctccagcagcaaagtgtacagttttcatgcatgtccccatcctggcgtgcttcctgccgaccggtgccatgggcgcagactcaggaggtatgtgtttgctctcgtaggtttaaacggaacctgcagcgtttccagtgttcccacgtccacgtcggagacgcctgactacttgctgtgagtgtttgtctgggccctgcaggccaggcctcccttttctgggttcagaccccctcccccagcactgcaggttatcagaggtagaagccactgcaagtctgagtatgtgaattccaaacatagcagcctcttctgggccaggccccctcataatccagggaatcacccgagaggccaggccgccggtggagccaggatggccacttcctgggtggggctgggtccttccagcctccactcagtggcccctctctcctgtttcaggaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgaggtagagcccccccgctgcctactgtgccctggctctggcgggagccagggcccacttgggcgcgcaccatcgccaccacgagccagggcctgttggtggccccagagtctggcccttccccaggcagcgcttctccccctggtgcactccatgcagcaaccccatggttctggcccggccctggggtcctgttgtgggagtccttgaaggcagcccagcttgtcagcctcctttgcagtggggacagctgtgacccacctccttggatgggggcgagccggggtacatggatccccacatgtttgagcgcctggggtcctctcacagcctaggacacagggctcttggtacctgtgccaaaccctcaggagactccgcagctgagctctgtccagcaccctggggcccatccatgctgccacaactatagcagggggaggtgacaggtccctgtggtcctgggaatcaggactcctgtggtcccctggcttgagctcacagctcattcagctgccctgtgtatacagagagtctccacccttagcctagccttggacgtagccgccccacctgccacctttcggaactggtgacctgactacagggctgggccctgattaatcagatgccggggtctctcctggccaaggcccctttgccttccaaagacgacgactcatgatggggttctaggggctgcgagccacgggttcttggggcatctctccttccccttccctccctctttgctgcacccccccaccccctccccacccccccacgacatggatacttccttgtcctgccacgcccccacaacagcagtgccccacctgctattgcctccaggggacccggcagcctttccctcatgccccacccactccggagctacagccgctgtgggcccctggggtgttacttggccttgtccttgaggctgccccaccctcccatgcccccttctcagagcacctgggaccactcaatttgggtttcctgtaggcggggacacattctgttttctcaaaattttgtttttcttctagactactcgagggcagattttgcaggaatatcgaaaaatcaaaaaggtgagtgtctcttgtgttggggtgggctccaagtgagccatgggagctggagggaggagggtgggcccggggcagcctccctgcccgctacttccaaggtgtgggggaagagcctttgagtctgaggccaaagttgccccaccacccccagctaagtcttcagctgtggcatcctggcccagccacacaagctgtggaggtgcgggggaccaactcccactctgcccttggaccacaaccctccttgctgggcaccaagcccaggtttttggtttgggggggacactggcctgcttacagcggggagcagcacccagggcggctctgtcctgagcatgactgtgctgtcccacagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctcctcgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactattttttttcttttaatgttgtactgtggagaaaaactattttgagccatggggttggtgtttacaagaactttccacttttgccaaaatgttacaattgaaaggcatctgcgtcttcagtttcctgatattttcttaaaagatctagtgtcctttttgtacactaaacaggtgaatgctgacttttttcattctccaataaatttcactgaactgaacctggcagcccaggctgcctggctggtgtgtgtggtgtgtgggtgttggtgtatctgtgtgtgtggtgtatggtgtgtatgtgtgtgtggtgtgtgttggggtgtgtgggtgtgtagtatatcctgtgtcggtgtgtgttggatgttgtgtgtgggtgtgtagtgtgtgtgatgtgtagggtgnnnnnnnnnnnnnnnnnnnntcaggggctctggctgggaccagataagaaggcagagtttgcagcctacctgagccgttgcctgagaaaggaccaaatcagagggccctgtaggtgacggggagcgcgggggtgggggcaggctgggtcagggcggagggatagggagccatagcaggtgtgtgagcacagcagtaccctctggtgtggatagggtgggctgaacccagcattgggattccttggccccctgtggcaccaaaggctacaggagtggggctgggggtgggggaaaccagctgtgactgtctccctctgatgaaagcagcagcaggtaacggtaatattacctgttcttcccacactggggcagtgcgcatcccctgtgccactagtggggatggggaaaaggcctgacgggagcggcggtggtgcaggtggaacgagccaggggccatggcagaacataacactcaacctgccagccaaggcacaagaaggggtgcatttagtaagcgataacaccgaagaataggaccgtgggcaaaggtcctgggcctgcagctgtggggggggcctggcctccctgcccgtccgtggccttggcccaagttctaaggccacccaggaatctgaggggcgcgggaggggaagtcatgcagcccagtggggcagcgtgtaccctgctcccagcatagcctggccacgctgttctcccaggataacatctctgtcccaacatcccagggccaacaccaacctcctgcagctcacggtcctgcctcccccggccctccaacgccagccctaagccaactgcccagcaatactctggccatcacccccgcagcctgcagaggccacagtcagtcccctgaccttcctgagccatggatgccatcagtctagtgccccggatattcaggagagccttcccaccctcatgacctgggcaccctggtagagaggggctcagagctgttaaaccctctcctgccacctgccaggggccccaattgtcctctttcaacgggcacccctgttcctgcagccccctcctgtaccaagctccacctgggctctgcaacacagcagtgactcagcctcatccctgccttcagggagcccacactttgctggggaataacagtgcatctcaccaccgacttcagcacacccaggcctgactgtaggggccaaaccccctccttcggccttgtcaactgctgggagtggaagcagcccagcctctatgccgattccctccagctgccctgtgccagctcccatcctccggcaccctctacaggtggccctgtgaacacaggctccccggggctgggtcttgggaccttcctcatgtctctcaactacacaggttcctgaatcacgtgtcgcctcgaggcacaaactccccgattctctgatcctccagtacctacaggatgtccaacagttccattcccagagatggtatcggactccacaagttatgggggtcagtcccacagggctgcacctgtgtcagatgccacctatacttctggcaagcaggctaataaattgcgagttcccatgaccccacttcaggtttgataattgctggaacagctcacagaactccggaaaatgctcacagccaaatggaggaggcgcacagggcaaggtatgggcgggccgtgaagcttccatgccttttccaggcatgccaccctcccagcccctccatattttcccctaaaccccatttttttttttgagacagggtattactctgttgcccaggctggagtgcagtggtacaatcatggctcactgcagcctacacctcctgagcttaggtgatcctcccacctcagcctcccacgcagctggactacaggtgtgcgccaccaagcccggctattttttgtttgtttgtttgtattgagacggggtttccccgtgttgcccaggctggtctcaaactcctgggctcaagcgatgcgcccgctttgacctcccaaagtgctaggattacaggcatgagccaccgtgcctggctgactgcctatttttcggcttaggttctatgaagaatgtgtatcaatgtgttgaaacactgtagatcttaaagggagcagactgggtgggggaggggggccagcctgcccagacttcctagactctgggtagcattccttcctccagggtatgggcaggaccctcccggaatgagggtcttcaagggagcaggcagagagtgacctttgccggctttgtggctttttttttttttttaaggggagaagggctccagtgtctctgacctgccttggggaagaggaattctggtttctatggtttccaggggagaaaggggctagaggcaggagggcaggagaaggtcggagagactcgattctgagctttccgatgccctgctcaaagcgcggggcaggccaaggccccataacttgaggctgaggggagtttctgtgttctgagccccaactgtctcatttgcatatatgtgattgattaaatcgttggccactggtgattgagctcaatgtctaaccaagaaccaggaacaaacaccaaatactctttcacactccctatccccagccctcagggtctgcccaagaccccaaactgcctcccacgtagccaatttttcatctgccctgtctgggtggctcaggtggcttggcctgtagttttctttcagtgaactcctcttcatgtctcaaaacccttgccagcagccccctcatctggggagcctgtcttgcaggggccctgcctgtgagttcccacccactggggcgggggtgtcccagtccacttccaactccctcagactggggccccttcagggtgaggcctggacccagagtcttaagccctcatcctccaaggtcaggccctgtctcttgcaaacgttcccaactatccaccttttgggccagctccagtggtggaaactttccggcctccaggcgcttgttttggaaagttcctgggggagctgccccggcctgcccgctgggttcccacgctcccttatcagcgcgcatgaggggggcgccctgcagtgcaggcctcattcctcccctgcctcggccctgcccgcctgtgcgtcccctcccctttccagcgaacagcctcccgctccggcccactcctgccaagccctcctgctgcaggtggggaaacaggccaaacaggccccatccttgtgagccccgtggggacagagtgactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtggaccagggggctgaggaaggaggcgtgctggggagagcggggcggctcggggagaagggcacgggacccgggattcactgcgcggcctgtcttcaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggtgggggcgggaggggcgtggtgggtagggaggcttggtgggagtccttgcgggcgggggcgggagcctgcagggggcggggctctgcgggaccaggggggctgtagggggtggggttccgcggggcgaggggctgcaggggcgagggacctgcccgggtctggaggcctgtagtgggcgagggacctgcagggggcgaagctctgtggggcgggagggcttgcagggggcggggcctggctgcaggcggaccccgtggaagggtttcgcgaggtagcggggactcctcgggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttcaccactcccacccgtcacctcgccgtgtctgctgacccccaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggtgggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctctttttgccccaccccgcgaatccaggcctcacttgacacccggggaactgagtagcccaggcctctgtgagtccgagagtatgtacaaccaacttccctacaccctctccatcctccccacaccctcaccatccaacccacagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgaggtgggcgaacgcccgggtggagcgggtcaggcagggccagtcacagacacagctctgtgctgactgcccgccttgcccacagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaaggtgcgtgggcctagggagctgccgagtgcaggaagggggcctgggccgcgagcacctggcttgtggggccgcagggcctgcagctgctggggcttcccttgtacccacagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtgcgtggggcgcgggcgcgggcgcggggttgcccggcgaggggtggcagggacccgggcaaactcctgctgcactccaggtggtcatcaagtatgtgccgtacgtgggtgacagcaagcgcgcgctggatgagtatacctcggagctgatgctgggcggaaccaacacactggtgctgcacaacacgtgtgaggtgcggcgcggcttcaggggctgctatgggaggcagggcttggccaccgcccccatctcctgacccacccgccccgcaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcaggtgcaccccagcctccaggttcccgcccggggcccagatacccccctggctaagctatgcacagggcttggggggctgtaggtggcagggataccccccctttctccctgtgggtgtctggctctgctaagctgtgtgacctctccagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtctttcgtgtggggcctcccagctgggcaagccttgattggccaggagtccaggtgcccgaggtgtgacctcagcccctcgccctgagcaggggcgctgggcagaagcctaggcccgcagagaggcccggggctgccgccccatcacacgctcatggtcatccctggcgagtactgcggagagaggagggggcagcgcgcaggggccgagttcagctccggaagaggctgggacccgcccccagggacaatgggggacagggcagggctgggtcctgggcagacatggggtggggacaggagggaacgggggaggggcgatgcatgggaaggccgccctggggcgcgggtcccggggtgggggcggatgggatcgggacggtgaaataggagcgggaggtggtggggggtggggagaggttgaggagagggaaaggatgccgcggccgcccccccacctggcccgccgcggtcacggtcttgctctggccccccggccgccccgccggggcctgcccgccaggcccctccggcccgacgccgccgcggggggggagtcgacgcagtcgcttacgctttcgctcgggaacgggtgcaggaaggtcccggcggccgccatctcgccgtcgtcccgcggggtgcccggggcgttgctcaggccggccacggcgccgggggaactctgggggcggccgcggtcagcgcgcaactccccgccccgccccctccccgccaccccccccggatcccacccccggcaagtagcgcagcctccttaccttcggcaacccgtccatgtcgcccgagcctacagacacggacagacacgggcaccggctcagacgtgctggcgccatgcccctcggcctccaggggccaacgaccctcgcaagctgcccccgccgacgcgcccccgccccgcacagcccgccaggaaccccgggactgaggccaggtggagggttgggcctgggggggaggggcggtcagtgcatcctctggtttggtcgctggatccccctccagctcggggcagcccctgtcactgagcggcccccggggggctcaggacgccactagacgcctccacccggcaggcgggctgacggcagggggaagcagccagggagcgcacgggcccggaaggcaacgtgggcgggagcagggacgcccactcacccagggatccgttcacgtggtgaggctccatcgcgctcatggcggccatggggccctccgggccagggccgagcgggaactgcgggcatggggacagcgtgggactcgggccacccattccccaagtggggtcaccgcctcgagaagcacccctgcaagcccccactcacattagccctgccggcgccctgcccgatggggttcatgatagtgtacatgttttcgctggagttggtggaatctgggggagaccagaagggtgccaggtgtgacggggtttcccccaaacacacccaccctagcacacccccacctcttactaggccatacctccagggctaggcatgatgggtgttccagggggcccacctcctcctgggggtccctgcacacaagagacaggaaccgtgagaaatggcccctcatctgccatcccacaacccctgcccaggggtgacccagctttgctcagacttacggtgtagctgccgggggatgaggaggagtaggggatctggggacaagggcagctgtgagcagtcagccaggcggctcacccagtgtccctcccaccccaccccaagcctgcccacccagccataggctcaccgagtttccactggggctggcccacgggccacgaactcctgggcccctggaagagaccgcggatgacagactctggggctagtccatgtggatcacagccctcaccacacaccccccacaccctgctccactgtatccccagaccgaccacagagcagcagatgttgctggaaaagtggccaccatgagctgccaggttccaatcccaacccatcactggccccaggagactaattgctacttcaagtctcagtttcccctcaacggtggccatgaaataaacaatatccaaggctgtcctgaggattcaggacctgccccagctgacccagccatgaagctggtggtggcctgcgaactgcacactcctaggatcccccagggtcttacatgttcatggcaggcaggcctgggccggcgagggagttgggtgggggtcgcatgccacctccatagctctgcggaggcaaaggggctgtgaggggtagaccggggacagcccgaaggccccacccaccagggctccactcttacctggggccccacgctggccatgccacgaggaggcgtcaccctctgcattgggccgcccatgctcggatgccctggggtggggcagaaggaaggggacttggacctggaccattccccagtgtggacagtggggaggcagcaaggtctgggctctgagagctggaattctgattgatggcgggataggggctggagcttccctactcaccctgggctcgtggggagggctccatggcgccagggaggaggggctgggagccagggaggcctgcgggaggctgcggagggggtgcggcggcactgagtgtggggtgctccctccccggcccagctcctgcccgccctcccctcatccctttctcacctgactcggcatccgcagggtgggccgggggccccctgggaagcgcggtgacatgaagggctggaagaggtgggcggggatcagcaccttcccccaccctctggtccccaaagctaccccattcctgctatgctggggcccccgacctggggagccccctcctccagaaccagccagcaaagcccggccagctggcaccagccaggacctcatggcttgagggtgggagggggcggcgctgggggaggggatgtgtgtgtgtgaggggcaggcaccacagctccttacctgaccgtgaggccccatcatgggggcgttggggttgtggggggacggctgggagccgggggggccctaggaggacagaaccaggtgggtgggggggagtgaggccctactgggtttggctgaggaggggaggggctccatggaggcagaggggtgggccagcctgtgggacagggaccttgtgggaaggcttgagggcaggactcaggcaccagtggtcaccaggaccactgtggctactgcatccccaagcaccctgtgcgcacacatgtgcaggccaagtgcacagacacccaccctccactgcactcgggccctccctcgctggcccctgaaaggcccacctgggcacacctgcggcacagaggaccctcccacccaactccagcctgccggcctcatgacctctgcccacgtgggaccccccccaccctcaaacgcatattcagccagagttgggggccagtggactccagccggggccatacctggaagaagccagccgccatggagcctgcggccattgtgtcacctggggccatactccccataacggggctgggggcggctgcagcactctgtaagggtgcgggaaacccagagggccaggtcaggacacctggacacttcctacctggggtgtgccccctcctctctgcaggtggccggccccatgggacagcgagctggcattggtcagtgagcacactggggttgtcggcctgaggatctgtgggtctgaagaccctgtaggacgcaggatccagtgtcgccctcgtttctcacagacctgctccccactccagacccatctcaactggccctgcatcgtcctggctggcagggcagctcagctgggtccccaactctactcaggaccccccaaataaacatacacacaaatataccggcagtttcaagagcctccctgaaggctccaccttagaacaagtgtagacccctgccccaccccaccctgcccttcgtccaggagggagggtgaaaagcaggattctggggtggggtccccatcccccagcctctctcagatggagaaggcgacaagacagggtgctggagagggggcttcctgtatctgccagaaattgtggtggcagcccagacctggccggggaccaagttctagacctgtctgctatggggcctacagggtctggcagggggaaggtggggagggggatgtgaggtgggaagggaggcccagtctatgagggcagaggaacacgtctggggacagggaggggagaacttctctcctggcccctgtctgtatggtccaggccaagccccaaaccccaaaaagaaggtgatgggctctctctggggtcggcccaagccagcacacagggacactcaggtgtttgtggcatgaactacagccacttgggctcagagaggttgagcactctgcctacagtcacacagcgtttcctgccctcagggactgctgcaaggggccccctgcctagaggagggctcctggagaaatcctccctccccctgtggggctgcgggttgaccccttcctgccccttctctgaggttagcctcaagcctcccgccagggtcctaaactgggggaggggctggaggcgggagccccctaagcccaccgtgacggcgagcactcccaaggcccaaaacaaatccttcgaaagccctcgtgccctactcctgtgccactttctcagttccaaacttccaggtcccctctgggctctggcccccaccccgccccctcccgcaaacacaatggcctggagcagctgccctcccaggcggcccctccggtccactccccgagggtggggagggggcacctttgagccctgtgtctgtccaccccgcagggagggcaatcccctcacgggccacagcgggtgcctgagcgtttcctggtcggggacgctccaccgcaccccccccccgccccctgcgacccgcagcttcccaactctaggccctgagcagttaatcccgggcggcgcgccctccccggcggttggcccgggccagaccccctacgtcaatcatccctgaagaggagccggcccggcccgcgttgccatggcgatgggctgggcgctccggcgtttcctggagacgccaaggtcggcagggagccggggaggggcgaacagagccccccccgcccccctcccccgcctcggagggcgagagaggaaggggccgcctccgtgcaggctcggcgggcaaggcgcccccagttagagcgagagcaacggaggcgacggcccggcatgacgagtccccgcggggattcggtcaccccagggcttgggcggcctccgccctgggccctgcggtctacgctctgcgccggcgctgccatggtaaccgctgcgcgcctgggaagcgcgttcacgccgactctccagctccgccctcctggcccggcggggggcgcccagagaggatgctagacccagacggcagggatgggggcagagtcgcccaagtccacagctccagacacccccggggccccagatctagcgggactaggacaaggggaccacacacgagtagtgggacaccatgggggtgaacagcagtgacgccaggagggcttcagcctgcccagctctcatgcagagtgctggaggcatcttcagagacatgggcgccccacccctcgggccgcctctgccttgctggggcctgcgctctggcgcacagggggtagggggtgggcgggactggcgccccccagacgcccaccggcagagccggcacctccccctcagacccaacagagggggccaggtggtccagcgcagaggatgaagggaagggctgccatctgctgccccatgacaacaggaggctgccatcccctagtgttagccaggcagcctccactccaggccggcctctgaccttttccaacccagagggaaaatgacagcagagagggagtgggcagctccagatacctggcaaggtcagaaagtgtcccagtgcctggcccatcaggcaccccgacctgtgctccccgctcagaggagcagcagtgacccccaatgcacacacggcagaggagggggaaggcagtgagcttcccccatctccacgcaggctcacatgagatgcggggaaatggcaccccccagtgccccaatgggggtgggagggctgtggggaccctcagaagtgtgtgcagtggaaagagctttcccttactctgtgagtgaccctggaccaagtggagggtggaaggaccccccaaaagtggccaagagcctgagtggaggctgcagctctgcctgtcaaccccaaactgccaccatccccagccctcctctggctgtgcagccccccaccccacctccccagccacaggcccagcacacctcccgccctggagcccctgagtccctggggccaggactcacatagtcctggaaggccttggcctcgccggagtgctcgcaggcctctcttctgtcaggcgccgcgcagtacaggtcccagaagacgctgtgggccaaaggggaagatggttgctccacgtgcctccctcaacccccttccacagcccacccacagcagcccagcccgtaccaccaccaggagtgcaggaacccagggggctcccccagcgtgatgttcttctcccatcggatctgcagggaaaggaaggtggtgagggggtggccctacctgaccctgccccaccacccagcagggtgcccagagaacatctgggcagggagggagtggggagggaagggtaacagggtgggcagagggccccaggatgtgtggcaggtcccggctgggcatgtggaccagatgcctggatgctagcccagggcctggaccctgcagagccctcagttcccagggccatcagaggggcaacgcgggcccaccccctggatccccagtggaaatgaaggacccccggagtgtgggtgaggagggagggccagcctggaggtggtggcttacctcagacaggaaggtctgggctgacttctgggcaccgatgtgcagcaggtactcataaacgtacagcgccaacctgtgggggcgaggcggcccagggagctcagactctccaaggcaagggcccaccccaaagcccctccatctctcaggagggcgggtggaaaggtggcctccccaccagctgctcagcagggacagctcatagttatccatctatgtcctgcaggcccctcccaggcatccgtgacccccaattccgggccgaattcggctgtgttccacgctccctcgaggaccaagtcctggccatgtcctgccaacactgagactccagagaggcctcagcgctggggaggtctcctccatagaggagtgtcattcctgtgtgtgtgcagggtggggacgaccactgggcaccctgggccatgtagtgtgctcagggcccacctccaaactcatccccagcctccccggcccaggaaggaaggagggaaggggtcctccaccccacatcccctgcagtccctggaccccatctcttccttggggaagagatgcccatccaccatggtggcctcaaccctttctgcagactgtccccagtcagggcagtgctgaacctggggcaatgtctggggaatggaggtggggggccaggggaggtagggcctgcagtgccatgtctgcagtggtgctgccctacccaaacacccacagggctctgcgcgagtccccagcctgccagggacccctggactcaccctcccaaccactgtgcaccccaagggcttggacctgagtcaccctcgcccagccaggtggctccagcacggccctctgcaggtcacagggggaggccggactgtccaccccgctccagtccagctgccacaccagagagcagaggacaaaccccctatccaaagggtcgcccagtcctgtggcaccagcccttctggacctccctggaactgagccgctccctgctcagagctcttgtactgtccagctagggaccacgagagtctgctgggggttgggggactcttagattcaagacagggtaccagagggccagcctgaggctgagccctagaggcgagaagcaggcaggcctgggggcccttccacagccgcctccagctcagctgcgccgccctctctggctgcgggccccatcctaaaataaccttcctttgactcacgctctgctccctcccagccaggctgctccaatcctagcacccaccacccatcagggcccccaagtccctttcagatttccagtcctcctgttcctgccccggcccctagagaacatggggacttcctgcccccacctggtcctcatgggcactgcccttgccccaaatctcatcctgcctcccctccttcgttcattcacttcttcattagttcctccagcatccatgaagtgccttttgcgcagtgcacacacccggcccctgtcctggaggccatgttcttgaggggagagacagagacaggcaatacctgtcaagagaggtgagctctgtggcagcttggaaggcgctgaggctacggaaaggcaagtgggggggtgacatcagggaggggaggcggtccagggtggagtgcgccaggctcacactgcaccacatgagctgtgaaggccaccccaggggcagggatggggcaggacacacagcgcccaatggtcacccctgcatcatcacagcactcttgaagagactgcccccagcccaggccctgctagatcctgacctccacccctccagtctcccacacctgctcttcctccactttcctggccccgcggcctgcaggcccacctgtctagctcacttctgtggcaccctggcccatctagaggcttctgagcttttccctgtggctagtggctgacaggcctgcgtccatcagtggaaggggagcacacaaggccagggtgagcaggttccaggggcagaccgactagcctggggagcccagtgccaacccacctgccaggtgtggaagagagttcccaccccagccacttaggggtcagagcagggggcatgaaaggccagagtggggtaagacagagttgcaggaacgctggtgagcggccccgggagggcgggggcagcgggaggtcctgctgaggctgcattctgggtaccccacacccagggcacggctgtccaaaaggcccagggggactcctgaaggagggggctgcgaagggttctacctgccttccttgtctcctgttcctcgactgtccccataagtgcctaacccaggaggtggccccctagagcccaccccgccctctccgccccctcctgctgtcctcctgcctccagcccccgcccccggctaccagctctgtcttctcctctgctctccctgtgtggccgcccgtcctgttttgatgatgccttcaagtaggggctgtccagagggtgctatggcctgaccttccccaaacttgggattccctgttcacttgacatctagaggcccagcctcgacaccctgagcccccaccccttccccattctccccctccctgctcagagactgtcagcttggcctttacacatgcatcctgtccaaggagcctctggtggcgtgcgcacaggcgtgcacctgtgtgagatccacccagctgtccccaaacatcactgcgtttaaaaaaacaccgaaggaaatctctttcctgacttgggcccctctccccacctccactgcacacctgggccaggccacccaccgtctcccacctggattacgacagagtcccctccaggtgctgctccccccacccccatgttccttgttcaaaccctcctgtgccgccccccgccccgacccacacactggctgccctgtcaccccagggcctctgcgcactgtttccctgcctggggcacttccacccagagactccagtgtcacctctcggggcttcactgtcacatggaagcccccaccctgctccgtctcctccatctgagagtctctgtcttgggcccccaatggaatgtagcttgacgtggggcggggacttggagtctgctcactgcaacgaccttagaatggagctgggcatcctgggccccagtcaccccagtgaatgaacaaaccggcccggggaccccctcctgggatgccgggaggattaggcgaaccatggggtaagtactgatgaaggtcagcagctattctgtccatactgaggatttgggagtttatcctgggagcgatgggaggccaaaggaagttttcggttttgctgatttcccttccacattggtccttttattttaaacaggattcagtctccagggaagaactgtgggttgttattgttttgggtgaaaagttttgaagcctggctgttcggccagggagttttgggacctacaaggtcctcccctcccagaggactgctccgggggccaggtctgggggcgccaccggttggggccctgagctcagttatagggaagggctctggatgcaaatcacccatgccctctgccccccaccggccacctgccctgggccggtacaacctctcagggcctgtcacctatgagggctccctgtgtcacacaggcaggtggccagaaaggaaaacagggaggcacccggaagagcagcaggcagctctccctgcagaaggaacacaagactcggaggacatggggcgcctggacctggagcgagcatgaggctgtgcagggaagcagagccaggatggggtgctagcgcctggtggcctgaaatgtaccacagctaccaccgtaatgacgcgagttaccataattacccagaatggctgcaatggatgctccctgctcagcgccttcctagacacagatgctgctggggcaggagacacctgccactcatggctttgtgtcaccttgccatccgtcaccaggtctcactcctgaccctccaaccctcgccgtcctccctcccctctgccaaccctaaaggccaggcctctggcagcttcttggcaaagtggcggcctctccttactaccctccacacctgcccctcatagccatttccagccaggggccaaaatgaccacgtccaatcgtgaatcccatccctggcttacctgccaggctgatgaacaagccaccgacatccatgtgccggctcaaaatcaagcccgggagaaacccacgagctgccaggcaacaccaaccatggctgtgattcatggacctcttctcaacctgcctggcaacacttgagtgctgaaggatatacacatgcccctcttcttgcaagtggcccactcagaccccagcctccctcagcccactctgctgcccctgcactccacagtcactgccatctgctgcgagcccccgagggcaggcacccaccaggtgctcggtccctttctggagccagctggccgagacctagtgtaagccgggaaggcctgtaggctccaagggcagccagaaggggctcaggattggggccagagagagaaggaaggatatgcagcgcctcatttttaggaggcatgaggctcattgcaggaagaaaagtgcagtgctggagagtcaaggtttggagcagtgtaacctcttcaccccatttcacagagaaggaaaccgaggcccagaggcaggaagtggcttgcccgaggcagatacttcctgagagccgcgtggctgccccggcaggtgctctgcctacgggctcccacccagtccttgcaaagatcctgaaagatgggtcgtccacatttcacatgaggaaactgaggcctggggctgcctctgagagctcatctgtgccagagaagctgagttctcatcaggtggcttcctctccagggccctggtgtccctttcgttgaaatgggtgcatgcggccatctggcgttttccaggctttctttcatagaggaacctcacctccaaaccaacacttatacgagaccctctccgtgaaatggaagcatgcaggctggctctgaccaaagatgggccctgcagcctccccactggcagctgagggacttccgagagccttgagtcccgaggccagtgtccccaaagcacctctgctgggcaggttggggagtgggaggacagtatgggaagggggccaggaatgcagctaaccccctcaccctaccacccccggctcaaacctatgaaatctcttccttcttacttgggtccaggctgccaccagctctctttcactgtttttcttttttgttctttttgagatggagtctcgccctgtcacccaggctggagggcagtggcacgatctcagctcactgcaacctctacctcctaggttcaagcgatcctttcacctcagcctccagagtagctgggattacaggcacccgccaccatgcccggctaatttttgtatttttagtagagacagggtttcatcatgttggccaggctggtctcgaactcctgacctcaaatgatccacccaccttggcctcccaaagtgctaggatgattataggcgtgagccaccacgcccggcctccccagctctctttcagacaactgtgtccacatccccagggcctcccagcctctgttcctgacccctataagccccactccacctgggagccagagcgcacttctgcacacacaacccactggggcccatctggcactcttgcaggctgcctcttcctccacctgggcccagccccagctccttttcctggtcccatatcagggcctttgcacttgctgtgccctccacctgacatcccctcacccttcgctatctatcatccactttgctttctcctgctaactggatacctgcctccctgctggggtgggggcttcttcagggccaccgaccctgccatcccgaccggagcctgccttcccgactgccacacccagggacacccagggcagatatgctgaatcagtgaacgatcccgattcccactgggtgggtggatgcctccagagccagcagctgcctggagacacacaggagacagaccaggggtccaggggtgaccatggcagacacctcctgcttccgacctgagcaggagccagaggccagtttcaaaaagtctttgggcttaagggtgcttggaaatggagctcatcttcctaactgcacacaggcaagggaggcctgacagtgcagtcatttgcctaccaccttctagccagaagagcctcttctccaaaatgacccagaggctgggcagaggggacaggcatctttgtggaggggtggggcatcccaagtcagcctaggcagaagaggcaggatgggggacactcagccaacgtccagggctcctctccagcacccagacattcaagtcctcactcctggcctggccctcaaggcaggtcctcatgggacccctccctgctgacccagcctcctctctgcttgggtggccagttccacaccacgggccactccaggtggctcaacttcaaggatcctggaagtcccccatcagctatgacaagactcccctcctcctgggcactgtttttttgttttttgttttttttttttgagatggaatctggctctgtcgccaggctggagtgcagtggcgtgatctcggctcactgcaacctctgcgccacgggttcaagggattctcctgcctcagcctcccgagtagttgggactacaggcgcccacgcccagctaatttttgtatttttagtagagacggggtttcaccatgttggccaggattgtctcgatctcttggcctcgtgatccgaccgcctcggcctcccaaagtgctgggattacaggcgtgagccaccgcgcccggcctctgggcacttttaacaacactgcaaactgccccgtgcccttcctgcgggacggtcactgctccaagcacctttcaaatgctttccacccggagagcacactcggctgactccccaccccgagagacctcagccccaccacgacccttcctccatccgcacggtggaacctgcccctaccagcttcagagcgcctggtacccacggcctggagccacgcccagaacaaaaggggccctcagtatgcactcttcagtggtatcaagagagcggctccgtcgtccccacccgcccctggactgtgaaccgtgcggcttccccaggggccccacacagctgctggggccagggcagacaggtggcggcgcgcccctccagccgctctccagctctaccccaggcgactggggtccccgagccgacactcttgttcgtcccggaaaacttcgctgacctcgatccccatgcgtccgcagcctcgcgcacccacgtctcgaggaggcctcgcgacccccgagacccgctcggggatctcgcgcgccccctcaaatctcgcgccctcgggtttcgcgcgcccccgccaatctcgcgacccctggagccgctccggtctcgcccgtccactcccgtctagcgcccctcgggtcgcccgccaaccctcaactccggcgacccctcagggtctcgcgcgccccccgccaatctcgtgcccctcgggggtcgcgcgcccccgccaatctcgcgacccctcgagcgcgctcaggctcgcgctccccgccgcccgcgcccacgtgccccgcgcggtgcccgcccgcgccggagcccacggaagagcgcggacgccgagccccgcccccggccccgcactcacttctcgcgggcctggctgtcggagggcacggccgaacccttgccccccttggcgtacatgctgctccacgccgccgccgccggggcccacacctgtcaggcggcgccgcgggccgcgcttgccgtcgccatagctaccccgcgccccgggcctcaccgccccgagccccaggcgggcacggcaggcatcgtccgcgcgggggagctccagacggccgcggcggcggcggcagcggcggctccagctccggccccggccgcagggtggctttttttcctccctttcctccgcgcgggctgttccgggaaacgcgcgctcccctcctcccgccgcgcgcgcccccgcccgctgcctctacgccgcccgcgggcgcagctcttaaaggggcgatggcgggcgcgcgggtgggtcccgccgccggagcgcgcacgcgcagtgcccgccgcggggggtgggggcgcggctacacactcgcgggtcaggatcccggacggccacccagggacgcacagctgatcgcggctgcacacgcgcgcgtgcacacacacgttcactcacctcaaatggagccggccacccacattgttgtacacccagccacacacattcgcagcgacactcaacatagcgctccacacagcaaaagtgtaccccgctgctggaacgactgcggatagccccataaagcctcaggcagtgacattgggtgtctcaccccgcagagctacccacactcagcaagggtgggaaccaccgcacatacagcccgcccagcgacacacatacactgccacacacccagctcacagtggccgtcctggaacaactaaacacaggccaccgcacacaggcacccagcctcacgcaggcgcgcgcttatgcaaggccgtgccacagcttccaacagccgtggacagagcccacggagttaactcacagtcaccctggggcgcactatcgcggcctcctcagaaccacaccctacccagctccacagtcacagggcctgcggacactcagcgtcccgcccgaagtcacacaacacagacacaacccaggcacacagacacaaagctcctatagtacccaggctgtgggagccacctggcaccaccccgaagtaacacccggtgacaatactaggtgctgggtgactgctgtttgggcttctcagcctcggtgctgtgagctgtaaatggggcgcatcccacctttgtctgcgggagtcagggtgcaggcagtgggtgcccttttccccttttagggcccttcatccccccaccaggggtgttcagagagggtgggggcggatactgagtcagggacccccgcagggcagggatgcccgggtaccagtgggtcgtgtgtggatgggcagggtaggggaaggcggtgcggttgactctgggtctagatgtttctgtgtttgccacggctattcctcttttttcctaggcaagcccgcgtgtgtgcaaacacgcggctcccgtgtgagtgcacgtgtgcatccttgtgcgtggggggcgggcaaacacccaataaattatcgctgtctcggcgactgtccctggctgcgcggtggcagttgtgggtccgagtcgggccgagtcgctcagtgaggttgcgtgcacaagtgtgtgccgaatgtgcacgtgtgtgtctccgcgcgtgggtgggccgccagctccctaggacctgtgtgtggctctgtgctcacgtttcgtgtgtgtgtttgtgtgtgaatgtctggatgtctctcgctgccagctgaccccgcagatgcctccccgatagaggccgccccccagtacgtgagaaccccccgcccccaccccaagccttctggccggcgggaagtcgggagccgccggggctccagacccgcggagaggaagggaagggcaggaccggccccagccccgcctcctccccgaggggcctcggcgcgggaggggggacgccagcccttcccacttcctgtccagccggccgccccttcccccagcttcctctcccgcgggcctccgggccccggctcggcggggtaggaggggcccgcacaattccgcagggcctcgggctggcgacggccccggagcctgggggaccacggggggcgtgggcttcggcgtccaggtcactcccatcctaatgaccgctcccaccactgcccccgccagcgcctactcctaatgaggcacagagagggtgtggctcacccaaagtcacacagagccttggtgacaaccggcactcccgggcccggcagatgcccctcctgccacccccagtttaatctcctaaagctccgtggctccccagggccctgtgtgccctggttggtccctcgccccctgtgagccacggttccttgggtcaatgtgagtcttcaccccattaaacatgtattgagcgcctactgtgtgctgggctccggagacccagccgggacacgttgctacctcttggagctcagaatctgatgggggaggcggacagtcaaaagctggcgagtcagtcggttaatttcagggagtgccacgtgcgtgagagggaggggacccctggtgacaggacgggcgacggcggggtcggtcggtctcccgggggagggcggaggcggagggagggagggaaggagggagggaggctgaggcgccggcggcccagagagctgtgatgggggaggcgcggagggcgggagcgaggagcgcggttctcatggcaaccgggaaggatctccaaacacagcctgggcgctggcggaaaagtgcgagggcagcgggccctgggtcccacgcggcgtcggggagctgagccgcgcgcactcccaaccagggcgcacgccttgcgggggcagaacccgcagaaagggaccccccacccacgcgaaggacgggcagggcggggaggaaaaattattaataacggggagaggaggggtggatttgaaagacctggaagtggaatgttcagactgtagtcacagtaagggccaaggccctgaggtgggcacacggcgaaggcgctggaggcagagccaggaagcagccgtggccggggcagggtgaagaagagggggatgatggcagggaaggcagagagctagaccacgcccagaggggagggggtgagatttttttctaagagcattagggagcaatgggagggtgtggagccgcgaggagaggatgggatctacgtcacgattttaagaagctccatgggaggccgcacgtggtggcagcgtgtgcctgtagccccagcacttcggaggccgagacaggatgatggcttgaacccagcaggtgaaggctgcagttagctgtgatcgtgccactgcacttcagcctggacgacagaccaagactcttactaaaaactaaaaaaaccggccgggcgcggtggctcatgcctgtaatcccagcactttgggaggctgaggcgggcgaatcacctcaggtcaggagttcgagaccagcctaaacaacatggtgaaaccccctctctactcaaaacacaaaaattagctgggtgtagtggcgggcgtctgtaatcccagctactcaggaggctgaggcaggagaatcgcttgaacccgggaggcgaaggttgcagtgagccaagattgcgctccagcctgggcatagagtgagactccgtctcaaaataacaacaacaaaaactaaaaaaacctaagaagctccgttgccagtgagatcaaggtggcacagagggggcggggaggttgccccggggaaggggcccagggcaggtcctcggctgggtctctgcttcttggggtggacagtggtgagtcacccaccatggatgtcccctaaatacgggtcaggggctgtgcctggaggagccctaaggagaatcttcttttagggcagggaggttgccaggagaaggggccgactgtaccctcaccctggatccaccctgcacagtcccacccataagcctttgcgctagcggttcctgccgcctggaacgctttttctctggcttctggcctggcctactgaggctcctcctttggccaagggttcctccttggtcctcctgggggaggaggccaactcctcctcttcctcttcctctccctcctcctcttcctcctcctcctccaagccttccctgggcactgcccccgcaagactgtttccgcacagtccctagttggacttggcagtattcggatgaaataacgcatcccgtcctcagttggccgcctccgccttcctctgggtcctgtctccttgaggacacagcagtgggggggcccacgagtactccccattcctgcagaggaggccgggttgggttttcctgctggtggtttttcttctccataggtggcggaaacggcctccctccctcctcctcattaaagtggggggccctgggaggggccaggactggggctggcgccccctgcaacccctccccagccgtgcgtgcgtgggaggcggccacagctgggagccgggtctgcgctaggagaccgtttcctctcagaagctgtaattatgggtaattttctaaatgcaacacaaaaattaaaacccaaacaacaccagggtgggagcagccacagcagctggtgaacacgagggtaggtcgagggtgaggggtgggaggagctgggcctttgactcaggaaggctgggggtggccagcatgggcagaggggtgttcagacagcctcactccttggacagccagctagggtttctgaaatggggattataccccaagactagttgcctggaggcggaaactcacagatagaggctctgggcctgggattgaacctagctgtgccctggctcactgtgtggccttgaccgggaaacagctgaacttcagtgacccctccaagccactgggtcatgccaccaatcccacagggctgcgagggactccgggtgacagaagggatacaggagggcctggccaagaagcctctgccaaacctgcaactcacacccccacgtccgtcctccacaaagcttaaccaaagccggtacacttctgtgcttctagcaccttgtgtggctttcaccggccacacatcgaagccccacccctctgccctgcacttgaactccagagtcatactaacccttgggaactggcttccatcctctggtaatgtcctccttccagaccaaagaaggtggcagcatctctagtttttctttttagatatgggtgtctcactctgtcacccaggctggagtgcagcggcacaatcatagctcactgcagcctcaacctccgggtttaagtgatcctcccacctcagcttcccaagtagctgggaccaaatgcatgcactaacaagcccagccatcatttcttctccccatgttacagatggggaaactgaggctcgtaaaggaaccaaggacgtcatgtgagcgacccagaggcaataccccacccatcagagtgcttccagtaccctgtctggtctgggagactcgaggtgtctcttagaaatcccaggtctaggaggagggtctgtaatagctgctggtagctctgggtgcacgctggctgcagcccatcctgggcctaaccacgtggctgcactccccaccgccagcttctgctactcctcacctgtagctttctctggccgagggaatgccgttttttttgtttgtttgtttttttgagatggagtcttgcactgttgcccaggctggagtgcagtggcacaatctcggctcactgcaacctccgcctcccaggttcaagcaattctcctgcctcagcttcctgagtagctgggattacagggtgcctgccaccacacctggctaatttttgtatttttagtagagacggggtttcaccatgctggccaggctggtcttgaactcccgacttcaggcgatctgcccgccttggcctcccaaagtgctgcgattacaggtgtgagccaccaccgtgcctgccctgggaatgccccgtctaaggacatgccagtctccctaaggtctccgacaggactgagcttcatttcccacgacctcccctgctcctgggcaccccctgcagggcccttccccagctcccatggccggatacccatgtgccccacattctcagtgtgccatcttgggtctgttttctgggaaatcaaaatgaggttgggggtggataaacaccccacagggctgggtgtggtgggtcacgcctgtaatcccagcactttgggaggccaaggcgagtggatcacctgaggtcaggagtttgagaccatcctggccaacatggtgaaaccccatttctactaaaattacaaaaaattagccaggcgtggtggcgcgtgcctgtatgtaatcccagctattcaggaggctgaggcaggacaatctcttgaacccaggaagcggaggttgccgtgagctgagattgtgccattgcactcctggccgaggagcctctgctgaacctacaacctcccaccctcacgttcgtcgtccctcccccacgtccacaataagaccaaaactccgtctaaaaaaaaaaaaaaaaaaaacccaaaccaaaacaccccacgctcctcgcccctgagtgggacccctctgagatgagcatctacactgtcccccagctgtcccaggcggggctgagcgccactcatccacatgtgtcatgtctgttggcagttggtgccccctgtagggctccttcccttcctgtctcatgtcccattccctaccaggagcttcctggggtcacctcccaggtatcccctcaccccacctgatcccacctgcccttgaatcttcaactcagagccagctactggaagccccagctaccgtgcacccagcgctctgcttcagtgctctcgctgaacctcaaccagctgccttggcagcctccacctcccgggcttaagcagtcctcccaccttggcctcccaagtagctaggaccacaggtgtgcgccaccactcctggctgtcatttcttctccccatgttacagatggggaaactgaggctcatcacggcatcaagggtgtcgtgtgagagacccataggtggcactcacctatgtctgagaaaggttcagagcagcaaagcaacttgcctggggacacaaatcagggagtggaggcaccagatctgacttcgaggtaccctgacaatgcccattcctcacctcgtctgtctagagctccagcctccgcctcctcctttttttttttttttttttttgagatggagtctcattctgttgcccaggctggagtgccgtggtgcgatctcgactcactgcaaacctccacctcctgagttcaagcaattctctgcctcagcctcccgagtagctgggattacaggcgcctgccaccacgcccggctaatttttgtatttttagtagagacggcgtttcaccatcttggccaggctggtcttgacctcctgacctgatggtccacccacctcagcctcccaaagtgctgggattacaggcatgaaccactgcacctggccctcatcctcctttttttagagacagtctcactctgtcacccaggctggagtgcagtggcacaatcacagctcactgcagcctcaaactcctgggctcaagcgatcctcgcagctcagcttcccgagtagctggggcaacagacgtgcaccaccaagcccagctaattttattttgtgtgtgtgtgtggggggtctgactttgtttcccaggttggtctcgaactcctggcctcaagcgatcctctcgcctcagcctctcaagtagctgggactacagatgtgtgccactgtgcccagattcagtctctcttcttactggtggaagaaagatttcctgtggtaccctaaggtccatccctctcgggatggtacagggacacgagtcttttcttcccttctgggggtcctttggcttaacaacaccacagagtccacacttggtaagtacctgatattgagcatgttttgacatgattatgttaaatgcatccaggtcatcccaccccagggcctttgcattgggttttctcctggccgggataccttttctacaactgtacaccatggccagcttctcttcatccttcaggcttcagctccagtgacataccctcggagaggtccccaaacctctgtttggattatattaccttgttggatcttcctggatacttttttttttctttaagacgaagtctcgctctgttgcccaggctggagtgcagtggcgcaatcttgactcactgcaacctccctctcctgggttcaagcaattctcctgcctcagcctcccgagtagctgggattacaggtgtgtgccaccacgcccggctactttttgtatttttttagtagagacaaggtttcatcatgttggccaggctggtctcaaactcctgacctcaggtgatctgcccactttggcatcccaaagtgttgagattacaggcgtgagcccatgcacctgacccttcctggatatcttgtttgttaatttttgcatatttattgccccaggaacccttgagctccatgcgggcaggaggtttctatgttttgctttcttttgtagagaagggggtctcactatgctacccagactggtcttgaactcctggcctcaagtgatcctcctgccttggcctcccaaagtgctgggattacaggcgtgagccaccgcgcccggccgaaatttgtatgttttgttcagggctgtgtccctagcgcttataacactttctggcatacagtaggtgctcaacaaatatttgttgctgagcaaatggactaaagattaccaatgtcccctctgtgctgaactcctctgtgtggtctacggagttgcctgccttcgccaaggcagccagcacctgcggttccgaatataaccacttgagggcagcagagactcaatgtagcaactcctgagaatcccagcaggtcccgcccccagcatccccttgaggcctccctgagctaagaccccaagggtcagcggtggaatctagtctgcctctcttgaccttgcccttgctctcaggtcggcttacaaatgtatatttacatatttctgtattgaattatttcatggcaaggaggaggcaaatatagaaaacatcacccagtcacgccacacccccaaaaatcctgtccccattttgaactcctccctgcgcatctttttttcttgtttgtccatatttttttctagagaggccttctttgactagcccgtttaaaactgaaccaggccgggcgcggtgactcacgcctgtaatcccagcactttgggaggccgaggtgggcggatcacttgaggtcaggagttcaataccagcctggccaacatggtgaaaccctgtcttcactaaaaatacaaaaattaggccgggcggggtggctcacgcctgtaatcccagcactttgggaggtcgaggcgggcggatcatgaggtcaggagatcgagaccatcctggctaacacggtgaaaccccgtctctactaaaaatacaaaaaaaaattagccgggcgtggtggcgggcgcctgtagtctcggctactctggaggctgaggcaggagaatggcttcaacccgggaggcggagcttgcagtgagccgagatcgtgccactgcactccaacttgggcgacagagcgagactccgtctccaaaaaacaaaaattagccaggtgtggtgtcatgcgcctgtatttccagctactcaggcggctgaggcaggagaatcgcttgaacctgagagacagagatttcagtgagccgagattgagccactgcactccagcctggatgacagagcgagactcagactcaaaaaagaaagaaaaaacaaaaactgaaccaggccaggcacggtggctcatgcctgtaatctcagcatttgggaggccgaggagggaggatcacgtgaggccagcaatttgaggccagcctgggcaacacagtgagacctcctgtctctacaaaaaataaaaaattagctggatgtggtggagccatgattgtgccactgcaccccagcctgggtgacagagcaagactctgtttcaaaacaagaaaaatctttgaaccatcctactctcccgactccttgactctaattttttggccatggcattttttttttaagtgaaatcaaatttattaagaaagtaaaataataaaagaatggctacagctggtcgccatggctcacgcctgtaataccaacactttgggaggccgaggcaaacagattgcctgagctgaggagttcgagaacagatgggcaacatggtgaagccgtatctgtaccaaaatcacaaaaaattagccaattgacgtggcgcacacctgcaatcccagctactcagaaggctgaggcgagagaatcgcttgaacctgggaggtagaggttgcagtgagcccagatcgcactactgcactccagcctggatgacagagcgagactctgtctcaaaaaaaaaaaaaaaaagaatggccactccataggcagatcagcaccacagcactattactgtctaatctcctttataatttgctgatttaggccgggcatgttggctcatgcctgtaatcccagcactttgggagggcaagacgggaggatcgtttgaggccaggagtttgagaccagcctatgcaacatagcaagaccctcatctctacaaaaaatcaaaaaattagccaagtgtggtggcccacacccatggtccccactacatgggaggctgagccaggaggatcgcttgagcccaggaagtggaggttgcagtgagtgagatcacgccactgcactccagcctgggtgaccgagtgagaccttgtctcaaaaaaacaaaccaaaagaactgtcttaatttggtggtttgggccgcgtgcggtggctcacgactgtaatcccagcactttgggaggccaaggcaggcggatcacctgagatcaggttcgagaccagcctggccaacatggcaaaaccctgtctctactaaaaatacaaaaattagccgggtgcgatggcgggcgcctataatcccaactactcaggaggctgaggcaggagaatcacttgaacctggggggcggagtttgcagtgagccgtgatggtgccactgcacaccagcctgggagatagagcggtactcagtctcaaaaaaaaaaaaaaaattggtggcttggtgaaggagactctaagactcaattcaggggcattatctgagaggtgatcccagaagccctcctgggggttaaagaggcaggaagggaaggggagccctgcagggggtgccagcgagcaggttcaacgtgggccaccaggaatgggtcctttctcagggagacagcaacagaagaggtgcttctgttgtcctacctgagggtggagggagcggaggcatttacagccaactctccttccgtctgtggttgaagactgctctcaagagagccatgtggccatgacgtggcctcccgtggtcagcgtcactgtcagccaagaaatgcaagcctcacaggtgggacatgcttggccgaccatggctgccttcatgccacgttttatttccccacgactctcccaaaggtattcagtggcttttaaaattttactagaaccagcagggcgggcgtggtggctcatgcctgtagtcccagcactctgggaggccaaggcaggagggttgcttgagcccagaagtttgagaccagtctgggcaatgtggtgaaaccctgtctctaccagaaaaatagaaaaattaggcgggtgtggtggtgtgcacctgtaatcccagctacttgggaggctgaggtaggaggatcacttgagccgaggaggtgcaggttgcagtgagccatgattgcgccactgcaccccaggctgggtgactgagcccagactctgcgtcaaaaaacaaaacaaaacaaaaattactaaggccgggtacagtggctcacacctgtaatcccagcactttgggaggccgaggtgggtggatcacgaggtcaggagatcgagaccatcctggctaacacagtgaaaccccgtctctactaaaaatacaaaaaattaaccgggcgtggtggcgggcgcctgtagtcccagctactctagtcccagctacttgggaggttgaggcaggagaatggcgtgaacccggggggcggagcttgcagtgagcccagatcacgccactgcactccagcctgggcaacagaacgagactccgtctcaaaaacaaaaacaacaacaaaaaaaacattactataactaacaaggccatgtgaccttaaacaaggtcttctcatgttattaaaaagtcatgctttgggctgggtgctgtgtcttacgcctgtaatcccagcactctgggaggccgaggtgggaggatcacctgaggtcaggagttcgagaccagcctggccaacaaggtgaaaccccgtctctactaaaaatacaaaaattagccaggcgtggtggtgtgcatctgtaattccagctacttgggaagttgagtcatgagaatcgcttgaacccgggaggcagaggtcgcagtgagccaagttcatgcccctaacacttcagcctaggagacagagcgagactccatctcaaaaataataataataataataaaataaaaaatataaaaatacagaggaggcagccaaggcacagagatgttgaggtgcgggtcctaggtcacacagcttggaagtgtctgagccagcctcaatcatcgtttgatgaatgaatgcgtataggtccacaatgtccatgtcagtccaccttccagccgttcctttaagtcctccctggcccagactcatggtcattacacctacttctggtcctgaccgctggctccagagcccctcagacccctccagacttccaggccttattgagggtctctggtgcttggctcagccctccccatctctctggggaagactggattccaccagcagcggacctgcgggcagactttgtatttttttttttaatttatattttttagacatagggcctcactctgtggcccaggctggagtgcggtggcacaatcatggctcactgcagccttgacctcctgggcccaacggatcctcccacctcagcctcccgagtagctgggactacaggcgcacaccaccaggcctggctaatttaaaaaaacttttttaggcagcacgtggtggctcacacctgtaatcccagcactttgagaggccaaggtgggaagatcatttgaggccaggagtttgagaccagcctggctaacattgcaaaaccccgtctctacataataataataatgataataataataatagtaataataataatagctgggcatggtggcgcacacctataatctcagcttcttgggaggctgaggcatgagaatcccttgaacccgagaagggaaggttgcagtgagccgagaatgtgccactgcactccagcctgggcgacacagccagatcctgtctcataaaaataaataaataaataaagtttttggcttggtacagtgtctcacgcctgtaatcccgacactttgggaggctgaggcaggaggatcatttgagcccaggagtttgagacctgcctgggcaacatggcaaaaaccccatctctcttctttctctctctgtcttttttttttttttttagacggagtcttgctctgtcacccaggctggagtgcagtggcgcaatctcagctcactgcaagctccgcctcccaggtgcacaccattctcctgcctcagcctccggagtagctgggactacaggcgcacgccaccacgcttaactaattttttgtatttttagtagagacagggtttcactgtgtttgttagccaggatggtctcgatcacctgacctcgtgatctgcctgctctcgatctcccaaagtgctgggattacaggcatgagccactgcacttggccaaccccatctcttaaaataatacagataattagccaggcatggtgacatgtgcctgcagacccagctactctggaggctgaggtgggaggatcacctgagtcccagaggctgaggatgcagtgcagtgagcaatgattttagcattgcactccagcatgggtgtcggacagagaccttgtctcaaaaagatttttttttttttttttgtagagacagagtctcactatgttgcccaggctggtcttgaactcctgggctcaagcgatcctcccaactcggcctcccaaagtgctgggattacaggcatgagccatcacgcctggcgtgggggagggtttttaaattcccctgctctgcctcatggctgtcacagagaggatggaggtggcagaaaaccaggaaggaggaggctggggtgggagatttggggtctgtgcaggtggctggggaagggggagggcagcccttgaccctgttccagcctgatctgactccacagggccaggcatccatggttgccccactgcctagactgagggttcttggggcagcacccaggctgaggcctggagggactctggcatcacccacctcagggtgggctctgaggacctgagggtgttgggtgaatgtggtgatggggttgaattgaggcggggccaccccagggagcttcttgcctggctctccatgtttttttctttcgcgggggggggggcctctgggctttccagggcatctctagggtctgtgaggatctctgggtggtctcaatgtctctgaatatttatcttttttttttttttttttttgagatggagtctcgctctgttacctgcgctggagtgcagtggcgtggtcttggctcactgcaagctctgcctcccaggttcacgctattctcctgcctcagcctccccggtagctgggactacagacacccaccaccacgcccagctaattttttgtatttttagtagagacggggtttcaccgtgttagccaggatggtctcaatctcctgaccttgtgatccacccacctcagcctccctaagtgctgggattacaggcgtgagccaccccgcccagcctttttttttttttttttgagacagagtctcgctctgtcacccaggctggagtgcagtggcacaatctcagctcactacaacctctgcctcttgggttcaagtgattctcctgcctcagcctcccgagtagctggaattacaggcgtgcactatcattcctggctaatttttgtatttttagtagaggcggggtttcaccatgttggccaggctggtcgtgaactcctgacctcaggtgatccacctgcctcagcctcctaaagtgctaggattacaggcgtcagccaccatgcccagcctggatgtctctgaatgtctctgaaagtctctggggatctctgagggtctctgagggtctctggggatctctgagggtctctgagggtctctgagggtctttgggagtctctgaaggtctctaaatgtctctgaggatcttgggggtctctgaggttttctgggcatccctgggcgtttctgagtgtccctaggtgtctctgcatgcctatggtggcccccaagtgtttctgagggtctcttggcatctctgagtatagctggggggcgggctggtgtctctctgtctggggccatctctggcggctgcctggaggtttttgtgcagactggctggccctgcctgggactcaagcctgggacggcttcaggtacatcagggggcagcagagggaccccagggaggtggcctctgaaagttccaggctcccttcagccagggatgaggccagtggagccttgagctgtcccctttcccagaaacctgggagtagccagctggggctgtgtcaggaaggcccagaccccaggggccccagaccccaagactcccagacctctggatccctagaccccagcacccccagaccccaagacccccagacctcaggaccccaggacccccagacttctggatccccagaccccaggaccctcaggccccaggactcccaaaccccaagactcccagacctctggatccccagagcccaggaccctcagtccccaggatccccagaccccaggatcctcaggccccaggactcccaaaccccaagactcccagacctctggatccccataccccagaacccacagacctcagaaccctcacatcctaagacctgcatgaaggggtggcctgcccctccacacctgtgggatatctcatcaggtggaatgagagactgagaaaagaaataagacacagagacagagtatagagaaagaacagtgggcccaggggaccggcgctcagcataccaaggacctgcactggcaccagtctctgagttccctcagtatttattgattactattttcactatctcagcaagaggaatgcatcaagagagcagggtgatagtggggaggaggtcagcaagaaaacatgtgagcaaaggaatccgtgtcacaagttcaagagcaggtactgtgcctggatgtgcagcgtaggccagatttatacttctctccacccaaacatctcagccgagtaaagagtaaacagagcagcattgctgccaatacgtctcgcctcccgccatagggcggtttttctcctatctcagaattgaacaaatgtacaatcgggttttataccgagacattcagttcccaggggcaggcaggagacagaggccttcctcttagctcaactgcaagaggccttcctcttttactaatcctcctcagcacagacccttcacgggtgtcgggctggggggacgatcagatctttcccatcccacgaggccatgtttcagactatcccatggggagaaatcttggacagtacctgactttccagagcagaggtccctgcggctttctgcagtgcattgtgcccctggttactcgagaatggagaatggcgatgacttttaccaagcacactgcctgcaaacattttattagcaaagcacatcctgcacagccctagatcccttaaaccttgattccatacaacacatatttctgtgagctcgaggttggggctaaagttacagattaacagcatctcagggcaaagcaattgttcagggtatgggtcaaaatgaagttttttatgtcttccttttctacatagacacagtaacagtctgatcgctttttcttttccctacatcccagaccccaggactaccaaactccagggcccccagactgcaggacccccagatcccaagactcccagacctctggatccccagacttcagaaccaccagacccctggacccccagaccccaagactctcagacatctggatccccagacccctatacccccccaccaaacccccatatcccaagacccctagatcccaggacccccaaacctccggatcctcagactttaggacccccagacctcaggacccttagattccaggactctcagacccctggatccccagacctcagagtccccaaatctcaggaccccacagacctcagactccaaggcccccagctcccccagacccacctccaaaactcactatcccagaccccaggcctgcctgtcccccaccacctgcagcctcgggtctggcacttcctcatttctttatttcctttttttctaagaggcctcagaactgggcgtggaggacgtgcagctgcatgaggctcactgctggctgggctcctccatccctctgctccttataaaagaggccccaagagctcccctgctccctctgctgtctactgaggacacagtgagaagacggtcatctgcaaactaggaagtgaatctgctggtgccttgatcttggacttcccagcttccggaactgttgttcataagctaccccagtttacggcatatttgttatagcagcctgaacaaacatttggagacatctgctctctacccagggctgctcccaccacagggcctttgcacatgctgttcccactcctggatgctgttccccacatcccttcctccttactccctaaggggttccttgatcatcccattgaaaagttgcttctgcggccaggctcagtggctcacgcctgtaatcccaacactctgggaggctgaggagggtggatcacctgaggtcaggaattcgggaccagcctggccaacatggtgaaaccccgtctctactaaaaatacaaaaagttaactgggcatggtcccatgcgcctgtaatcccagctacttgggaggctgaggcaggagaatcgcttgaacccgggaggtggaggttgcagtgagccgagatcgcatcactgcactccagcctgggcaacaagagcaaaactccgtttcaaataaataaataaataaataaataaataaataaataaataaaagtttcccatctcatttcctgcccttatttttctttgcagcattcccaccacctgcacttgatatattttcccgatggattctgcctgttgtctgtttccccaactacagtgagaggtggggggagggggggctgggatttttgtctgttttattcactgctgtgtctgtggttcatagtacctggtatacaacaggaacttcataaaggcttacagaggaaatgaatgagtctttccttataggttcatagagatttataatttcattttcagaactttgtggcatgctaggatggatgaactgaactgttactaatgtaaccaatcctttaagttatttcctttttttttttttccttcttcttgaggcagaggatcactctgcactctgtcaccccaggctggagtgcagtggcacgatttcagctcacttcaacctctgccttccagactcaagcgatcctcctgccttaggttcccgagtagctggaactgtaaggatgtgccaccactcccagctaatttttgtgtgtgtgtatatctatctatatatatatataaaaatttttttttttggtagacatggggtttcaccatattgcccaggctagtcttgaactcctgggctcaagcgatcctcctatcttgacctcccaaagtgctgggattacaggcatgactcactgtgcccggcccattttattttttttcatgtaacaaacaatgctgcaatgaatcactttgagcctggagcatctttttgccttctctctctctctcttttttttttttatatgaagtctcgctctgtcaccaggctggagtgctgtggcgcgatctaggcttactgcaacctccaactccctggttcaagtgattttcctgcctcagcctcccgagtagctgggattacaggtacatgccaccacgcccagctaattttttgtatttttggtagagacagggtttcacagcgttggccaggattgtctcagtctcctgaccttgtgatccgcccacctcagcctcccaaagtgctgggattacaggtgtgagccaccacgcctgactttgccttctcaaaaaaacaaacctgcaacatacacacaacataaaattgaacattttagccaatttatttatttattattattattttgagatggagttttgctcttgttgcccaggctggagtgcagtgccgtgatctcggctcaactgcaaactctacctcccaggctcaagtgattctcctgcctcagcctcccaagtagctgggattacaggcatgcgccaccacacccggctaattttgtgtatttagtagagatggagtttctccacgttggtcaggctagtctcaaactctggacctcaggtgatccgcccacctcagcctcccaaagtgctgggattacaggcatgagccaccgcggccggcccagccatttattttaaattattttttagagatagggtcttgctctgctgcataggctggagtggagtggcacaatcacggctcactgcagtcacaaccttctgggctcaagggatcctcccacctcagcctctgaagtagctgggactacaggctgaagccaccatgcccagctaatttttaaattattattattattattattattattattattgagatggagtctcgctctaacgcccaaactggagtgcagtggcatgatctcagctcactgcaacctctgcctcctgggttcaagcgattctcctgcctcagcctccctagtagctgggattacaggcacgtgccaccatgcccagctaatttttgtatttttagtggagacggggtttcaccatgttggccaggctggtctggtactcctgacctcgtgatccgcccaccttggtcccccaaagtgctgggattacaggcatgagccaccacgtccaggctgagccacatttttttattcgttagtcagttcacactgtaaacatgcaaatattcaggcagggattcccagaagtggacttgctgtgtcagcaggcacatgagtttatcattccggtggcctgtgccagggtgccctccaccagtgctacaccatggacgcaccccacagcctggctggcacagaatgtcattgcattgttggatttttgccaatttgattggtgaagacaaacagtttgtgatttgcagttttcttattaagtgtgaacttttttttttttttgagacaggtctcactctgttgcccaggctggaatgcagtggagtgatcttggctcactgcagcctccacctcctgggttcaaacaattctcctgcctcagcctcctgagtagctgggactacaggcacataccaccacacctggctaatttttgtattttttaaagtagagacggggtttcaccatgatggccaggctggtctcgaactcctgggctcaagcgatctgctcacttcagcctcccaaagtgttgggattacaggtgtaagccactgcacctggcaagaatgagcatctctggacatgttgaaaagcagtttcccgctttttcttcaaggtctccgttcaaagcctttgaccatttcttggagtttggcgatgtgaaggacagaggccgaaaagaggggaaaacgtgggggagtggactcccagcctcccagatcccggagaagcctctgtgcatttgacagctgtggacatggtgtcacacgcagttaaggtggcacagtgagtcgggctggcataggttgtacctggtccacctgacaccaggttcaggtgaggccttctcccagcccacccctcctcagtatcatttttgtcactactacccctccagtctgcctcaggcccccatctgcttctgggacctcagcctcctccccaagttgcccaccccagacaccaggctcactccagagggacttcttgagccagtgcccctctgcccacgcacctgccttggctccacatggacctcttcccccaccaccaattccttctatcctctccactcctaaccatgctatcccagccagctacattttcccaagctgctgggagccctcctcactgtcccctccagcatagaggtgccactgtgcaagaactcagtgggagaggcttggaggagcttggagagccaatgataggtttggggaatcttagtgaactcctactcatgcgttgaagccccaactgtaatgcctcctcctccaggaagccttccaggaccctgtctttccctctggaccttccttaactgcatgggactaggagtgtctatgtccagctctgtcctctcttaagatagctccttgaggacctggtcagggctgaggcctcttgggggcccagcgtgggtgatgcttgttgaatgaataaatgactgcatgagctgggaaccagccaagctgagatcaagaagcgagttgatgaggtggcagtcggttggggtgctaatagaggacatgaagtcactgggttctagcaagagggaagcgggactctggtccacccctccctcttgccctccatccacctctggtgagaaccttgaggccctgcaagggggcggatctctgtcttcattcttcccctctgcactccacccagacaccagttcctcttccccctgagtcgctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggtaggactgaggctctagaacttgcacctgtgcagggactgcaaaccagacctgggaggaccctttcagcagcccccactccaccctatcccaggacttcccagcgacccgccgttctgggagataccgggagcgtgatcagggggcggggccgtttccaaggcaaccgcttatttgcatagggtcccgtcctggccaacgagggcgccccaaatgttcaggacatagaagaaggggttaactggcccggatctcctcctcgccttccaagcccgctaagcactggggttatctacccattccccagaaggggagactgaggcagcccaccagccaaaggaggcgaccagactggggctgcgttttaccatttcagaagcggcttgagctggtctgagctataataataaacactggcggtggaggcgagggcgaccacagggctgaggtcagggctaggattccggtgtctctacgtaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcctgcccctccactcccgactatgagaacatgtttgtgggccagccagcagccgagcaccagtgggatgaacaagggtaagtaagccactgagacacctgccaaagtggtgaataataaggctccacacccagatggccgaggttcaaatcccagctctgccgcttgaaggctgtgggatcttaggtgagtagctttacttctctgagcctcagtctcctcacctataaaatggggagaggactggacatggtggctcacacctgtaatcctagcactttgggaggccaaggcaggcggatcacttgaagtcaggagtttgagaccagcctggccaacacggtgaaacccagtctgtactaaaaatacaaaaattagccaggtgtggtggcgggcgcctgtggttccagctactgaggaggctgaggcaagagaatctcttgaacctgggagtcagaggttgcagtgagccaagttcatgccattgcactccagcctgggtgacagagtgagactccatctcaaaaataaaatcaataaaataaagtaaaatgagggagaattacagcccccatcatagtgtgttggggtaagaattaagtgagttcccatatatgggacaaacttcccccccttatgacctgtaaacccagtttctggcggccaaggatggggagacaggaggcaactgcttgagcggagttggggctccgcggtggcggtcagcagcataggcccaggtcccatgtgacccaaggctgtctctgaacctccatttctgtctccatagagtggggacagccccccatttccccatgacacacatgagatactaaagaggtgccctacaaagtcccatcaccactagatgatttttttttttttttttttgagatggagtctggccctgtcatccaggctagagtgtagtgacacgatctcggctcactgccagctccgcctcccgggttcatgccattctcctgcctcagcctcccgagtagctgggactacaggcgcccgccaccacgccaggctaattttttgtatttttagtagagacggggtttcaccgtgttagccaggatggtctcgatctcctgacctcgtgatccgcccacctcagcctccttaagtgctgggattacaggtgtgagccaccgcgcccagccgacatttttttttgagacagtgtcattctgtcgccctggctggagtgcagtggcaccatcacagatcactgcagcctcaagctcctggcctcaagtgatcctcctgcctcagtctccagagtagttgggaccacaggcacatgccgccgcacccaactaatttttgtatttttcatagagacgggggtcttgctatatttctcaggctggtctcaaactcttggcctcaagtgatcctcatgtcttagcctcccaaagtgctggcattatgggtgtgagccaccgccaccggcttctggatgattttgctgggcttagacaaatgagttgaacttttctaggttggtgtggggtgcggtggctcatgcctataatcccagcacttttcgaggccaaggcgaggtcagatcacctgtggtcaggacctcaagaccagcctgaccaacatggtggaaccctgtttctactaaaaaatacaaaaattaggccgggcacggtggctcatgcctgtaatcccaacactttgggaggccaaggcaggaggatcacgaggtcaggagttcgagaccagcctggccaatatggtgaaaccctgtctctactaaaaatacaaaaattagccgggcatggtcgtgggtgcctgtaatcccagctacttgggaggctgaggcaagaagaatcacttgaacccaggaggtggaggttgcagtgagcccagatcgcaccactgcaccccagcctgggcgacagagcgagactccgtctcaaaaaaaaaaaaaaagaaagaaagaaagaaaaaaagaaaagaaaagcttttctaggttggaaaagggaatggagggaatttcaaggggtgggaccctcaggggcagagacccagaggtgggaaagaacagagaatttgctgtgaatggtttttgagaagggatgacttgaaagctgaggcctgaggggaacagggagggccaagcaggaaggggccgcggccatggctgtgtttgggcagcagagtccgtgccaggaggtggggaggctatcggaaggctgttggtgagaaaggagaaaatatgcaaagcagatgtcaacatggctcaaaagcagaaatggtctgaggcagggtgttgaagacactggactcgcaaaagcagcttgtgctctgatgttcatcttggcctccctgtccccgaggcttccggatcagcctcctttatgtactggcctccagaaacactgtgtttagaattgactgtgtcatttccaccctgcatcttacagttacagacatggaggctctgggaggcagggaaatgacttgtccaaggtcacatagccagtcaaaaaaggcaggacacaaaccctgcgtcccagacctgttcgtccccctacaaccacttaggggttggtgggcaattcgtactagagtataattgactgatagatgctgttaacacaaagtagcccttttgcctttttttttttcccgctctgtcgcccaggctagagtgcaatggcatgatctcggctcactgcaaccttcacctcccgggttcaagtgattctcctgcctcctgcctcagcctcccgagtagctgggattacaggcgcccaccatcacacccggctaattttagtagagacggggttttgccatgttggccaggctggtcttgaactcctgacctcaggtgatctgcccaccttggcctctcaaagtgctgggattataggcgtgagccaccgcacctggcccagtggccctttttacaagaggagctgggttggaattagaatgttcaggaggcaggaaaattctctggaggtcttgctgaccataacaaatatt

SEQ ID NO: 12609 - DNA, 109025 bp, Human
  misc_feature (1)...(109025): n = A,T,C or G
cagagtgaaaatctcctaggtcatttgttgaaaggttacttagactggatgtgtaatgttttttcttacatctcatgattgaaaccatgggaattgtgattcagagagaagtactgaaagtgaatgtctataaggtatcatctgagaagggttctggaatttagggttttgttgttgttacagagatgggatcttgatacgttgttcaggctggtctccaactcctggtctcaagtgagcctcgcatagctaaaagtggtgaagcttggacatgaatactggcccttcacttctctgctatcctgcctctcatagtctgcctctctcatagtaaataaatacagattatacttattatcaggccaaaattgtgaccacagtgtgggacattgggacttggttgcattgctctaaccagcaagaagcttgggtatcagctttgagaattattcccttctgtgtcacctcttgaatcaaatgtgtaccagtggtgcagcctccctaaacggatacagtatttcttcattctgcttacatatgactctttaaaaaaaaaaaaaaaaaaaactaactccactgcgctattgtatcagaagtggcgagaagaaattattgtagtacagctgagactgggcagcccagattacagggaagaagtggcctggcggtttgactggtacgcgttatgttccttagccctccttgctctttgtccttactcttgattgtcctctgtcatcttccttaagttctctgtcttctaatgcactttaccttccctttgatttttttttttttctatccagaaaagaaaagaagccactacaaaaagtaaaggaggggcaaaggtgatttagaagtctgggggccagaaggaaggggaagtagtatcgaataggagctctaggaaagactttaaatgcagatttcagcttgtcctgctgcattgttttttcttttggtaagcagttattgaacaccttgagtagcagtcttttatggtttcctcacagtctttgtaagtctctttgtttagctctttcagtacgtaaacctctgtcactggcttgttcttgcttacctaaatattattttgattatgttagtgatgacgagcacactgattttcttacatttttttttattttcttactgagaggaattcagcaagcaggagctgatcatggttcttcccacttgggggtcagtaaagttcccctgacttctggggcatatcttaagacctttggcgttagcagccagaaccagctgagggaaggaaagtttggaggcggcaggatgtgagagaggaagtgaccatgctgtgtgcagggaggcgagctgccacagagagagggcaccgatggaggagcagccaggcagctgctgcaggagagccaggcacaggagcttcccgaggggccaggaagatcccccactagggggcattgattaagaggccttgtgcaggaactcggggctacaggggtgtcagatgtacctagttaaatttgaaaaccttcaatttcgtgtcctggcactggctcttccccgggctgtctgttgtgggtgagctgttgcagcatagacttcacattggctaacccaaaacagagactgggaggagccccttacaacacctgtagtttccacatggtgcaagatcactcttgaaactggaggctggcagcccaaacccagagctggtagattgtagttcatggtgctgttgaaatacaactcgtgtttaaagaatttgggcccaatgaggtaggcttgtttgtttcttaaatgttaacctttacatttgcttaatcttaaaagatttttttaaagagacggcttttatattagaaattatacatgcacataaaacaatgttaattactggtctcaaatttctgattggagtcaaaattcttttattgttggtaaaatgatcagacacttcatcatcagctctcttcatttttttcttcctcttctctgttttctgttttagttgctgatatgtgttcaagatgagtgggatgggagaaaatacctctgacccctccagggcagagacaagaaagcgcaaggaatgtcctgaccaacttggacccaggttagattcttgctgagaaaaggaatcagtattgtctgttaaagccacatgagtgcttctttgttattttagcattgattttactgctgattcaaatattgagttggtttttctccttaacagttaaatctctgaatatgtacttgcttacattttgaatatgcaaatcagttacagattgtattctttacaaaaagaggaaagctgtaaacttctgatatcttttgactcttagaatcaatttatttaataatattgagtttgattacacaatattataacaagaagatcctatagtaaaaaggatttgccgttaattttataatgggttttatttttgttgttttatttttaaagacataaaatgttaaacccatgtacttctgagttgagaacaaagattgtggctctttagtgaataaaacaaagaattttaaagcaaatttcatctcatatattatgggtggaagtatgagttgttataatgcccatgtagggtaatttggcagtatcaaaattataaatgcatatcctgtttgaactagccattccacttttaggaattttcctattatatactttaacacatgcaaaatgacgtgtatatgaggttactcaaattgcaaaagattcggaaaaacctaaatgtctgttaaacagctgtggtacatctagaacctggaacacagttcagctaggataaagatgaggatgctctttatgggttaatatgaaaaaaaaatctcttaagaatattgttacagacaaaaagcaaggtttagaaaatgtttttggaatattgccatctgtataaacaaggaagaaaaaagaatgtgtattgttttaggataatcaagaaacaataattgttgctacctgtttcggtggatgagaactgggcaaatagttaccaaaagtagaagagagacttttcactttttcaatgttttaaatcatataaataattttaagaattaaataaaaacaacaccttctacctaatggacagtaaaagcatcagacatgaaatagtagggaagagggctaggaaaagtcatcaagagaggcagagcaggagaaagggcaaaacaccagtattttatattcccttttccccttctagttgccaagcaaaacatcaagcccaataaatctccactctctacatcccagcccccagctcctctaggttccctactacttcctggtaaaccacaaacttctgtctgtcagactgcctttaatagtcaggagccctacctggggaggcagtgggagaaagtgggaactgtttcagctgtgggctgtagtggcaggtctctgagccctccctctggggcgctcaggggtcttttgaacacaactcccctttctcacctatttgtcatttatttcttaccttgtgagagggtgagagggcatgggtggagggtggtggagggggtcagaatgggaactgggctattctaagcattccagccactctttaccttttgctgtaaaaacagaagctacgggtaaaaatgagacttagaaaaaaaaccaaattctgaattactgtgccagtaattcgtggggtgatcctggacaaattgtataaacactataaaatagagacattgtattatagtatgtatttatgaaaatcaaacatatttagagatgcatatatgaaagtctattgtgaatccagaaattttaaaattagtattatatacaaataattatatataaaaatacagaaagctgctacattaagcaacttgcttttcttccttattgtattgttttgaatgtcatttaatgggcccccctttgcacttgagaaaataattgtatgctgttattatgaaaaggaacttttcagtttactattttgtcacattctaatggaagattttgcctcttttgatatttttccattccattaactttttaaactttagttgaaattggactgtttgtttatattttgcatgtcattcagcttggacagttaacaaatttcctgggtcagtttcgcttttgtttctagctgtattgtgactttttgcattacctaaaaaggctgtttggtttgcttactaacattctgaagaagtctataaaattataaatatctggttttattttttatgttttaccaaaaattattgaaatttattcctgttattaactgggttaacttctcttcttttactaatcttaaataaattttaaaatataacctcctttacctttttgaaacattcttttatttgtcaactaatttggtgcccacttgtttcaagtactgcactaagcacagtggtgagcacagtccaggtcactgtgaagtggacagtccagtgggagacgccaaacacattgaacagatagtttcattacaaactaggcttaggttgatttttttaaaaaaacatggaacacttttggaaaattgtgtttttcccccaaaagtatttctgtgtttatataggtagcttttgtttgctatctttgtattaaacttgtttaacacgttcatttttttcacaatagctctttttcaaatacatcataaaaatgtgtttcttcttttaagccccaaaaggaacactgaaaaacgtaatcgtgaacagggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaaggtaagaggactgaattagtattttgaagagttgaattggtttctgtttttccctgtgtgagaagtcccttcagagtccctttaatccatttcttatgcttaaattattgatgaggaaatgatgtcacagtgtaagatgaatgcaagtatcacttgcagtggtttataaataggctttgtataaaattcagccataccctaaagacagagaagactgaggtgagtcagggtgatggaacttttcatctagtaaactcagttaggtgcccacaattctcctccccacactgtggcattttcaaggcatacacagcaagtgaccatcaaaagttgcaagtagcagccagattgagatgtaaaccagaagtaaggaagtgaagcacctcctatttcagctagtcagcatatttgattaatctgagcctcaactggccatgacactagattagaatttcatatcctgaatgacaagagatttgaaagtctctaacctccagtaagaaatccatctgtgaacttgaaacatagaacatgacagctctcttcctatggttttctttttttctgagataattttatgattcttttctttgatatttatgcctacagaaaaatatcaagaaaataatgtttttaagaacacatttgactttgtggtgccaaaaataaatctttattcggcatgtatgaacaacgttttggtgcccagggccaatatatgctcttgaagtatctgtgtactgcttttctttaggcctggggagattattatcttttgtaatctggtgtggttttttttttttttttttggtgttttttttgagacagtctcactctatcgcccaggctggggtgcagtggtgtgatcctcaactcactgcaacctctgcctcctcggttcaagcgattctcctgcctcagcctcccgagtagctgggattacaggtgcctgccaccatgccctgctaattttttagtatttttagtaaaaacagggtttcaccgtgtttgccaggctggtctggaactcctgacctcaagcaaccctcctgcctcggcctcccaaagggctgggattacaggcgtgagccaccgtgcctgacctgtaatctgtttttgaatgcatcctcttagagttcaaatttttaaaatctgccttttatataatattcaaaaaaggcatatttcataaaaataatatctttgtctttataatacatgagcctgaaactgtctgctcttatctgtcacaaatcctagctacctattagcatatcatcttagcgttttccatttcatacctatactgttgagctaaattctgtataaaatagttttacaagtatagttctgtcttctaagaacataaaaatatacatatagcattcacaacacagtttctaacaccagcccactctgcaaatcagtctttatttcctgatttctccatgacctttaacatccagtgggtttcttctcccagtgcccatttcagtccccttcatcactcgtctttcttttccctttggggttcactagttatcaaaaactcagtttaaacctcaattttgtatcttcatattttagtgtcagcaaagggataaaataatattcctagaactcttaggagaaataattggttaaagttattaaccagtgccttgaagttgctgtgtttctagttgctgatgtcattacagtaaagaaatcattaagcttcttgttttaggtttctaaggattatgaatgattcagttttgagaacactgcatgtttaggtagtacttctacatttcaaaacaaatatatatatatatatatatatatatatatatatgcgccacaaagaaggtcttgcacaagtttttaaagtttgcaaaaccttggtaattcccccttcaaaccataaaacatgttcagatgtgtcatgctgggactgcgccataccttaaccatagttttaatcatagggctgcataccacaaccacccaagaagcagcaatatataccctgtcacgtcttattcttctaataatgttcctgctaatttgaaaagcaacgtgttttgtaaagggaagcaaaacttaaataccaaatgaaaaaacgaaaagcataaatgtatttttaagttctcaactactctgatattttccgaatagtctttgtttaataatttgttttttaaaaagagcagaattgaatcagacaggagctaggtatgaatcctggtccatttaggagctttttgaacctgggcaaattatcttatctctgagactcagttgcctcatatagagtttagtgctaacaatacctaggttacatagctgttgaagatatcatgagccatgtaaattcagtaaacacctgtcatagtagatgttcagtagttttcattcctacttaagcagaaagatgctgttttttctttttttttctttttttttttggagtcttgctctgttgcccaggctggagtgcagtggcgcgatctcagctcactgcaacctccaccttctgggttcaagcgattctcctgcctcagcctcccgagtagctgggattacaggcatgcgccaccacgtccagctaatttttgtatttttaatagagaaggggtttcaccatgttggccaggctggtctcgaactcctgacctcatgatctgcctgcctcggcctcccaaagtgctgggattacaggcatgagccactgtgcctgacctatttgtagaaagtaaaagaattttctggtgccagaaaatctgtgcaacccatgcgtaccactccatcagcagctctgtttgggccagtttgatttttctcagcatctgacagccagtaagaacaacacataagtcaggccaaagcctttctctctaactctgtcttcccccaaccccaactgatcccctgaccaatcagcataaataaaatccaactaccatctttacaccattatccagacttaatttgtatttcagtcatagttgtcagcgtgaataaaatgcatttgggagctcaggagaacatgcccattatgtaataaacctgcctatttatcctagagaagttaaactgggttgcatgaggggccatactaaagaatacacaatgaggaaagctgggctcatctttatggaaccctgctccagtgtcagaagctatgacgtgtcagccaggcatggagggctctttccctcaagtctgtgctctgtcagttacttctcaacttttatatgctttataaataaagggagagaagaaaaggatttttaaatggcctaaaggatggaaatttggaggggaaattaccagctagttaaattaataagcattctgttgtacgtagcgctttatgagacccgtgtttcataaacgctagccctccaagagcattaactgtggaatggactttgtagaaacagagcaagtacacacaagagtttgatgctaatagtgtgactgccatcaaatagagaattccgtacatgttggtggggttttttttggccgacattcataatccttagttattagctaagttagttacttagtaattaattaagttagatcttctgttggctaaataatcttggagaatttttaatactagctaagactaaatagttcttactgtgtgtcaggcagtttttaaagtgctcagatttgataacctatttcgtactcaaaacaaaccatggaataggcgtattgttttcccccttggcaggaggggaacctgagacacagagtggttaagtagcctggcaaagtcacacagccattaagcgaaagaatagggcagtctgggtctggaatctgcactgtcatcacagctttctgatactgaagtaggatatttctttatatttggtatgatagtcataaatgtttagaacttctctcttctataacttagaaacaggagtcatggaaacagatagcaaataaccattttccctaactgggaggctaatattgcttctattccacagaaaaatagtaagcacaggcatacctcagagatactgcaggttcagttccagatccgcaccataaagcgaatataaaataaagcaagtgacatgaattttttgtttttccagggtgtataaaagttatacttcactgtactgtagtctattaagcgtacaatggtattacttctttaaaaaattaatacattttaacttaaaaataccttaatgctagaaagtgctataacaagcatatgagcctcgtcaacaagttctaatctctttgctggtgggagggtcttgcctcaatgttgatggctgctgactgatcagggtgggagttgctaaaggctggggtggctataacgatttcttaaagtaagataacagtgaagtttgtcatactgatggactcttactttcatgaaagatttctctgtaccatgcaatgctgtttgatggcattatacccacagtagaactttcaaaattggaatcagtcctctcaaaccctgttcctgccttatcaactaagtttatggaatattctaaatcctttgttgtcatttcaacagtgttcacagcatctttaccaggagttgattccatctcaagaaaccattttctttgtttatccgcaaaaagcaactcctcgtttgttcaagtttgatcatgagattgcagcaattcagtcacatcttggacttcacttctaattccagttctcttgttatttccactgcatctagagttacttcctccactgaagtcaggaatccctccaagtcatccatgagggttagaatcagcttcttccaaattcctgttaatgttgatattttgacctcctcccatggaatcatgaatgttcttcatggcatctagaatggtgattcctttccagaatatttttctttgtactttgcccagatctatcagaagaatcactgcctgtggcagatacacccttacaaagtgtatttcttaagtacaccttgaaacatggctatagcatagatactgtgttagttagcaggcatgaaaacaaacatttttggccttgtacatcttcatcacagctcttgggtgactgggtccattgccaatgagcagtaatattttgaaaggaatctttttctaagcagtacatctcaacaatgggcttaaaatagtcagtaaaccatactataaacaaatgtgctgacattcagtctttgttatttcagggcacaggcagagtagatttagcattattcttatgaagagccctagaattttcagaatgggaagtgaacatttacttcaagtcaccagctgcatcagccccttaacagaagagtcagtttgtcctttcaagcttcgaaatgaggcgttgacttctctcctctagctatgaaagtcctagatggctgcttcttccaacagaaggtttttttgtctacattgaaaatctattgcttagtgtaaccaccttcattaatgatcttagccagaccttctggataacttgctacagcttctccatcagcacatgctgcttcaccttatatttttatattatggaggatttttttccttaaactttatgaactcacctttgctagctttaaacttttcttctgcatcttctcatagaattgaaaatatcttctgcatcttctcatagaattttcttctgcatcttctcatagaattgagagggccttgctctcaattaggctctcatttaagggaatcttgtggctggcttgatcttctgtccagacaactgaaactttgtgcatatcagcaaaaaggctatttcactttcttatatttattttattttatttttttattttcagagatgggatctcactaggtggcccaggctggtctcgaactcttaagctcaagagatcctcccacttggcctcccaaagtgctgtgattataggcatgagtcaccacgtccagctgtttcacttttttattgttgatgcattcgctgaagtagcactattcattttcaattgcttttcttttcttcttcttcttcttcttttttttttttttttttttttttgaggtggagtcaggctctgtcacccaggctggagttcagtggcgccatctcagttcactgcaacctctgcctcccaggttcaagcagttcttctgcctcagcctcccgagtagctgggattacagtgcccaccaccatgcctggctaatttttgtatttttagtagagacagggtttcaccatgttggtcaggctggtctcaaactcctaacctaaggtgatccacccgccttggcctcccagagtgctgggattacaggcatgagccaccacaccccaccaatactgcagtttttaatgaagattaactatttttccactgaactacatataattcattttcgcacattttcatgtggcttaatggcttatatggctaatgaaatccttaaaattagtgagcagggatggaatttctattctcatttcctcctaggatccccttattttatttcttaagtacatggaagttttttgtttaacagctttcagataaagaggatttaaataattgaatgtgttataatgctttaggatttatgatgtgagctctcacttcaagacccaagccggctatcacactctgatagaaagtagacatcccttgttttcttgatcaccttgtacttgtatgaaaagaaattaattctgtcattaatgtatgacactaatcatacatcaatactgtatgtattgctttcattcaagagtaaatattcattcaataaattttgtattgagtatatactatatataaaacgtatggttatttgccaggggaaatccagcaatcagtaagtacatgattctttttcttggagctttcactcatttgggggaaaatcagctttcagacaactagctgtggaactgtagggaacaatggaaaggaatgtgattattaaagaagcctgttgattattaaagaagctggcacaggcttcgaggaggacaataaacttgaactgggtcttgctgtaaaagtaagattttaataggtaaaaaagtcggggctgggcgtgaggagaggcactccacacaggaaatagaggagcctgagtgctcagtggcatgtggtgtgtgccgggtcagactgtagaataagatgtatgggagcacttggttggatttgaggctgaaaagggcaagtcagagctagataggagagtagtaagcccagtacagtaagcaatattggaatttggagagggtaacattaaatgagagacctctaaccatcttcagcagagctggcttgaagtcatctaccatcctctccagattctagagatactctatatttggaatgggagataatttggatttttaaaaattctaaatctagagggggagaggtgcataactaatgaaacaacaagaaaaaatgaagttaaaacaaatgctggaaaactataaaatttctcattcatcaataagaaataaattttgttttataaataagctttcatttatttttataatttaaatagacttagaaggagcaggaggaaatgaagagggggaaatgacagaggtgaaagacagtgagagagactcacaatgacagagagctggacacagagagaggaatatggaaagtacactcagaagtacccacttgcaggttcaaacaccaagatagagaaattcttaaatatcttagtttatagttccttatgacattgtcactaatgacttaatgcagagtcatattgtgacactgcgggcacatttgtagataagagcccttgggctgagcccactagctgccagtccttaccttctgtcctactcccaccccagctttagtgaagagtgcccacatgtttcctggctgctcagccctctcttgtacttgtcagagggtgggggaggtgaatcagtatgctacctgctcctgccactttgattgctggggcatagtatctgccattgtgcccaggggagtaatacttggccattcctatacaagaatctgctaaaggtactccttaagatcctccttgagggagccaggttgatcatttgccccgacttcgtgactactagcggagtctatgacaaagtccaaaagaagaaccctcaccatagaagactagtacccctgtgatttgtctccagtcctgccattctcccttgctccaaccgacaacctcctttgcacttgcatctcttccccatgacatacactggctcaggctctcacgttgtggtttcctccttctgggtcttctgtttgggaatgcctctttttttttcccctctcagctggttgacatctgctcacctttagtaggccatcctgatggagtatcacagctattctgcgtttgtagtgtatagtgacagggaatctgggtggatgatagtagaaggtccagtggcaagggggcttcaccaagacctcgggtctgaccagtttggcctactactgtattcttgtggctcatttcatcagtacgtatacccaaagcccattaccctagactacttattattgctgacacatacttcacatacttgtgctttttcactttggtgtgattatttgtattctttcctccctatccaaaatactgcttttcctgtttctgtctattcccattacattcctactgttcattcttcaaggcctatctcaaacactgctttttttttcacaaaacactttctaatctccaaacaaatatgaattcatctcctttgacatctctggtactgtctgatcttactctgtttagtgtttgtttagtgttttaggtacttcactttctcttcacccactgaatgacagatttcttgatggcagaggttgtattatctacctaacccttggacctgcagcacttctttttttgagacaaggtcttgctctgtcttccgggccagagtgcaatggtacgatctccgctcactgcaacctctgcctcccgggttcaagcgattcttgtgcctcatcctcctgagtagctgggattataggtgtgcaccactacagtcatgcaccaccatgcctggctaatttttgtatttttagtagagacagggtttcgccatgttgcccaggctggtcttgaactcctgagctcaggtgatctgccctccttgtcctccctaagtgctgggattacaggcgtgagccaccgcacccagccacctgcagcggttttgagtatcatgtttgttcttagtttatgtaaaataaatatttgttggatttttctgattcctggcctttattcagccttgtgtaatggttttatatcaggagaaaatactgccctaaatttaagaacataacatttgtattatagtaactgagtgaatacattcccatccttgcacaaggattacagattacaacctatcttgtgacaaatattatttacaatatttttgtttgcctcctgatagtgcattaacatctttataaaacaagtggtggtgaactgttaactctcttagattctgataagcatagctggagccctgtttgtttttgtaaggatgaagaatcctcacagcttgtcgactagaatatattttgaaatcctattcgccggtcatggtggcttatgcctgtaatcccagcactttgggaggctgaggcaggcggatcacttgaggtcaggagttcgagactatcctggccaacatggtgaaaccccgtctctactaaaaatacaaaaattagcctggcatggtggcacacgcctgtaatcccagctactcaggaggctgaggcagaagaatcgcttgaacccgggaaagcagaggttgcggtgagccaagattgcaccactgcactcatgggtgatagagcgagacctcatcttaaaaaaaaaaaagaatcctatgaaaagaagtattttataattttttattaggaactttaattaccatggaatattttctctaatgttttaaatagacatattgttttagactagaatatataatatagaacgcacattcacattttatgttagtgctgcgcagatattagatatattggttttgaaataactcatgtaagaatttgccgagtacatttaaatttctgtgagctgatgtttacatttaattcattcttttagtttgaagaatgatgccaatttttgagaaatgaattaaatatttgtgctgtggtagggagaagagtttaaacatagaaataaacaaaagatataagagcacaaataccactgtttattattgtcattcactggttagcttaggtttaaagtaggtttttctgtttctttctttcttatttcttttttttttcagttgaggtcttgcaatgttgcccaggtttgattcaaacttctgagttcaagtgatcctcccacctcagcctcttaagtagctgggattatagtaaagtacatttttcatgggtgtttgttttgggtttgtttttttaaaaacaaatcaataagaacgatcctattttaaaaatctgttgtactggtagaagaagggagagggaactgtgactaattttatggactttagacttacgtattttcagactgatatggattatacagtaataaattacacatgcaactatttcctctttcttttttctttttttttttttttttgagacagagtcttgttctatcaccagcctggagtgcagtggtgcgatctcggctcactgcaacctctgcctcccaggttcaagtgattcttctgcgtcagcctcctgattagctgggactacaggcacatgccatcatgcccagctaatttttatatttttagttgagacggggtttcaccgtgttggccagaatggtctcgatcttttgacctcgtgatccacctgcctcagcctcccaaagtgctgggattacaggcatgagccaccacttgatctcttgacctcgtgatccggccacctcagcctcccaaagtcctgggattataggcataagctaccgcgcccagcccttgcaactattttcattggtccttccaaggagacttttttttggttggtgaatttgtgggtggggtagtaaataagcacataaagtaaattgactctcttaccaatttttaggtgtaaattacaatattgttaactatatgcacattgttgtacagtggatctctagaatttcatcttgcatgagtaaaactctgttcccagtaaacagcaactctgtttccctgcccctgacaatcaccattctagtttctagttctgctagtttgactacttcggataccttatatgaataaaacaaggcagtatttgtctttttgtgattggggttctttcacatggcttaatgtcctcaaggttcatccattttgtggcatgtgactggatttccttctttttttaagcctgaataagattctactgtgttatataccacattttctttattcatttatccattgatgtacatatagattgcttccatatcttggctgttatgaataaaatactgcaattaacatggggatgcaaatatctctttgagatcctgttttcaattcttttgggtatatacccagaagtgagattactggcttatacatggtaattctgcatttaaattttcagggaacctccatagtgtcttctatagtggatgcatcattttacaattccaccaccagtgtgcaagactttccattttcccatactctcaccaacacttactctctgggggtggttttgatagtggctgtccttaataggtgtgaggtgatatctcattgtggttttcatttgcattttcctgctgaatagtgatgttgaacatcttttccaaggagatattttgaaaagaataattatctaatactatattgcatcacagaatgccttctatagtcaagtatcataatatttatcactgaataatctagggcactaaacatgatcataggccaagaaaatgggagcggggagattctaaggtacaggaaggaggattctttgaggcagattagaagtcaataggagaatgagagaaaaccaccatggcattgacatctcctttctggacattttgcctcatttcagtcgtttctcatgtccccctaaagagtatttcttgcgctgaagctttttgctacgttagacttcctatacaggttacagggaaagaagaagtgtaatggctgtccttctatctgtagtttgggcatgggcagaatagaggcactcacttccagttctttcctcctcttattactgctgctcactctgaaatattttagttcatttcttcttacaaaatgttcaccttttgttaattactgagtcatttatccctggtaatcagtgtaggagcttgtgtttttatcctcttatcatccccatccctgagatttgtaaggtaataactccggggcaacagtaatagtgttcttcacctcagctttataggtaagaaatggagcctcttacagcttaggtgttgtcatgagtgcaaagtctgctaaaaagttgacctgcagttctggacttggagattatgattgctagtccagcttttactccagaggtgtgtttatcagcatgtcagattctggttcatattttgttaagagattttctgtgaatgtgactgtagaggatacttcacaaaattacaagaattgcagttctgcttgtaatacttattgatttaaagactctaaataccaattatcctttaacctgagaattgattttaatttgaccttttttgttgtggtaaatattcataatataaaatttaccatctttaaatgtgcagttcagtggcattaagtaaattcactttactttttttttttttttttttttttgagacacagtctcaccctgttacccaggctggagtgcagtagtgtaatcgtggctcaccgcagccccttgacttcctgggctcaagtgattctcccacctcagcctcccaagtagctaggaccacaggtgtacaacaccacatttgacttttttggtagtgttgagttctcgctatgttgcacaggttggccttgaactcctgagctgaagcagtcctcccacctcgacctcccaaagtgctgggatgattacaggcatgcaccaccacacctggccttacattcacatttttgtgtaaccatcactactgttcatcttctatgaatttgactattatagttaccttgtgtaagtagaatcatgtaatatttgcccttctgtgactggctcatttcacttagtgtaatgtccttaagctttatccatgttgtagcaattattgttccttcaattgtgtcacctgactagggataggtagtggcgagtcagaattacacaatgattttgtcagtcaggaaacccttaatgaatgccttcttcatggagctggagttgagcagtaggagagacaggccacagatcagtaaattacagtgcaaaatccatccctagagtaaggcagtaatgctgtatgccttaggaagtgatcttgcttgggcttcatggaaggtggttggtctcttgcctttcagctagaaatgaatagataaaccaggacccataatattgaactccaataatatttgatgttcattctaacagaggtacatacgtgtaccttataaataaatatacatattttatgcagtcacccctctgaatccatgggggattggttccaggacccccatggataccaaaatccttggatgcttatgtccctgatataaagtggtatagtatttgtgtataacctatgcacatcctcctgtttactttaaatcatctgtagattacttattatataatatgtaaaacaatataaatgctatatacatagttgttatagtgtattgtttagggaataatgacaaggggggaaaaagaaaagcttgttcatgtttggtacagaccatccatcttttcctgaatattttcaatctgtggttggttgaatccaccaatgcagaacccatggatacagaaggctgactgtatacattatatagaggtacgaaaaatcctgatagcgtgagtattaaagatgtttcttttagcaaattctggcctagttggctgtcaatggatgtaattagcctacagctaacagaggagtgaatagggagatggcaggatgtggcctgggaccaagaaagatctgagttctgcctccttatgatggttttcttgtcaccatactgtttgctcgttcttcttctctttattgccaaatttcttacaaaatgaaggaagttacactcctgtttactgttcagcagctaaactctggcctgtgtgcccctcactgctccctggactgtctgcagcgactcccgttgatcagaggtggcagctcttcttcccatctgcctgcctagcttctctggtagctgtctctgttgaccatccctctctacttttttttttttttttttttgagatggagtctcactctgacaacccaggctagagtgcagtggcgcaatcttggctttctgcaacctccacctcctgggttcaagcaattctcctgcctcagcctcctgagtagctgggactacaggcacccaccaccacacccaggtaattttttttgtatttttagtagagacaaggtttcatcatgttggccaggctggcctcgaactcctgacctcaggtgatcctcccacctcagcctcccaaagtgctggaattacaggcatgagccactgcacctcacccctttctacttttgagctgtaccacattcatcctcactcactggctttttttcctcatctaaaccttggccctttcttcttctcaaataaaattcgctctttaatgagttttaactattgcttgtatttgtgctgactgtcaaggtaaatctgcccttgacctttccctcatctttcattgcacagatactcggtgagtccctccccacagcccccgtcttacagtttcattgtccgtccagattgccagctaccattagacatccacaggggtgttccacaggtgccttaaattgatactctcaaaccaaacccgttttctcctctgccttctgaaaagactgcctcatccttttttctgtgctctatctcagtctgtgtaaccaccatgcgctgatcacctgttttgtccttaccgaggctagaaacctcagttccagccaccttctcttttacctcttccttccccacaatcagccaatttagtcagctctgtcagttcctcactgtattctgtgctatataacccttttttcccatgtttattttcagcactctaatttaagacatcttttctcaccttaactcatctctgcttctttaccttctataatccatccccgctgctatcaccattaactttctaaaaatacattggctgtgtaactcctgagcctccagtgagtctccctgcctgcaggacgaaggaaaatgccttcccatggtattcaaggccctttgctggctggtcccattgtactttccaggctgtctcctgctcttatctttctggccatcgtacttctaggcagacctccagccttaattactctttaactcataactgcacagcttgtgtgccacttttagatcaaatgtatacatcattttggcttgtagtgtagtttaaactgaaaacaacaacaacaaaacacaaaaaactccctattaccattaccacgacagctcttttgtggaggaaccttatcttaataatttttatacccttttacctgtcttgtacataagagatacttaataagcatttatacaaaatgaacaaaaagccagatgccattactcacacctgttattccaacactttgggaggccaaggcaggaggatctcttgaggccaggagtttgagaccagcctgggcaacgtagtgagatcctgtccctacaaaaaataaaaaaaaattaaatgggcatggtggtgtgtgcctgtagttctagctactcaagaggctgagctgggaggatcacttgagccaatgcactctagcctgggtgacagagaaaagccttgtctttaaaaaaaaaaaaaaacttttagagaaaatgtgaaagcagcaagaaatccaaggttttcttcagatgctttaagaaggtatgaatagaataatgaagaaaaagaacacatttaaggactttcattaactgctgtgtcagtttaaaataaattccaatgatatggtctggaaatgaccaaatgaccagggaatatgccataattatatttaaacatggtgatttcttattaattcatacttacgttcaggacacattggccagatatcttctatgttcaaacactgtgctagccatcaggaatataaagacctgtaaagcactgtccctgtcgttgtggggctctcaggctgtgcagacaacaaagaaatcgttaaagcttttttagaatagctgctcctcagcatatgtccctcaccctccctgacgtagggacccaccctcaagggaggccagtgggggtccagcttggcctgtgcctgcatttagtaggtaataaagctgatacctggatctaagaaaaagaagaagtaataatagcaaattagtaagtactatgattgattgattgataggttgatgtagatatatagtgatataaaggaaagtgggataagagaaggtaggaagtaaaacgttttttgatctccgggagtatattgaagttcaccatatgggtaatgtttaaataaagtctaatactaagaatcaaaattccttgtatccagggctacttaactatacttttttctttagcagcgttaagagaatgtcatgtaaatgcattcatacatactgttttcagctacctcatcccatttagacgcctactgcattctacactctgtccatagaatagatctgtgagactgcctcaggattggaattattgcctatgtttcatagataaggaaactgatacacaaaaacagtagtaaggttgaggccttaaaactagtcagtgacaaactagaacccaaagcgcagtctggttattctgcagcctgtgatctttcacctccgcattccattacctacctgagaatggttgtcatgtcttcaactttgcctttgtttattaagacagaaaatgttgttccacagagaaattccaaaagcaacacattcaaaataaaaataaagatttgtaatagttattgctgtgtctttagagatagttttttagaggtagttttaacacatattgttcagaaaagagattttgataatttgagttagatgtggtttcattaaaaaccttaaatcttatgtaggctgtagtcaaggcctctgaggcattataggttaaggaagcactatagcaaacagcacctttaggtcataactgtctctaatccagggtcctgtatgttctgcacatctaagcatttctaaccaggctttcatcgccgatgtatatccatcataggtgaagagaaaaaaggaaaggttattttttatttttatttttatttttttgagacacagtctagccctgttgcccaggctggagtgcaatggtgtgatctcagctcactgcagcctccgcctcccaggttcaagtgattctcgtgcctcagcctcccaagtagctgagattacagacgtgcaccactatgcccagctaatttttgtatctttagtggagacggggtttcaccatgttgtccaggctggtctcgaactcctgacctcgtgatctgcctgccttggcctcccaacatgctgggattacaggcgtgagccaccgtgcccagccaggaaaggttattattcttcttcctcctccagatgcgagaattcctcatggccatgaacactatctgaatactgctgctctgtattcagagcactcatgcctttctgttgtcttaaaaggaacataaaatatggggttcaatgaatgatgtcccctataatgctgttccttctgggccactcttctcacaggtggctgtagtttggcgtggtgtggagcacaagaagatgtgaccacacggtgtttggggtgggaatgaattggtctcttaaaggaatgtggtgaagcagctattgggaagaaagttgtaagcggtgtagcaggatgcaatggaacgtgggatttctgtagccaccggggatcatcagatgaaacagtgattcctgtatgaccatttatatttaagggacttgtaaatatcaagaactttggtctaacaatctgcttgtaaagataaaatatagaacataagatgtaattaatattacaagccaaaagccagatgaatgacataaaaataattaagtgaaaattttatattgtacattttcagaggcagaattccctctaggctgacaaagcttaagcttcaggaccccttacttgtatgggtcctatatgtgccaggagctatagagtgttctagataggaccccacgtttcaatcaggaagcacttcttcagaagcatttcagattattatctacagagttctcagaagaagaaatttgaatcttgttcatcactctagtgtttacagctcttttctcattctatgtaaatattcacttttatactcaattttttactcttaaagagacacccttccctgtaattaagctccaggccctacaaaatgcagatccatccttatgtactagcaaagtctgtcacatatactctgtcaaaagcaaaagggtcagctactacagtgaaatgagaattcacacatacagagtgctgacttggtgccaggcactgctctttcatacgtcatctcatttcagccttgcaacactccctgtaggtaagttgagttattatctccattttacagaagaagaacctaggtttgggtctagactccagacttctctagagtcacacagctaataagtggtaggactagcattgaagtctagatctctacctagctccacatccactgtctcccagtgaagtggaaagacaattaaacctgttacccagctgtttactcttggctttgtctgccatttggaagaaggttgttaggagtcaattgggtaagcatggtatcagctgttatttgaaacacagagacaccgagttttagtttactaggaagaatattttttgcagatccctatttcagaagatgatgcacactttcaaggcaggtcagcttttcctgtcagggaaaaaaaaaaaaaaaaaaaagaagataaaagagcccagaaaaacagaaagttgctctctagaccaaaaaagacttcttggtatttagccagaatattggataccaggcttgttttagaacattcattttgtacccctatgtgagcagatgaggaatttttctgtcagagtgaatgttctgttgtccatcataagatctgtccatcttcacttgtgcgatgtaacctctagataaacaacactggccttgttaaggtgttctctcccattttgggaagtatgttgggagcaaaacagactttgcagatagtcactgtgaccaccccagtattcattacatcattgatcaaaaatgaaggaatgtaatctgagggccaagagtgcttagctatatacaagaccgtatgcagtgtgttttaacttgtgttctggaaaagaatgtaaaatctgaacttccacctagaaaatgaatttattagatttcaaatatttacacttaaaattttagatatgaaattgcatctttgcctatgtttctcatttctgttgttttgtacaaaaggaaaccccaattcaacatagtcacatagaaaaaatacacagcagagaaaagttgttcatttaaaacggacttggattctgctcttccagtgttagaaccttgatatctgtaatagatttagagtccagttggagctgtcttttttggaaataagaaattttgtctgaggaagaagagtaaaataaataatgccaatatcagcgtggtgctgcttcccgtacattcatcactgagatgcctttccactgccagttaacaccagatagcaaacattacagaactctgaggtcgttttggggagcctgtatcctctatttctttaggcccgaagtggttctcagagcagtggtgatttcttatttaagcctgtctacattagatgggcatgcgcataccaccattctgtaagattccaagtggtgtattcattttgttacatctgatgggaggaaacagaagaggaaaagaagcaagctcttttgggattgacatgattaaactcaacttcttaaaagcttttttcctctggtagaccatcttcaatttgtagatcctttatgtcagatgaggggaaaaaattacacatagtacattttatttggaatattgttagatagctgaattgtcaaagatcagaagttgttacatatttttgtctcttagataatatggaagtatataccttgtgtgattgcatttgggagtcttttttttccctcacttccatgctttcttaagaaagaaagagaccttttaacctttaaaccttttctttttctgagatttaactataagttaattgttcagaatggagggtattttctatcaaaccaatgcaaattttggtgattagattattggaccagctccataaggcctattgttatcaatattgcatctaacgagagaagttcttaatctatgtggtgcatatagctctgatggtgtaatgatagatagttcttttagaagcattactgaacttactgtaacctgttcttcatgttatatatcattttcaagtatgatattgtcctatgggtctccatttttttttttttttttttttttaatagagtctcgctctgtcgcccaggctggagtgcagtggtgcaatctcggctcactgcaacctctgcctcccaggttcaagcaattctcctgcctcagcctcctgagtagctgggattacagacatgcgccaccatgcccggctaattttcgtatttttagtagtgatgagttttcaccatgttggtcaggctggtctcgaactcctgagctcgtgatctgcccgcctccgcctcccaaagtgctgggattacaggcatgagccaccgttcttggccaggtctccatttttattgatgttaaaaagagccctcttaccccaaaaggtgggaaccactgacccaatgtttattacaaggagggatactatagaggctaattgatcaacacatccatatatttcctgggaagatctgttctggatttccagagaagcctggagcatggttgcctcttccttcctttctgccctggtagtgtcctggctcctccctttgcaggcctccactgccatgaaataccaggcaagactcttaggagcagaggggcaggcccgtgggtggtggggttgtccagtcacaggtgtatgcacaggctggaagccaggagctactaagggctcaggctagcacagtaactcttctaagactctggcaaagttccttcctttactttataagtcacctgcttcccattctgctgtcttcctctagccatcagtttatttcttttttttcccctcctctggtccgctgtagcacaaaattcaggtttttatgtacagttgtccctgaagcaaatgctcaactctttggggagtaaggattgttactgtaataacaaagtaaaataagggaaaagtcacaaactttcagcaaatcttaaaaactcctactaaatggtattccacgtacagatacaattggaaatgtattctttgaaatacatgtaaagcttggtttcaactctcccatgttgtcttcagtcttttattttttgtttttatttttatttttgttttttgagacggattctcactctctcgcccaggctggagtgcagtggcacgatctcagctcactgcagcctctgcctcccaggttcaagcggttctcctgcctcagcctccccaagtaactgggattacaggcgccttccaccatggccagctaatttttgtatttttagtagagatggggtttcgccatgttggccaggctggtctcaaactcctgagctcaggtgatccacccacttcggcctcccaaagttctgggattacaggcatgagccaccgtccctggccttttcagtctttagaaacccctcagtttatctcttttaatctcacaggagattctcatgggtctctctcacttctataaaaacatatcccatttgtgtatgtctctttctccctctccctccctctctcttcctccctctctcttcctccttttcttagagacaaaggccactgtataggtaaatgatgagtcttttattacatgaagaattaatgtaaggttcatctcttcagaggaaaactcagtctaattttctaggagctccctatgccagaggatattctaagtggggggactaggaaatgtgggtgaggctatgtgtgcagcttgaggagtggatagaaatccaccctgtctgtcttttgactggcattatttcagtactgaagtgattgtacattacctggctaaccaggtggacatttgagtttttgtttactacttcagtggcttcaaattgatagaagttttatctttgatttctgtctattcattatagtagtcactcagaattgtaagaatatactctctgcccattccttgcctataggacacaataaggctattttcatatttttttaaagcacacaaatgatgaacaatttaactttttttgaaatgacccttggagtgagagtgggagaagtcattcatgatgaagctgaaagtttatggacctggtatcagtgtttgtaaagacctgcagtatcagatattcttgtgtcaaagtcatgtacctaccagcttctcaattagttttcttgctgttaggtccactgcttttagctcccttaccaaagtatcctccacaaatgatccttgatttttagactcccattcccctgatttttctcatttataatgtagtcatttgaagttcatcttcttccaactttcttttactttactttttttttggagacagagtctcactccatcgcccaggtgatctcagcttactgcaacctctgcctcctgggttcaagtaattctcctgcttcaccctcccaagtagctgggattacagacgtctaccaccacgcccagctaaattttttttgtatttttagtagagacagggttttgccatgttggccaggctggtctcgaactcctgacctcaggggatccacccgcctcagcctcccaaagttctggaattacaggcatgagccatcacaccaggccttactttccttcttataaatagtttattatagtaattcgtctgaagagcccctgaggtactttcatatactctactaaaccctctctgtttttggaaatcaaggttttaattgagctcccaatccatattcggatacgtgagagcaaagatctaaacaccaatgagttttatttagttccattcctgacttagtgactcatagtttctttagaaaggacagatagtataactcctctttgtatagatgcttttgtagttccatgattgtaggtttttctctaagtctaccacttaactgggtttagttttgaaaaattaacagatttctttttattcctgcagggtatgttcttagcctgaatttttgagatttgtaagtctaatttccttggcaattggatttatcctgagaggataatataagagattattaatcttcacatttttattttccaaaaatttttttgagctgttatacttcagagaactaattaggccctgttagcatcctgaggtgtatgtattgttcctggtgtgttgatggaagtttattttgagttaagtaatcagctttgctatgttcattctctgatgaaagcattcttagtgaaaatcttagataattagagtctttctttattcagcatccagatcaatgctgtttcctatactctccaaacaagtggagtcttctagctaaataaagaaaaacctttttaatacttatgaattcacaaatttcaaatttaatttttcttttgttcataaatccctaacactttaatcacgataatccactaaccccatttcagcacttggcttaaccgtggcagtgcaccctaaaccctataagaggcagagcttgtctttttcatctttgcatttccaccatctaatatcatgtatttttaaaaaagaaaacataaactactacttctctaaaacaaaattacaaatgaaaattagagagtaaaattcctcgtcccatgtgcttgaagttgctgctgtacagcctgttcagcccacttgagggaaacagtgttttctccagagtgtgggtcacttgggtctacatggtgtctacatgggtcagcagttgcatggtgaatagagatacacagatgaaaaatggaatttctggctcagagactggacaatcttgagggagttctgagatctagatcaaataagacgatttatatgatacagtaaatgatattatggacatgttgtggaagcacagagggtaaacagcttggatcccctgaaattctgagatttccttgagaaaatggcatctgctgaaccaagaaggcccgtcactatccagtaaattcagtggcacctaagagcctagcaatgccacttcaacctggccagctctggtagagagacaccccaaatgaagtggaatttaatgcatcgtgttcctttggctgggcgtgtctggaggaaaaagaaataggcatttcccatccataagacaaatgctgttggcaaaaaaggaagaaagaaagaaaagaagagaaagaaaatccagcattattttaatttgttaaaaagaaacaatgtacatttggtatagtattcatgttttattctactgagagttaaatcagttttatcattgataactgaagaaattttattactgttaatactgactttgatttaaaatttattagtaagaaagccatagaaatataactaaatttaattcataacagcaatgtcacaaaataattttaataaaatatacttttctttcttgtaagtttctgattccatttctattctctcacaaagcaatataatctttctgtttagtagaaacttgtctatttcttttcattttgacttagccttatgaagtctgttcattccacttttcagactgaaatgatttcaggttttttttgttgtacaattaaattatttaagctagtttttatttgtaatttgtgaacaggtctattagatttttgccattgtaagactgcttgtcattataaatgcagaataatattattacttcctgcctttcttctgtagagctcagagtgcttcacatgcattattttattaagtctcataacatccctgtgaagcagggcattttgcaagtgattatttattgctttgctgaatcagcatagccttacggcattacgataagcttggaaaagattgaggtcgtgtactaacttgctctcaggaaaccctatatgcagccaaatattttccttggcaatacagagctgacaaactgccaccattccattctctgggaagcccactgtccgttgatgtaatttaaaaacaacacacaatgcgtttttgaaaaagcaaatctaagacagtattcagtttatttgagaagcaggtgaattacatatgaaatgagtacaccatcatcctcgtgtccaggctatcagtctacaaaaaaaaggctaccttctgttcttgctatggctctgaaaactggacctgcccagctgtcacatcagtcatcttcagcctcacctgtaagccatcacctggcaggcaggatttccaaaaacaggtttcttggattcaacccatgcatctgcattgaagctaagcttattgtttcaaactgccactgggggaaaaatgccattgggtagaacttttctgaagtcttatgatagtgtattactaaattagttagcatctagaagcttatgtaggataattaaattgaaagaagaagaaattttatgaggattttattttatttcattatttgaatggttgtagaatggtggggaagcatctcttgtggttaatatatgtaaaacaaaactaattttaaggtaatttaaaccagttaatttgatagggagtaacttaattaccatgtctttttcatatttataattagatactgaattgtgatatgttctatggcctatatggatgatcataattaattttctgagagtttttcgtttttgacttatccatccatagccatggtgctcacagtctgtatatctgtctgttgtggctcaaacttttccataacatctactggaaaattgttagactttaaatagacatttgttctgatttcttgcaagtggatttgattgcttaaacagtccttgtatttgagagcacgtaaccgatataaaatctcagggaattactaaattactgaggatattaccattttttcccctcaggttacaaaatttgctgcagaattaaataaaataagaaaaggagaggatttggttatagaaaggttagtctggataccaaatttaggaaacattgtaaatgttggttggcctttgttaatgtcactttgacctcagcatgcaaattgtaaccacctctctttcacacttgtgctgggctttgcagcatggaagtgccagccatttctaaggccctcactgcttctcctgctgcctggttgaggcatgtcaatttctgagtgatgccagtccttgtattctttttaattgcctactgctttaaatagttgtggaaggttggttgatgattcactgccatgcctgcttaaattggagagaatttatgctgtaaggtatttaaagggtcattttaaagatgtatttaaagctcttcctgttgtcattatgaaatgcagtaattattgaatggatatttgacaggacctctttttctagaatgtcctttgaatttaggtgttaataaagatgttaataaagaaaattcacatttttacaaattaggaagatctactttggaattattttccaaatgcttcctagtctttcttctcacctactgttttacctgatctcttactctcaatacagtgagcatgttacacaataagacatactgtaaatttgtctgtaaatacatatcaggtttatttgttacatatgcaaaccttgcttttaaaaattttgtagtagcatatttttgatcttcagaacaaatcaggtcctttattttaccagactttacttcgcagaatttacctgtcccaggtaacagctctcttctggaagagggccctgatgatcttagtgcagaagatgaatacttcataacagctttgtccctcgcagcaccttgccctctgcagtcagccctgatctgaggggccttggtagtgccgagttcataaggactgggaccattctgagattagctggtcaggggaggaaagtgaggagggaggacatacactttgtatgtaaaaatgtgaattcaaaattaagctgtttcaagcatttgaacagaatctgtttctatatgatataaatattattctttatgtagttttccccacagaagttctgttaggaagaacatagaccttctaatggttagaaagtccctgggttgtgaactgagacccaggattataaactttttacaccatcctttcttgacatcctggaggataaatctgggctcctttccccaagatgggtttctctggagaaagagagagagagagtgagagagtgtgtatgtatttaggtttattatttgtatgtgcgttttcattgttaggtggccgcattcctatacgtagtttctaataggttaaaaaaaaaaatcctgtgaaccaggtagaaaataaacatacatgtagagaaggactaatgacacaacaaataatggcagttggagaatcacaagaaatggtaaactctgcctgtagtaactgctcaaattgccaaaaaaatacttgagactagacagacctattctcatatacccacttattttcctccctaaatgttcacttagaaattacctagtttttgtcttagcagtcagctttccagagagttgatttgactgaagcaaattcttggctactagagatctttgcctgtgggagatttgagtggtgtcagattgtaaacttttctggagcctgcctctggagttgttccacctccacgccaccccaccacgtgccccatgaccctgtccacagagagcttgcgccctggccacaagcagcctgcactcgccttacagttacttcctttgttctcatggtctttcttgttttgctccctggagtctgctgtcctctcagccccattctccctgtgccttcattgcttggccagagccatggtgctgcgtatatttatgcagagttctcccattgttaacactgctttgctttctctgctacaatgatatgatttagcataatgttttaggctctaaattggatgattctgtgttctattatcagctttttgcattaggtactttaaattaggaacacctgctttttgaaaaaccacactggtgaggtcctcccatgattgctcaagcaaatgctagaatgagagaactgggaatagacggtagtaagcaaaatgaaaccgggaatttcaacctccctatgatattgttagaatcacagtaggggaaaggagaagagtctacatatgatgagttgtagcagtctctttagaatgacatcagatcctgtgtctgtagagagaaactggaaggaaaagataaccagatgggagaaaaacacaaggagagaaatgcaagcaggtctgagaagtggaacaaaatgcattggggagcaagatgtcagtgaaaaggaagtgaggagcagggaggattcctaggcatggaagatatggccccagaagacaaatgaaggtcaggtactaggatggttttcagtcctttcgaagccttgagagacacccctccagatagccaccattaaggtgaagcagcggcctgggagtgaagccttgcaagcttcatagaaatgagggttggtggcagagccagaaagaagagacagcacaaagtaaccagccccccttcctttccttcatccttccctctgtctttctctacacgtttattggccatctttagggcgttcagctttattttagtcattggatattcaaagttgaataagacaggaagaaccttggcagcctctccagggattttagcccttcggccaatcccactttataaagccacctataaagcgctgctttataggtggctttcctctatcagctgttaaccttatccttagaatccaaggcttctcgcagcactctgcgtgggagggacaagaaacctgatgaagtgctcttttatcctggctccccaggcaaatgtgacaatttgtacaacctccacttgggtaggtttattttcttaagagctgtgagtggctgggaaaatcccaaggactgaaaaaaatgtctgtgttacccagatcactttttttgtaaagtaggttgtaacttcctagatgagaatctggactagtaaagtaggctggttggggtttttaaacttcgtggctcaggtgtagagaaagccttggtgacttttcttccaaatcctcttctcattggcctgaccacctgagctattattcttgatgcccttagcaaatacggtctgaccttttttctcatcccatctctacctaatactttgactccaaaaataaaaaatcagagtcttaaaatgaacctccactatgttaggtatatggtaaagctcttccaaacagatacctctgaagagacatttgtgatatttcagccctggctaaatggaatttaattttagctccagctgtgaaactgtattcacagctgtgaatactgtgttcagtattaacacaacatcattgagcgcccactatgtgccaggcagcaaataaaaagtcatttcttacagccaaggagccagcaatgtagtgaaaagggacagacatgaaaatagatcatttcaaaatggtgaggggaatgttaagatggggatgggcatagggcatcacagaagcacggcggcaggggcctaacttcgttgacatgagctttctggagctgtggtggcatcttccaagagaaggggtggaagggcatctgtgccaatggaacaatctgagagaatgctcaaaatcttgaaagaatgtgatgcatttggggggagacagatactaaatattgctatggtgtataagctaggaataatgggagatgaggtttactgcgctaataaacagaattgtgatttaggagattttaaaagttgcacaactaagaccaaagtcttagaattttataaacaactttttaaatataattttcatattttaagctatttatcagaaactttattaagtactcctacagtgtaactttgttggccttgcttttgagttgacattcatatttggaagaaatagaacttttttataatttggtcttttgacaggcttactcataatcttctgaataagtgatgacttcgagcctcacctcacttctcatttctttcacacccattgattttttttccttctttcatctaatctcaatttcacctttcaactttctaagcaaattatgattcctttatttccttgttcaggtaacttccaaaacttcagtgagtggagcccaataaattagaatttactctgaaatagcagtttttatattttattttgccttcacctctcagtactccattgctgtggaagatacaaatagagatgcaccattatcatatcagggaatgaatgaatgctgccataataaatgtagtaatatgtataatatttaatacttgttggctttcagttcactaacttgaagcacttctgaagccatgtttccatgggttctttcagtgtctacattgtttattgtgtgcctaagtattttttttcttctgcagttgatctttaaatttaagctcctataggacatgaactgtgaggtgcaggaatttggattatataaaaggaagattttggacaaattgttattcactgacatggcttatcatgaaagattttccactgcccattttacctttcagtaaattcaatactgataggtactatatgaagtgggctattacatagtaatatgtatgggcaatagcagagggaatgatagtgaattcccatgaacaaaagcattttctattaaagtctattctgtctatactcaaagcctaaatattctgtctaatactcaaagtctattctggttgctgtcctttctcttggtaactgtagtacattaattttaaaagtaggcctgtgtatttcaaacttgagacatgatttttgtttctacttaagtagtcatgccttataccattgatgaaaatgaagccaaatatgttgctttctctaaagcagagagtaagagggttttgctgggtggagatggccttcagattggttaattttgctatttcttcatgctgaagggaaatcatgatgttaagaagctcaatgtcagaaaaagagggaggcaacttgcggcttaggttcctcccactactaaagaaagtgcagctgcgcgcttttaatatgcacggcaggagacttcagcagcttgatgatatatagtgcattaatgttgaaaagataaacacatttggagagcacaggaagggccttgtgtttttatgttagcagaatgcttcctaatgaataagaatgtgctgctggcttcacaaagccatatggcagcttttctaattttagttgggtgcagatgcataattctctcattttaccttctagaaccttggagatgctacataacttttcctgtaatatttcatctatagtgcttggtcagaaactgcccatcattgtttcagtgacttctttgctctgcgtaggtctcactgctgctgggtttgacagtcacttcacctgaaacatccagttccttaatgcaggaaaacatagaaattgtggatgttttcccattagaatcttcaaatttgttgtggaggtaattagacttgtgtttgacgtcagtctactgaaaaattcgtagatttctaggtgagtgattttactcactttgaagcagaggaattaattataaaacctacacaaagtatcagattccattttagtcagagattctatctaatttaaataatacagcttctgtaaaaacaactctcctcaggcttgaccaaacagaaagataacctaaattcttaattgtctttacacatcagggatctgtaaacatgggcagtcttaaaatgtctctatatatgtgtacataccctgtggattatctctcagtagatgcattattacagagtgagtgacattgtttggattctgactttttgaagatagactaatttctgcgcgttttctacaacctcttcagatgatccccaaaaaaggaaaaagcaagagtatcaacttctaccataatgacagtgtcaccctgtccctataatgggagacatttaatagcatttaggtttctaagtaatcagtagtggttgccactgctgctgctggagttagaacaattacgtggctgtcccttgagcatgactgccaccccagtgaagggatagaactctgttctggtaatgctttgtggaaagactctctgaatttgtaatctcagttcagttgcctaataaaaaattgattaagagtacctaatactatgagattaagtaagctaccaaaattaataaatgatacttcagaagattatgtaaaggcctttttttaaaacatcacttgataatttaaaaatgtttaattgtacttttttaaaaataaattttttgctaggatcagtttctaatttattgttctcaccagaagactggaattttactttcagtttatgcatggagctgagcatggtggcatttgccaataatctcagcaacttaggaggctgagtcaggaggattgcttaagaccaagagttcaaggctgtagtgtgtgatgatcacacctgtgaatagccactgcactccagcctggtgacatagtgggatgctgtctctaaaaataaacaaataaataaataacagatttatgcctgtacatgccaatgagcaatttaatacagctgcttcaaaaaataaatattttttccttgtattttcaaatcacttatatttctaggatcagattcttccctgttcaccttttcttttgttctaagagaaagcacgaataataattacttataaaaaaacctatggaatataatattaatgatttttccccagtttgtggtatgactcatcttaacatggtccctgaagagatggggttttgttcttcgctttgaaagtggaaatctaattaattggtgttggatttctggagcgcgggcaaatggagaaggagattgtgagggattgctgttcaagcagccacccaggaggaaaaggcgagtcagagaaaaattatagaggcatccttggatgatctctccaatcaggttttgcatttgtaaaactgggcgctattaaaaagatcatagctacttcctactgatcagatctaaaaagatcagagatattttatgatttctttaagtcttttgtgagtgaggaagacaaggatagaattagtattttcattgttactttcttaggtcgtggtctttatctaaaaagaaaaactgtggggattgggcatggtggttcatgcctgtaatcccagcactttgggaggccaaggcgagaagattgcttgagcccaggagttcaagaccagcctgggcaacagagtgaaaccctgtctctacaaaaacaaaaacaaaaatttaataaaataaaaagaataactttaatggtaaaagcgtagcaggaagaaataatgaagtcagggcttagaagaaatattctagtagtctctgaaaatttgattttatcatctctttctctgatttaaaaagatttccatctgtaataatgagatttcataaggttttgatcatatgaaactctgagacgagctttctactgttgagtttactgaaggatatttttgtaacagaatatatttttatggttaatggatgcaaaagatagaaaagtaaatatagtttgtgaccgctgagaaaactgccttatttaaaaatatttaatagtgtgttttagtgtagtaatgctgtacttacagaagtataaatatctaaggatttaagcttatttatatctggtacataaaaatagcatactcattactgaaatgctctgtcaagataccagtatatgtccggttaacataatagtatctctctaaagagtccttttctttttcctcctcccttcctcccttcttttcctcctccggtataatatcaaggctcaactgaacattcaacagaggtagtaattacttcatgaaaagtacccaaataacataaatttagggccactttaatttagattccgattacattggtaaagccatatttctgagtgttttctatcacttcatattattgatttttttctttttaatattgagaaatggtcaaagcacaaattcaatacagaattaaagaatagatgacaaattagctagaaaatacatatgtttcattcttgtgagaataagagtaagctctgaattcttcacccttttttcttttattaatgaggaataaaaatttctcattctcttaatatatataaatagcatttgtgtaaatattgcaacactttttaaagcttctcttgcaattaacctatagagtcatttggaattttctttcaaatcacaatttccactaatataagtttagattgatcttgtgaacaactttgttgttttattttctgtctgagtttgctagagttccagcttagatcaatgtttcgccagtgttccttaccatgggctttcaaaccaggctgagattttgtagtggcccgatgccagccacacatccgtctccacctgttttcttgctgtccacttgcatatcctgcagaatccaattcggttacaacaaatgtgaaatactttcagctatgtccagccatttccatccctttttttgaactgagggcttgctgtttagccctatgttgtgctcatttggttgggttgtatacttttgccctcctggacagagggtgagccctcggcagacgaggatttttcactttgcttcccctgcacagacagtgcaggccacagaccagacacacagacataggctactctgcccatcccagtgtcactgttccattccctcatgtgggctcacataggccactcattctccattactggtgttagctactgctttcttcctcttaaatatttatcagttgactattttaaagaataaaacagcatgttttgcatttataagtaatgtttcagggtaataattatttttatccaggctttcctccagttgttcctcaaacacatgttttgtgagatccaaatcatctcccaatttaaattgtaggcccttaccccaaattatatctgataaattcctaaaaataaaatactgtacatatttgatcctgattctacataacctctgacaaaagtctaaaattctttgcctgagcacattgctagaatttagaatacccaggcatgaagacttagcagtgttgaggaacctgcctgattgagttatctaagtgtaaggtttttgtatcacacagaatgttgatggctgaatttagatcctcagaaagattatcataccctgataatataaacatctcacaaggcctacttattgtctttaaaaggcctagaaatgggttactatcacaaacatcattattttgtatttattttgcccaaaaatgcaacattagtatagataccataggaaacaataattcattactattgtgatatcagaatctcatgtgccaaataggctgatgttttctagtgatcagcgataggcacagggttgcctttgtgattgggcagctgttgtttcctctcactctctcccgcaacattaacctaaattaaattcattcttaaaaagaataaaataggacttggatcctgagagaataataggacttgggatcctgagagaatatgagatgccttgaaacttcttgactatagcaagataagattgttatttaagaccagtttttaggaaaccctttcccatattacttgaccctgtccacctattctatcttcctcctctaccctggaggtcctgtgaggcaaaaggggaaaattactttatctttccacacaccctcgatcccacttgctcccatgcttctgggaggaagtgctggtggtgggtctagcctttcagtcagcccccatagatgcagtgaaaacctggtctgaaataggggcggtgctattgaggatccagacacagttcaaaaagcttaccttcaagtcgggtagcctactcttttgtggactgtgtgtcacactgtaggaggcaggagaatggggatatcctcctaggaagatgtatcagaatctcagcaaagcagacctttcaagctgtctgtgtgttcccactgcacattctgatagacccccctccagggaggttgtcttctcatgtttaccattgcattttgagaatcactgctgctactgaaagatgggagaatgtgacccctgatgcgacccctgtgaatagttaggcgaaggaaaggctgcagatcagtcagtctgtgggatgtcagcacattgctcctgcatgtggactgctgcaacactgaagacaataaagaagtaagaatgcagtaggaccacataaattatgacatgttttatatgggccttgagatttagtattcatgaaacatagggatccttaggtctgaggcacactggggcctctacaacaaggactgttaagggaggtacacaccctgtccacatccaagaagaccccacagagtgtggtgtggatggaggtgctcaaggaaaatccagcatagctactgtagcaagatggcccttgaaaattagatgaagcagcaggtagcagtacaaatcctattcctgtactggtgggtagaaaagtgagcagatcttgaggagaaatcaacattcttagagagtgaactgccaaaaaaattaaaaagtatgccccagtgcacatttattttactgtgagtctatttggcaatgaaaaagattccagtaaaagggggtgggggcggtcacatgcaataattggccaagccaatcctgtggctggagaccctgaggtatttgccgcctcagaagggaccggctgaggaattggaatgagaccaagcctgcagacagaacaaatgtacaggacccagcagtgaggagcttgggaaggcagcaaagccagaaatgaagcaaggactgacaaatccaccaatattgagttatgaaggctaccagacaagtcatatctctatttataggcagtcacaattttttcaatctaaagaggtgaatcaggaatatattagagagttgataaagcagatacagtctgcttatgataagctctgcagagaaattactacatttggaactcaaggaagaactaatcaatacagatatgctagtattaagatacatttgtaaacttctttgtatttttaaagagtgtttcacataccatcccatttactttggctcagtccatgatatacgggagacaggtaaattgaagcaacttgcttgaagtcatacttcttagtgactgagtttgagcttgaactgcacaggtcatcctcccctctgtgaaagctttgtcatgggaatggcaagattgggaggacccacatcattcctaattgttttctaggttctcagccataaattaggctttacagattttcaacatactgtataaaatatttttgacaaaaaaaaaaaaattattaaggttctgaaagcaggttaattctgagtgctaaattgatttacagttttctatttctacgtttaattacaacgataacatgcagtgtaaacaggatataatttattcaagtacaaataattgtcacgttgttttgtgttgttttctagcaagttgttgatatgtatgtgttatgctgtaaactttttttggtgttcttgaaataactactttaccacatacgttgataagtgtgcatctttttcttctgtgagctttttcacaaaacattctcattctatgaagaaatgtcttccggggccttcctgtcttcatgagcctaaaatttgccttgcacgtttccatccaggagcgcacgctacgcgcctttctgctagatcagagggcagccattgaaattccccaagtgcctggtagggtgcttctaacctcttagatggagaagcactttgaacaagtcagggaccaaatcttcctgtccactttaaatgggaatgtaagcagaagtggaacagtaaaagagtccaggcagacattgcagaatgtctcatgggggcagccatagcagtttaggagtccttgttacttcttcaaatgtgtgcaaatctatctgtgattatgctaccaaattctgaacaacagaccttcctttatcctagtttggggaatctcctgagtagaaattaattgtgccatagaatatagcagtttcataatctagaaaaaaatgcctgttggggactgtcatgaaacctcaaaattcattttctgggcagcctgaaagtggatccaagccacaggttctagaggtgaaaagttaatgttctggcttctgcttccagcagtttctcccatttaggggcaacagggatgtactgtaactcttttgtagctgcatctgatcccactagagatttttaaaaatcattacagtaaaaacatttctgtgtcactctgtccttgaaatagcactgccatttaattcacacttatgtttattgcagagaaagcagcagctgccaacatagatgaagtgcagaagtcagatgtatcctctacagggcagggtgtcatcgacaaggatgcgctggggcctatgatgcttgaggtagcacatcttcattttagtgctgtattttaaaatcttgttgatcttcacattattacatttaatttcaggtgaatataatttaaggagaatccacactagtactagtactatggacctcttgagcttgctgatatgcctgtgtgtctctatgtatgttttggctcctgctgccagtatatgtgtgtttgaaattaacatagaattaaattaactagattagagtagacattgacaagttgtaattgccagttgagcatttatttgagaaactgtattcacaagtcctactaaattctgtgttgtattttagcttgaaatgttctcaaaattcttaaattttgtacatgccatgtacaaatgcctatacatacaggttaaaatatgaggaccaaggaggagctttatgctttctatttatgctatttgaaactagcttatttatctcataaggaagaaaactgaaataataggcaaaaggaacttttaagagaagcataaggttggtcttaactacctgttgtttattaacttcaggaagctttatgaccagctaatgtctacagtttgtaaagtacagtttttctattttattaactagtactaaacgccaagtgctttgctgtacctgttccaaaattaaaattcaagatgtaggttatggtaagatgagaaaaaaaaatgtcagtgaatatataacaagaaacagaggaaccctgagacataaattatgtcagttctcaggataatttgctcggctgatgatacgatgaggttgaaaagactgcatggccagaagctttgcagcactgccattgtagaatcagctagcttgctgcagcagacaataattagtatttttaaaacagagataaccaatagtcccccttatctcttttttttcagttgatgcttaaagggatttttatttttagaaaatctaattctatgaaaatctaccataaaattgggggcagggcggagggggggcacacaataaagactccaagagcatctgacccagtctttgtatttagaaatgacaaacttcatttcctggggctggacctgctggccaaaaggctttaaatgtcccagtgttggcccttgcttatctcctctagaatcactggcttgaaaacattcagcctccctttccaggagaaaagcaaaaacacacttaacccaattttccatagtcaacaaggcaatggaaggccagagagtgctacttctctctgggttcttagaagcagattatgaaaactataactaggtggaccatttagaattaaatgaaagaaactggataatttcctttggaaaatgtttgaattacaaattaaaaactgatttgaaaattatgttaactaaattattacaattgggaaatttccctatacatgtgtttattcattgtatcttggggtggggggaacattagagtggcaactcctgggaagacttttgatacttctaaatagaaatgctgggaataacagagctgggactcaagccctttgagactgagttcattaattgtagaaatcagattgctagatgtcagtagacctgatgtcataaaatcaaaccaacatttttgtcattcagaatagtcttctgagaatttagtgcattgatcaagaacctgtgtagcaggacttgagtgttaaatgtgttagagaggttattcttaaatctggtgacttatggtttgaatttaaatttttgtccctgtttacgtgtaatcacttaaacagagagaacatgttctcatggagctgttcctaggcatagatgcacactcatgcttacatcatagcatagtggttgctaggcaacaaaaccaaatgtcagcttttttcatcagagcatatcatagtgagccttaaaaaaaacacagctttatgagaggaaacaatttcgtctttcagttttattatacctcaagtcagtctttttactgtggtataagcagtaggaagcaacatgtacttttaaaaatgaaccataggtaatatgattatgaaaatccctatcaaagggtgtatccaaagcagtgagttgaaaagggacactgggcatgtaacttatcacctaacctcctgagtgcacacacttgcacacagttctcaaggttagtaccatgtattatgaaaggctatttatttacatatagtcttgctttgtcctgcatgtggttcatacaattgagaaaacctgatagaatgttttaagaaaaacttaaaaaccaaatgggtgaacctttctctggtgccttatggtcagttctaatttgagagagcacttagttttgtgattaaaatagaattaaagatgaaatatattcaaagatagctcataaaataggagcctgtttaataacataagggaaaaacaaactagggaaaaagtaaacacttcaggccccatccaccaaattcattgttgtatgtgtatacatgtgacattcatgttaaaaatagtaataaacttgctgggcatagtggctcatgcctataatcccagcactttgggattacagagtggtgggaggatcacttgaggccgagagtttgagaccagcctgggcagcatagtgagttcctttctctacagaaaatttaaaaagactggcgcactggctcatgcctgtaatttcacccctttgtgaggctgagacaaggaggatcacttggacccaggagttcaagaccagcttgggcaacacagggagaccccatcattacaaaaataaaaaaattagtcaagtttgtaatggtacatgcctgtagttccagctacttggtaggctgaggtgggaggatcacttgggcccaggaggtgaaggctgcagtgagccatgatcatgccattgcaccccagcctatgcaacagagtgagactgtgtctcaaaaaataaaaaatatctgggtgtggtggtgcatacctgtgatcctagctactcaggaggctgaggtgggaggatagcttgagcccaggagttcaaggctgcagtgagctatgatcgtgccactgtactccaggctgggcggagagcaagaccttgtctccaaaaaagataaaattgtaataaacacatatcacaaagaaactgactagaccccatggccctggtcccaggtatgatgaatcaatgtaaagctttcagtcctgatcactcacgtgatccataaaacagagctttgataagcaagggtcaaaaagagaaaaatggggtaatgtaaccaggagaaactaaacccccaacatttccatcaccaaggtaaacatgatgggaagtggattaggggtgaatgaatattagagtagaggactgtactgaatggtcatcaaagcatgagctttggaatctgatccttctggattcacattcaagctgtactaccactgactagttctgagactttaacctctttgagcctcagtttcctcctctgtaaattgggaaagataaaagattccttccaggaggtacttgtaaggcacagtgaacatgctccacagccactgttattatctcaacttcctgaaatgatcctagattctttatctccttcccttacctccgttgggatgacaacaaaaagtgaggctgtgaactcattaccggaagcgtgctactgttatttgggtaatttaggaacctgcatcttaatctggagaacaagtaacatagaataatttgacataattagtgcccttctaaggtcagggcaatgctgaggtccccatgaaggtgagtttgccacatcagagacacttccgagaccctttcccatatacaccaagtaataaaggattgatgtttctttaaaggtctgaaattatctgtgatgtttttcatataatccgtgacagctaggtggtaaaattcaggaaggttttcctggtaattatccttaaactggggaaaaattatgacccctttctctcattgtataacatgacaaactatagatcaaaattaccttgcattaggttgatgacataaaagttgttcttggccccgtggagtatgtcagtctcattttgaaaatacagatgaatgtctgtacacttttacttcacggtaattatctcctgataaattaatggagttagtgttggtcgtttagtttgtgacaagaaaccctagtctaggctctctctcccacttactaagatggaataatttctatttcaccaagagaaaatgtgttaattgttcctgaaaactgggagagggctgagaaagatctcttttctatccgtgtgtgaattgtgtttccttgaaagggatcattcccttcttaacaattgcatgtgatgttatgttgcatcctttctaacacaatttgtactttgttccctaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctataggtaaatgtctgctgggtctccctccctacctcccgtcacccccacctgccctgcctcatacacacagtgtcttggttgaagtggatcaaataaaactatattatatcagatggggaggagagtgactgggtagttttttacagatgcttgtgtgtttaagcttaaaagtcatggaaaagggggcatcttcagatactgatctcaaatgagtgatcattttcgatcctatatttaaagtacgtgaaaatcattgcttcttagccaaaaggccaagaagtgatgatgatgatgatgatgatgatgatgatgatgatgattttgcttggcagtaattacctcatgataaatgaacagaaattgattcagattcatgaaaatgattcagatggaaagtacttatatggcaactattttcattaagattgttgtattttttttaattttttatttttgtgcatacatagtaggtgtatatatttatggggtacatgaggtgttttgatacagacatgcagtgtgaaatagtcacatcatggagatggggtatttatccccttgagcatctgtcctttgtgctataatgcagagattgtttttttaaggtgacacattgcctcaccctgttccatgctagccaactttgttttgtccattttctccatgaccatctgaaaagtcaaaggtcatgagaagtttgagattcagcgtattttgagtcctgcacatgaagcatattataggtgtgtacacattctaaaaataaaatgttaaggaacaagtggcagatggagaggttcagatgctatagcccaagccctgaatgggctcttcggtcttgcagactctccagtgggccctgtaggtgtgatcaccagatgccgctgccttagcctactctccctgtctggaatttcctgacttcatcttattttggagatgtcgtccgagtacgtgatgattaaggacacactgtgcagtgggtgattcacagcgtgggcccaccttagctgctgctctagagtactgctgttcccactcactaagtgattctttttttaatattctcaaattgatgatgctaagaacatcttcacggattgaaggaagtgcaaaataaggtcaaatcctgagttggcaagtacttctgttcttaagattgtttatactagctggtcttattgttgtaataagtaggaaaaggtccttttcaaatttcattcgggctagcttttcctttatgtgataattctttgttcaaagtgactataacagtgatacaaaatgtatgaatacttgtgtaggattcctttattatattctctagtaaattaagaaaatgggatttcttatttcaagtaactaatattttcagatctcttcagtagttttatgacttccttaaaagacttctacttattaattcactattattaattcacttgtctataagagctctttgccttactttatattgtatccttttaactttcaacttattaatctgacttaataagaactctttttcccttcagttgactactctgtgtagtctttattttgtaaataagcttttcaaaatgctgatactggctgggctcagtggctcacccgtgtaatcccagcactttgggaggccaaggctggtggatcgcttgaggtcaggagttcaagaccagcctggccaacatggcaaaaccctgcctccactaaaaaatacaaaacattagccaggcatggtggctcgtgcctgtaatcccagcttctccagaggctgaggcatgagaatcccttgagcccaggaggtggagatttcagtgagccaagatcacgccactgcactccagccttggtgacagagactctgtctcaaaaaagtaataataataaaataaaatgctgatgctgaaataaacttcccaaatgtctgcaaaaacataaaaagctagttatgggtttttctgtaattttcaaataatttcttacagctaactttttcctttcgagggtttgtttcctttctcattctacagcccagtggccatgggctctttgggttcactgggccattcatgggccattggattcgctgtaacacctacatgtccttctccattttctttagctgatgactggagaatatattagttttcttatgactcaccctttttttgatctcctgttctattgtcctactgtccccagtatattttagataaagcataaggaatgatatagaaaagaacaccaaaatgagaattaggattgattctgattccaacttttctagtagttgaacatgtctttggacatcagattttttttatgtgtcaaatgaggaagttaacctggtaaaatccataaacaccctttaattctcaaaatcagtcattgttttatttctttcattgttatctctaatgcatttcaaaaataattgttgtctttcctctctttcattgtctcattcttaaatatatactttttttagttttaatactcaaatagatgtctgaagtagttaacttgaaaagaaatgacatttgcactgtattttcaaggatttttcagtcttattgaagaaatgtacatgaaacaatttaaaaagactaccactgaacaacttaggaaaaacaaagttataaactatatactaaagtttctgtaaaatttgagaaaagaaaaatctgcccaaggaggcagtatgggggagtagttagtaaagtattgattgtagaggacctcagccttagagcatgagtacctatggagagagaaactgaggcaacctgatatgtcagatagggtggcagcaggagcaaggacatccatgcgggcccggtatggtggagcatggggaggcttgtgcaggggaatgtggaagatcccgttagatggatgcaatggagctggttagtgagagtctgtgttaatggacttcatcctccagactacatcaagtctaaatcctctgaaagaatttaacgtgcactacatttggtgccactcacagaattttgagcagggctgacttatctaaaattagaatgcaagtagattgaactaaatttctaagaaatcagttaggaagacgcaaaagtagaaaactatagtattctagtaacaaataatccaggactggacttgaagggaaggagtcagggtaaagaagtagtgtagaaaatgttttgaaaatcccaagattccacatgtattccagaacttgaagtataataaaagaaaaaaaaattggaaaaaagaaaatcccaagatattcccaagttgtaaaaatggtaaagatttttcctcctctagattatgaaagtatttagacaagtataaaagtagtacataaagatgaaataatcatatttttcctacatcattttaataattcagaggcaatgaatctgatgtttgtttctttgtaaaactggattacttttgccttgctcagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaaggtgggacagaatccctagggtgttctgtgtgtctgtgtatttattcctgtgctacttccttcacactttaattagtggtcacccaaagaaaagtgaggaggcagtatctttgttcttttcaattttactgttttgtgatggaaatttttaagtcttcagaacagcactgtccaacagaattatctgcaatggtggaagtgacatatcttcactgtctggtgtggcagccactagccatgtgtggctggtgagccttgaaatgtcagtagtgcagctagggggcgggagttttaatttttattaaatttacgtttgaatagccacatgcagttagcggctactgtactagtataactgtattagtgagcacacttttgagggatcctaggctctttgaacatctagtgcaagctgtgagccacagccctagaaaaatgcacagttttcctggcacggtggctcacgcctgtaatcccagcactttgggagactgaggcgggtggatcacgagatcaggagatcgagaccatcctggccaacatggtgaaaccctgtctctactaaaagtacaaaaagtagccgggcgtggtggctggcatgtgcctgtagtcccagctactcaggaggctgaggcaggagaatcacttgaacctgagaggcggaggttgcagttagccaagatcacgccattgcactccagcctgggcgacagagtgagactccatctcagaaaagaaaaaagaaaaatgcacacagttaaaacaaccttttaaatatactttcaaggggttaatggaatccatgtagcctatccatggatgctgggcccagaattgataaaatacaatggtactaaagagaggatagagacaggagtggggaatggagggggttttagactctaagcttattaggctgtttgccataaagatgtgctgatgtagcattcacttcctgagcccactaggcaagccgtccacacagctgagtgtcactctaatacaaggcagtgttgaagagtgcattgtgcgtggggagcagaagggaaagagctgaggaccacttgtgactgaaaacatccccggctacataatcagacaggccaactcctaattcagctgctcccagctctgggactttggacagaatccttggcctttctgagcaacagtttattatcaagtgaagtcaccaataccagtatcagaatgtaataaggtttaaatgaatatgctgaactgtggttggcattgaatgctagttatttaatgcttattttaaaatttaaattttattgagaaggaaatattagagctgttagagataataaacacatagtatttcaaaattaagttttttgcctaggtcaaatgattttattttgttttatgcagcggagtaagtgctgctaatttatccatctgataatattccaaggcagtataaaaaaggaatagctgagctaatttattactttgtgctttataaacattttttgtacatttaaaagtacgttctatgttaagttaacacagtatagcataagcacagggtttctgagccatggcatgctcagattctaatcctggctttgccgaaggtttgcgtgacattggacaagttacttaaactttgtgctttgatctttttgtctgtaaaatggaaataatgctactacgtgtgtcatagagctgttaagaggattaaatgagttaataactcatacagtagctagaaaggtgtttatctcgtagtgcccaaaaatttagttgttattttcttgaggactataattgcattttagttttgtgataccagctattactggatatttcagtcttgttgaagaaataatacatgaaacagttttaaaagactacagtagagcaattcaggaacagccaagttaaaaactatatcctaaaatttctgtaaaagttgagaaagaaaaatctgtccaaggaggcagtgtggggtcctatagtagttagtgaagtactgattgtagaggacctccgccttacagcatgaatacctgtggaggatgaaattgaggcagcctgatattttagatagggtagcagcaggagcaaagaaaaataataaactctttgtcaaattcaagaaattctcaaatttagaggtaaacaatcagaaatcagtgatataagaagacatgaagggattacttaagttttttgacaacagcatttgtccagtgttttttaaatggaaagggctgtgcagagtactctgcatgttacaaagataaataaaacttttccctttcctccagaaatgaaccctgacgcataagacagttgaagcaaggtgaggattaagtgattagaattggctgtgtgagaaaccgtccacagccaagattctgaactataatgcagctgttctggtgcacgctgcattttctaggtattgtgggagtcgttctctgaatctgcgtctagacccagtttatattctttgctttaaattgcatgttgccattgtagtatttacttagtttggcataaggtgtacctagttttcctgaaccctaaaactcaagaagcaaacccttgacaaaacaagagtatcatattttagtttcatcatttttgtacttcattacaaattaacctggttttctatcagccatttaaaaagaaaggatttcatttttttttctactgctggagagagggtttcagattattaacgttttagtgtagtcgatgtatttccatcacatgtatcgcggggacttggcagtttatcctttgctccccagctctccttacacagccaccctccgtctcccttacccacctaccactttcatgaagagaataaaaccagtaggaagctcaggtacatagtgtttcatcactgtctcccttactgcttttttaatgacaggctgtgctgtcataaatacacttgggtttgtttgaatcactagaaaagcccaatatgataaatgtaaacatgtgtggtttaagatttgcagtcctgcttgatttgcgtggcaagaagagttcccatgaaggaaagaccagttcttccctcatcagaaagttttactactcgccaggatctccaaggtaaatttccctctccaaagaagaccaaaggaatcattttagaatacttacatatttgggaatgcaaggactctatttagaagactgtaaggatgctagtactagcaattgctgctgcagtagaaatgtcaaggagttggaggaccggagagagagccactggctctcactgtatacccttttgttccatgtacttatgttacctagtttaaataaatacatttaaatcttgttaaaatttaattgtttctggctgggcacggtggctcacacctgtaaccccaacactttgggtggctgaggcaggaggatcacttgaggtcaggagttcaaagccagcctggccaacatggcaaaacctcatctgtattaaaaatacaaaaattagccaaatgtggtggtacacgcctgtaatcccagctacttgggcatctgattcacaagagtcgtttgaccccaggaggtagaggttgcagtgagctgagatcgcaccactgcactccagcctggacgatagagtgagactctgtctcaaaaaaaaaaaaaaaaaaaaaaattatttccataaagaatagatcaacatgtaggtataatgcctgctgttacttaataggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaaggtaagcatctctaaatgatttttcttaaattattgcttcctgtgggagctttctgtcaatgattcctggagttcaccttgggaacagagctggtgactgttctcgtgagctgtctcatctggccccagtgttgccatctaaaggaaaatttaacaggagaacctgtaggacagaagagtgatgaaagtagaacaggagatgatagtgtcacagaggcaggcaaaaggaggaagaggtcattttctttgatccaggggcttctagatatgtgacaagattataagtaccatctaatgaaaagaaatattaacgattcagttagaatctgaatataagagtaagtggaattttggagagtgagtgaacccctggtgaaggtaatagtgggaccccaagcccttcttcaaggtggtaaccaacaaagactatccaggtgtttctagagggcccaaaagttgacacgacttgtctcagctcacagacttaagcaataggacagctggaactgagcccaagacttcagtaataacagcagcccttattgagcacctggtctttgtgtggcattatcccttttgcctcctctcactggccctcacagcaagcctgtgatgtgaacatcacgtctctcactctggacaaggggacgaggaggttcaggcaagtgaaatgactgactctctagcattcagtgtcagtgcaggacgtccatctgagctcattttggtcactgtcatgctgcttccgaaggtcttcccaaagaatcactttttctcaagtgcattgttgttttctgttaaagaggtaggaaccaaaaaaaaaaaaaattcttttgctttagtatgtgctaatttggggagggagactgtccttctctctgtgtcccagcagtgcggttggccagggctccacatgcactgtcagctgcgccatgctgcacgtgagggactcatgcagtgcagtgcagcttgtaactcagcttcaacagttgtctgcatccttgcagaaaaaaatttgtagctagttattgaaaatggagtttcagtttgtcatcatccacctaatgtgcatctggcactttaccaatagtgttggtatgtttaaactttatactttttagatcacttataaaaaagcaaaaatcttaataaatgacctgtttctcccatgccctttttttcccctcatcttattcattcttttcatcctattcatcctattttttagaaataagtgcataatccaacaacttgtgtcttccgtcatttttctttaagtttgaaagaatacaaggaaataatgatgctacattgacagaaatcaatatttaacctactatttcattacatctggtttaaaataggaagaatagtaataacaaaaactaagaaactggcataagcaaacatgttcagcatccttgggtcctgagtttaattctttgacaacctgattccttacaaaaggatttacacagatggatcaggcactgcactagatttaaacagatgggacccactggaaggaaaccccgtatagacatttcaaacttttgaaataggtaagatcaggaatgatcagttacattgaacagaaatctactgcaaagcgttgtttaaatggaggcacttcctaaatgtgttcaggtgcgtgctcacagatacctacttttcagaggtgttggatgtagaccaagaggaaatgaaaatctttagggatcacagccaaggtcaggtaaaattctgaaattataagccattggaaatataagtcttactataaaaaattacatttatgtcatcttttagacactttgtgcaaagcaagatactcacatgttcagtaattcattttcagtacttccacttcagactaacattgtgcaacagttgatggcagaaagtgaaacctaaatgtagtatctaactgaaactgcagagaggagtcattagacaaattgcttaaagtgaaattttacgaagaaattagaatccacattatatgtcagtctctctctctctctctctctctctctctctctctctctctctctgtctctcacttgtggcagttttgtggcatggtgaatacacatggttgctttaggggtaactattcaacccacaaaatttgtgctgaggattatgtggtagcaacatagtagccttgttaaaatggtttaagaggaactaaattctatgtctttttttttaactgaattgaaatgttcttttttaataggtgatataagacagttataaaacatagtagctttaaaagataaatctcaattcttttaagagaaattatattaacctagttgatttgtgttctattttgttattgtcttgaaaatggaaacacctgatcccttatctaaaagttaaaccaattccagtgttgctaagatttgcacttttattgtttcagttttgtttagcctttttttctctgaatagattcttctgattgtttatcttttacttcctgttgtcctaaccacataaataatacttcttacacagtgagaaacaggactgggggagagtagtgtgtgagatgatggattgaacagtacgtaatttctagatgaatattcagagaacatattaaatgtcataaattttattttcatatttgtattagttttacaaggaaattaaagtcatattgtatacgtaagagataccctgtttatacattgtgttgttttctaccattttaagcaaatcattataaagcttgtttgagcagttaaatggtttacactgttttgccataataataaagattttaagaacacagtttgagggtccaggctcttactccttttcataaggaaaacagataattgaggttattggtattttcagtgaaaagtaaatgtgcttttaaaatgttatgtttcaatctcataaagtattacttataactctttacatgctggtgggaaactattatgaaacttaatgaagttgattactcttattatgtcttgtcctccccgacccctcaatttttttttctaaacgtgccttctgtttccttgcttgcctgcagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacaggtaatcctagttctaagaagtcattttccatttccaagttaagaggagatattacaaaagcagcaaattattttagagctttgaggatttgttagacatttcttctcatcaatcccagtaatgtaaaatataaaattaaattgttattagctgttggctaaaagacaattcataatataattggccctctgtatccatggcttctgcatcccaggagtcaaccaaccacagatggaaaatattttgggggggaaaaaaatatatatatacattaaaaaaatatatatatatatatatataatgttatactgtattatttgtattataactatatttacactgtatcaggtataagaaattatttctagaaatgatttaaagtatataggaggatgtgtgtaggttatatgcaaaaattatgctattaatttcagggacttgagcatccatggattttagtatctgcagcgtgggggcagggtggaggctagaaccagtcccccatataaccaaagaacaactgtactggcaaagtaggactctactttgaattttagccttaacactagttaattgtaaaacccagttggcactaagtttgcttagacatgattgcccattacattgaaaaagggaaatttattgatcagctcccagtagcaacaaatgcagggcaggaatattgatgtcactagtatgatttctgctcctgtgtgtttaaatgtagaactgtttggtttttttgttttgttttgttttttgttttgttttgaggcagagtcttgctctgtctcccagactggagtgcagtggcgcgatctcagctcactgcaacctctgcctcttgggttcaggcaattcttgtgcctccacctcctgagtagctgtgattacaggcatgcgccagccttgagtgatccttccaccttggcctcccaaattgctggaattacaggtgtggactaccacgcctagcctaaatctagaactttctatgtatatatttacaaataatattttagatttttgttctctggttcaaattaacttctcaacattagaccttaaattgaagggtaataaacattttcataaaaaagtgaagataaagaaattgaatattgatttttaaataaatgtcataagccatattgtcttagagcacatatttaggaaaatgattaaatttcattagttatctaaatatttatgcttatgctgtggaaaactatatgaggtcctatcagtaaatatataacgttgctctggctgaggagttccattttatcacatttctcaattcactgtttaggagtaaaaaaatcaggcaactctgtttgccaactgttaataaatctaacctcaaactgaaacaatttgaaagtgattacagatgtggcaaatttcacccacctaacgaaaagctgatgtttgacaatttgtgaaacctgttttatttggatttgtgaacacatttggtaactcaaaagtgactgccaaggctgtaaattaaagctcatagaacttgcaaaatcatcttgctcagaaagcctgcttttagtcattagtaaggagatggaatggagttatccagaagtagaagaataagatcccaaactaaagtcactctgaacttcccttcccatgctgttggctctgaggtcttgctctgacttggaggggtgtggggtgaggagatgagtggaaatctgttaaacaaggtgatctaattctaaacagttttagtaactattagttctagaactggcagagtttctcttttaacagttaggggcaagttgttttcccctaagcgtgtttatcttgagccaagtagtaaatatcagagctctgggcttacagatgtgtctattgttaggaattataatctctggaaaaaaaactgaagacagctctactcatttctttaagacagtacaagctctcaactactcatgagaaagatgtattatgtaattggaaccctgttaatgtcttgtctagtaaatgcaatttaaatacagtagtagtcaaatttaaacacaccccctctgtaaaaccagacatcttaatgagttgcctgaaaaacatccctcttggtccaacactgtacatgttcagtcttgtcaataattgcagatgatttcaacaaagtattatctatccttaaaatgtagcctgttcttttaaggtgaagaggccatatcatttttaaaaattaataacaacttgctaagtatttttccttttatcttacatttttttcttttctcgttatacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccaggtaagttttatcacatcttctcgcaggtgtactaatctgtatccatcaaggattttctccataggggcattttgaagtctcaggtgattggataaaaataagctttctcctttgttgttcttatcttgaaaatctcgctgaagctgtgtgtttcaaatactctcctagcagagtgacattgttatagaacataggtgggcaggcctttttttgtgaggaccaaatgtaagtattttaggctttgcaggccatatagtctctgtcacagccattcaaatccaccattgtagtgcaaaagcagccacagacactgtgtaaacaaacttgaatatgactttgctccgataaaacattgcttatagacactgaaatttgaatttcatggaattatcatgtgtcacaaaatatttaaaatgtttttaaccattaaaaaaatgtaaattcattcttagctcatacaaaaacaagatttagcccacaggctggtggtagtttgctgacctctgttatagaagctgcctgaattggagataatcacttccttgaaactgggctttgtcagaacagacgtaattgaattatttcttatttacctttctctctttttaagatcagagtttaactggttttgaaacccaatgaaggtcgttctacctctctttattcttaactaaacttctgattaatgcaaaagaatttcttagaccactggtataaaaaatatttaagagggaaagggatagtagaaaggagaaagaaagattgaactgatattagtacgtctgagccatggtatgtaaattcaaaactagaataataggctacattatgtgctctcattgtctgaaaaataagttccctgaaaaaatccaggataccttaagtgatattcaaaataatacttatttatacttgacaaattaaaattgtatatatttatggtatacaacatgttgttttgaaatccatatcctggaatggctagaccaagctaattaacaaatacattacctcacatactttttggggtacaaacacttaaaatctattagtgattttcaggcatataatacattgttactaactgtagccacagtgttgtacaatagatctcttgaacttactcttcccggctaactgaaatttgtatcctttgaccaacatctcctcaaccttccaccccaaatcattcttgataatcctctaaggagataatgacatcacagggaaaaagtaagctatttttctttattaaaaaaacaaaaacagactgggtgaggtggctcatgcttgtaatcccaacactttgggaggccaaggtggaggactgcttgaggacaagagttcaagaccagcctgggcagcatgatgaaaccccatctctagaaaacataaaaaattagctaggtgtggtggcatgcacctgtagtctcagctactcaggaggctgaggctgcttgagcccaggagttggaggctgcagtgagctatgactgcaccagtgcactccagcctaggcaatagattgagaccctgtctcaaaaaattaaaacccatttaaagaaaacatgggttattaacagccacagtgacttggcatgagacgtttcctagggaatcaatgatcaaagactttaccctagccatcacttttctctagtccctgaatatgccctatacttcttatctgttcttgggtcatgattggttaagaagtgaagaagccaagagggctttcctactttaaatgactcaaggtttgtccttgaaatttgttttgcgagaggatatttcatgtgtcagtgtcttcaatggatggagagaggaaaagcacaccccttgctgtaccttggagctctgctgagtcggtagagctaacccagaggcaggtctggggttgagagccatcctcagggaagccaaggccacacttgctcttctagctgggctccatctaggcttctaagcacttggcttccttatttctttcactttgatgtctcgacagctgctaccattcctaaaggtcggatacaatttttcaaaccttcatgtccttcacaagggaagcggagccaaattatataaacgtcttgggtgattaatccttaaacttagatattagtgcaaggttctattagcagctgttccgtaacactgtaaaatcattaaatggggaaactggtgtctcagcagaaaattaatagcaatgtcttgaataaagtgaaatgtaaaaccatattaacacctgtaagtgttttaatcttttgaggtgtactagattagaatctacacagctagtggtaatccagagtggcaggcacagacaatggcactccggtctcttgacacatgctggagggcaagatggtctcccctagcttagtgtctaacgtggccaggccttccctgtgtaaacgatttatttctatcctaggcctgatctgaggcccaagggacttagagggtcaaggaaaggggccactctttggtatttctgtatttatttatgtgattgcactaacttcagacaagaaactgacaaaagaggagttttttaaaaactccttgagtcacttgcagtttcaggttatttatttaggagaaatgtttttctgataaaaattgtctcacctaggaaacataaagtccagagtgtaatcagcacagatctgtttttttggggtgaatcaaaaagcagtgtacacaggcacacatgcatgtgcacacacacagaggcacatatagtaagtatatttttcttaatgaaatccagtctctggtctcgccctccctttactctcatgtaaaactccaccagaagtactgctttagagcaattttaacatcaaaaacattgcagcttgaaaagttaccacaggaagtgtgcattacctatatttagatcaaagttagaatgacttactttaagaaaaaaacaatgattctttcacctcttgctcaccttcactgtttccaaatacaggttaattgtatctcctattgattgctgtacaaacttattgaagacttttctttcatttcaagggaatacaataagttatttagtgagataaaacaaactattaatgagtctgaattgcacagttaactgtcttgttattttgattcagaaaagagccattgactgagtgtgtgtttaacctattactaacttattaatgacaggaagtacttcgatggtgctattatacccaaaatagcattttttaccgagcagagtggttaaacatttgtttatacagcatttcctaaccagcaggaaacagtaacagaaaaatttccagtatgtttacacacttttaagttacatgcttatttacacagtggaacatggttgatacttaaccaaacgatactactgggtcctttctaatgctgctgagacacgtatgataagggtttggaaatagtctaaaaagaatttcttcttggtatttgactccattagaaaggcaaaccatattttaaactgatagtgtcctgaaaatttctctccagatgtggtagaattgtattaccatttcttaacaactttgtgttaggcaaatatggtaaaattatactttttatttaaaatattttgaaaagatgccttgtaatttattagaatactgatgttgtttaaatgcttgtgctttttatatttcctgcagagaacaagttgatttgacatgaaaaaatcctaaaaccagaaaaatgaaaaattaaagaaatcaagtctgattttcattttgtagaacttttataaaaatctttctgactcattttctgcctgaaatagtttaaactaacaactcaaattgatgtggctaatttgagcattcaaatagatgcctaagcaaaactttgaagtatcttggcaaagcattttaaaggaaggcattaatctttttgtcttgtaaagaaattgtgcctaacaaagtggatagagactagaagaacttttgatgagaattaaagcctacaaaaattgaggggagaaaattttttaacagaaacttaatgtgatcaaatttattccttccaaaacttacatgaatacagaaaaaaaaaaattctgtagtcatcaaatgttactgttaacctgaggggtatagatattctgaactttatctccttgaagaagaacatgtaaagtgaacttacgacaattaatgttaaatgtgtactccataaattgacaaggaataaacacaggcaaagcaatattatctctagttgggaaaacttcatagtgcatttttcagatgccaagcttgaatgaattcaaatagtgttcatagttttaagccttcatagaactagttccttttgatactaagaagatcctgaatggctttcttaagaaaaatgtatttaggccgggcgcgatggctcacacctgtaatcccaacactttgggaagccaaggcaggcagatcatctgaggttgggagttcaagaccagcctagccaacatggtgaaaccccatttctactaaaaatgcgaaaatgagccaggtgtggttgtgcacacctgtagttccagctgttggggaggctgaggcaggagaattgcttgaacctgggaggcggaggttgcagtgagcctagattacaccactgcactccagcctgggtgacagagtgagaccttgtctccaaaaaaaaaaaaggaaaagtgtgagtctagactgttcttaatatatattgtcaaaagttccttttacatatgtctgggattggaagcaaatataaatgtatccattgagaaataacatactttacttttattgtttacatggacctatttattttggatatttctcttaaaagtaatctgcagagctttctcaagaggcaactcatcacttattatagcccacctccctcacccccacacatggagcttctaccttttaaaaatgctcaacacaggacaacattgtagtagggaaactggttttcatagaacagatataaccttctcagtttattagaggctttttctgatctatcttcatgacaagtgtaaggaaatttaccacacatttttatgaaacattttctgaaaaagtaatggaaattataggaattcctatgaaaaaaattactgatttggggaagattttttaaagtttgtgttaatatgattaaaagaaatcatcgtgttgactcagtgcccattacttagttctaggcactgtccttggaggacaatctatgtttatactgagaataacagtttataccttatgcattcagcaaaacatgataaagaagattacagtggagtcaactttacatatgtattttaagtacataaagtcagttttatgttcctggaagaacagatggttattaaatggttatttcagtagtatgagcagttttgcccaccattgaactcaatgaatacctgccgtagtggagtgatcatgaggtgggtgacatgactttgctgggttttggttcccttgtggctctaatagtgtgaacatgtacctatgggctttttaaatgcagtatggcccctacataaactacttcacttaggactcagccaaagaaatagtaatttgctgccactctggaggaaagactgttgctgttggaggagatagtcagtgcggtgccttcctacagagctttaaggataatttgacctgtctgtgactgttggtactttaggatgctaactttggaacccagctcttaattcataactgactctcctgtattagatacctccctcttttgttacaattgagtggctaaactagctaaaaaatggtcttgtaattgctctaacaatgcgttaggaaaatggatctcccaatcattgctaagctagttgtctctgagaagaaccaaataaaatctcacttcattctattcttcctaacttgagaaatatttccaatcaaaaaacatctcatatggatgttaaatttgctgtaagttgcaaaaatcttagcatatccaacctctgcatggggaggaattgtatgtcggataaaaatgtaagccatcctactttcagtgtaactcattattagatgtatgccatgtatttcatttgatttgccagtgtagatgaaaggaatagttgtggtcaaggattcaaagtccaatgactgaggaaactaacttacgttttccacttacacatcaagaaaatcgttcgtactactttctgcactagaaagcaatcctagcatgcactatctgattttaaatatctggcacatagataggttatatttaaaagaatatctgtaaaatctagaataaattccagtttagcttcctagcagaaaagtgctaagtgtgaaatagtggtgatacttagcttatgttagtgcttgaattttgtttttttttttaatggaagagaaaacttaaaaacattttttatggcttctgtagacaggcacggtggctctctcctgtaatcccagcactttgggaagctgaggcaggaggactgcttgagctcagagaccagcctgggcaacaaaatgagacccccatctctaaaaaaaaaaaaaatcaaaaaattagccagacatggtggtggtggtgcatgcctgtggtcccagctactgaggaggctcaggtggcaggatcacttgagcccaggagatcaagactacagggatgagtgtttgcgctactgctcgccagtctgggtgacagagcaagaccctttctcagaaaaaaaaaaacaaaaaaaacatttttatagcttctgtataattaggttaatagtgctatgtttggggggcaaccagtttttatcctgcttccctacctttgttacctaagctggcaaaagactgggaaagccattgtcattcaaaattgaaagtccaagcagaaaaaaaggactactcaaattgaaaaggcagtgcttagttcatggatgcttcaagcttattttgcttctctctccccacccctgtgttcttttaaagattaaaaaaaaaaaaatcctgaagggaaatgactgtttgttaaatactgattgggtgcaaatttggattacattatatgccagttttttgttgttgttatttcttagggagttttgatgataaaacctagacctggaccaaagtcatagtctattcataattaattggaaatatatattcttataattaattgaatgataagcataaaataaaggagaatttataaattgccaataaatcacaatgctggaagagagctttctttcttattcagccatctctttttatagatgaggaaattgaggaccaagagattaaattatttgtcctttgttaacctaattttttaaaagatgatcaattatctgttaggcctgtggtatgcaggaatctacctattttatttggctgtggtgccttatggcagttaggtcagtgattgcaaatgggcttgtggtgtctactcttagagtagactggataaactcttctgtttgtcaactacagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcagtgagtatgagaaatggctggttatgccaagaaatttccatataatcactatcagaaacagggattattgaagtctgatgcaaccagcttagtcactttaaggtttttgtgatcaaatagcaccatctactgtcctggtcttttgaaacagtattcaaaatggatcctcctgagcatggttctctcacattctcttgtgggttaatttaatcagcactggacagggagactgacctacattgatgaagttcttcaactgattgtcatatttcccttcatttcagtgactgccttcagacatggagtttatcctggattttatgtgtttaatagacaatgaaatactgaaatatataacatttgggagctatgctgactttttagggataatacactatttaaaaatattctaccctcccaaactgctcagctggtagtaacaaaaaataaatttaaaaaaaaataataaaatattctactaaaagtatttttacatgaaagggctacacacattaaaaatcttgccctgtctcaggaatcttcatataaacatcacttgacgtggaactttacgtttctaaatgtattctaagttaagttgtctgtttagaaagaacatcttctatcttttcattttaaagttttgtaagcttaggataaacttgtttactatgaacactcagtttacaaacttgattaatacctgaagttgtctgataatcttgaatggaagaaaatatctgttatgtagcaaggccataatttatgaaagatagataacctcttcagcattaaattggcaaaacagagtgatttttccttttcagatacaatttgagccaatacctggcatttgttctcagatcaaaaatggcaaccatcagtcaaatcatagaacatctttcattgctaggtcttttctcaagtgatttctgaccattctgaaataggaaaaacaaaagacagatgagtttgggccgggcgtggtggtgggtgcctgtaattccagctactcgggaggccgaggcaggagaattggttgaacccgggaggcggaggttgcagtggtccgagattgcgccgctgtactccagcctgggcgacagagcaaaactccatctcagaacacacacacacacacacacgcgcgcgcgcgcgcgcgaaagatttgcatgtgacctctcaaacctcactctttcttgggcaatggagagttaattgtggatcatgggagatcacgaagtcaaaagagttgagaattgggtaagaaacacactagacaggctgggcgcagtcgcacgtgcctgtaatcccagcacttggggaggctgaggcaggtcgatcacctgaggtcaggagttcaagaccagcctggccaacatggtgaaaccccatctctactacaaaaaatttgctgggcatgatggtgggcgcctgtaatcccagctactcgggaggctgaggcaggagaattgcttgaacccggaaggtggaggttgcagtgagctgagatcatgccattgcactccaccgtggacaacaagagtgaaactcagtctcaaaaaaaaaaacagacacactagacagtccatgctcattagccctaggggaggttatgaaggactgtgtagaatttatggtttctcctctttctgtagctcctggtggtattcagattattgatggcaacctgataaccaaacctgaggaagtcatgattaagcacgcacataatttccattctcagccctaattttttaaaatattttatttctatcattgatggttaagaactttttcttttaaatgtgctatttcagactatgtttatataattcaggaaaataaagtacttgatgttatgtaataagttactataatttgtaatatcttagtattaaatttaatagcgttaacaaattataggttgtcagtgtgatgctggtctagtgcttagtacacaataaattcttgtcaactagctataaaaatcatatcaaatccaaatatgtctagaatttaaagaagctgtactttgaaaagtaagcagggtcctacagctttaatttaatactgctttaggcaacagagttcacacttaaaatttttaacttctaatgagagtaaccacttttaatctaattctaatcctaggaaagcccagttaagaagtgatgttctaatatccaaaccatgtatgtataggtttggtgatatatgtaagagatgttaatagcttcatagctgtgagaaagcagtactcctaagtctgaatattataacgtgaaaaaaacactggtttaattagcaaatacagttatatatttgaaattactattgggagccagacacggtggctcatgcctgtaatcccagcactttggggggccaaggcaggaggatcacttgaggcaagaagtttgagaccaccttaggcaatatagtgagacactgtctcaacaaaaaaattttaaaattagccagacctggtggtacttacctgtagtcctagctactcagaaagctgaggcaagaggatctcttaaccttttcttaagcccaggagttaaaagctgcagttaactacaattgtgctgctacactccagctggcacaacagagtgagaccctgtattaaaaaaaaaaaaaaagggctgggcacagtggctcaggcctgtaatcccagcactttgggaggccgaggcaggcgggtcacacggtcaagagatcgagaccatcctggccaacatggtgaaaccccgtctctactaaaaatacaaaaattagctgggcgtggtggcacagctgtagtcccagctactcgggaggctgaggcaagagaatcacttgaaccctagaggcagaggttgcagtgagccgagatcgggccactacactccagcctcgcaacagagcgagactccgtctcaaaaaaaaaaaagaaaaaaagaaagaaaaaattagccgggcatggtagtgcacgcctataatcccagctacttgggaggctgaagcaggagaatctcttgaacctcggaggcagaggttgtaatgagccgagatcgtgccattgcactctagcttgggcaacaagagcgaaactctgtctcagaataaaaaaagagagagagagaatgaatgaatgaatgaatgaatgaaattactattggtgaggaaggtatatggtaaataatatacatgtgtttgttttgttttgcaagatcgtcaagaattagagaccagttgattagatcacacatctatgctttggggtgctgcatgtgttttttgtctgtgattttgtcttttatctaggtagttggtccctgacatacatacctttgtcattttacagacattgtccctaaacactactgttaatattattttccattatcctatattaaccttcaattttcatttgttttctccttagcttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggtaaggggtcaaatgcactgttactttattggtgggttatttaatttaatggtatatttatccacatcaaactagtagaatttttcaagtgaactttttatgttagaaaataacatctgaaagtgagaaaattctacagattttcactgtgagaatggcatgtgggaaagcctttgggtgagctaaccatttaattctgtgattgttacttttatgaggtttccaaccattaatcctatagctgagacttatttcacttctatcccagttactgttctaggcattgcagggtatatataaaattactccagggataatttactgatacctcaaaaacttatggattgattatttgtgtttggagaatttcagaataagagcttaaaattcaaccaaccttttatacttctaggtgataaaattcttattccaaaaagtactaattaaaaataaagaactttaaacagtaatatgcctggcctaatagctttcagatctggtccccagctcccttttgaagatgtaggaagttgcctgtgatcaggtttggatgttgacctgctataattgcaggtgtctggcaatttgcctaggcacatttcctaggtagtagtcactgtctcagtggccattatattcccaagcttatatccagttcagattggaagtcactgcagtagcaccgattgctgttgccaccacatccacatcctgtaccctgtaacatatttttattatggatatagcaggatgctgttttctaatgcaaagctgctcacagtttatagctttcttcctctgtctcaatgagtcactagaaacaaaggcatggaaagaaatcttgtaagaagaacttatagtggtaggtgttttaactgttggtattttatttttagccaagcctgtatccctatacacacattgagtgctgtttacacagttaactgaatataagagttcaatttaaggggaagaagtagatttttaactttctattgtttataaggaattcatggcaactgtgaactgtgctgtattaaggtaactttttccttcagcaaatatttattgggtgcctgccacatatgtcatgcactgactgcttcactaattatatagtcatattcatttcattaaatattcagtaaacaaagattaatttaaaatttaagataaataaaatattgatttatataaagttctataagagaaaaaggagccatgatttattaaggcttaccagcagaatacaagaagatatgagttcttgtaggaatcttctgcaggaatttgagaataggcctgtattaaaatccgagcagccaagagagcactggtgtccagcctgtgaagatcatacaatactctcacgctgtttaaaaaaacacagactaggccaggcatggtggctcatgcctgtaatcccagcactttgggaggccaaggcgggtggatgacaaggtcaggagttcgagaccatcccgaccaacatggtgaaacctcatctccactaaaaatacaaaaattaaatgggcgtggtggcgtgcacctgtaatcccggctactcaggaggctgaggcaggagaatcacttgaacccaggaggcggaggttgtagtgagccgagatcataccactgcactccagcctgggcaacagagtgagactccatctcaaaaaaaaaaaaacaaaaaaaacaaaacacagactgagagggactttcccatttatcattgcagtaatattgttgaattatggatcattctcttttttgctttctagacttcctataatcttgtcatattatttagataacagatttttaaaaaaataaaatccctttttcccataatatttttctatagttcaaatctaattctaaaatggtttttaaaatatgtgttaatagaatacccttctaactttttattttagtttatttttgagacagagtcttactttgtcacccaggctggagtgcagtggctcaatcacagctcaccatagcttcaacctcccaggctcaagtgatcctcccacctcagcctcctgagtaattgggactacaggcatctgccaccatgcccggctaatttttgtattttttatagagatgaggcttccccatgttgcccaggctcacctcgaattcctgggctcaagcaatctgcccaccgcagcctccctaagtgctgggattacagacatgagccaccgcgcctggcctcttaactttaaaatctaactgactacctttcacccttaatcatcacagcacattctcatttcgtaagtgaagaaacgcccacaatgcatgttcatttgttaaatataccccatttttagttgtttatcgtaattaaagaaaatgaaagcagccatatatttgaaagcagaaccttcatgtatccatcattaaacacttcaaaatgaagagacctcatttgaagagttttccctttagaatatcaagtcttagcaaatgtttggccattatcagcatcctgggggccaggacaggacagagcaaacacagtcctgcttagcagcgttacgctcttatgtgtggtcagataactgttaacacctcaaaaaggaagggatttttacaaatctgtcctaacccattctaggtctgtatagtcaggaatacagtggatacaaggcaaggaactcccttgccttggctatgaagaactacagtaaatatcagaaagatctataagttctccattgcttagaggctactcttggtcagttttgaagtataccctgaaggagacttgaggataaagtctcatatagacttcaagatatcttctatgattatcgtttataatgagagtattgattatcagtttttaccttattcctcttggcctctacctcccttttggaaagtaaagcattgacgtgtatatcagctaatgtgattcacttcctgaggaaggaagttggggttatccacacaccacggcacctgtttctaagtacaaatgggaacaattttaatagcttttctaaactataaagagcggcaggtccatgttatgaaaactatgtagtgattgccaattgttatttcttagccaaggtcccacatctgcccaatgagaacattagctattggctaagtgtgaattacagaatgattgttttgtagggtaagatcatctggtgttcatacatgctaaatatgttttcagttactgcatctctcagttttctttggcttgcatgcaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatataggtaaggtggctctagtgctgtttgcttttaacttttatgctctcttagaaaagagagcgtcataagttctttcaagacatgcttcttatgggcattttagataatcctcccatgaagctgccataagtgggattttgctggaactctgtatggaattagaatctcaaaagttcttcagtcatataagagacccaactacctttgagatgttttatttttactaaattacctaatttcaactttggggaagaaatgaattataatgtcacactattaataaagaaataggccaggcacggtgactcacgcttgtaatcccagcactttgggaggccgaggcaggaggatcacttgaggtcaggagttcgagaccagcctggccaacatggtgaaaccccatctctactaaaattacaaaaattagctgggtgtggtggtgggcacctgtaaccccagctactcaggatgctgaggcaggagaatcacttcctgggaggtggagggtgcattgagccaagatgacaccactgcactcaagcctgggcaacagagcaagactctgtctcaaaaaaaaaaaaaaaaaaaaaaaacttaggtggtacagcagtagtttctaacgctgtgtgatcatcagaacaatatcaggaacttcaaatgcagattcctgggccaccacctagactactaaatcagactatcccaggccctcactgaaggttgcaaggtcttacagaacatctcacagaatgtgaggattactagaattctatttggagacagttcacatattattaaaattgatggtctgatacatcatatgataccatttatatgaaatgtccagaatgagcaaatctgtagggacagaaagtaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaacactgttggcttcttcactcttattatcgcccaagcgttatggtagagttttccagaaattttacatgctatatgatatcacagaagatgaaatgcgaaaacagaggatttcactctattccattaacccaggcattaaagctatttgcagaaatgtaaaacgatgccaataaaagaattttttaattttgcaatcaaaaatcttatttcttccacttacttggatctagaaaaaaatcttttaacatataattcatttattgtgatttttaaatgaatctacacttttttctgtttctcaatttcaatttccagtacagtaaatatcagtaagatataacgcacatgaataaaaacttttttgagtatttaaagtcttaaatgctaaaggtttagaactgcttgtctagatattctctgaaatggctttcatatttattgacttctatttcagaatcagaattttatcttcttatattcacctagttaattattactgcttctgtgttttccctttttcataaaccagacatttcactttatattacatagcagaaataaatgcttccttgattaaagatgtaagatttttttcttctccctttctagggccatctgaattagagatgaacatggggggacctcagtatagccaacaacaagctcctccaaatcagactgccccatggcctgaaagcatcctgcctatagaccaggcgtcttttgccagccaaaacaggtgagtcctgagcacctagggtagccagttattttatacctgtccagaaattaatcttttccttttgagtagtcggtgcctgaccagttttcatttattggtactatattatctactgtgcagtgcatgaagaggaggggtgaatccagaaatcagtatgacctaggacatacctttaaaggagttacaaattaaatggaaaataacatatgtatgctgataactgtaatattgaggtagtgtgtggtataaaaatcataagccatgtttcagaagatcatccaaccaggatgcttggagaagccttcagaatcttgaagaaaaggtctcatttcagatggcagagatgacaggaagccagtccagctggtaaaagctgcatatcacagggccagagtaaggattgctgtgagtagaattgaggcagtgggtgacagaggaagaacctcaggcaggcggtgtggctcgtcccaaactggctgccaagggcagtggtaggcgcacactgtgtagacagggaagcatgccccaggtagatagccattgctgtcgcacttggagctgctgtcatacttggaggtggtggtttctcacagtccatcttgttctttgattcttgtttcatgacatcagtgaatggtaggctatttctagatacgtttatttgatatgttagaaaccccacccatttccatggaaacttgaatataacacaggacaaatgtataataattaaatccaccacctgatagttgtttttggatgaaatgtcaaagattagtttttaggaagaactagacccaaaattaggatttttagtgttgcccaaacaggaggagagttctcttaaaacaaaaatggagctagacgcggtggctcacgcctgtaatcctagcactttgggaggttgaggcgggcagatcacctgaggtcaggagtttgagaccagcctgaccaacgtggagaaaccctgtctctgctaaaaatacaaaaaaacttagccgggtgtggtggcgcatgcctgtaatcccagatactcgggaggctgaggcaggagaatcgcttgaacccggaaggcagaggttgtggtgagctgagaccgcaccgttgcactccagcctgggcaacaagagcgaaactccagtgatagagtcagcatgttaagtttgctgtgcaagtgtctgtgactcagcactgccctagcatgttgttgtttctgttaccatcagttaggttttttgcataagcaatgtgtggacaaaacattttcattacgtttaaagttatttcagtttttctagccactctcacatttttattttaaataattcagtgtggaagaaacttagaaccagctttatggtaatcttactgtcatagaaaatcagaagtaatgggtaataaagtttctaaccatgtctctcttttgaaataaaagaagagcagtgctttttaaaaatcccctttataagcatcacagttaatatttaggaaccaggttttttaacgttttatgaatccagcatcagtttatgtatacatttcaaaaagatagtagtttagcccttaaatctgtaacattcacatattcatgtatttatagctaatttccacttttagttccattatgggtttttgggtttttttttttttccttcattcatctggtatataaaagagatctttataatatagccaaaaatttatagatgactttttaaagatatctgttggttttattaaaggggttttctcttgaaatacaatagctgtctttcatgaaagacttccttttgcattaagttcacaatttggtggatttttgtttggtttttttgttttgagacagagtctcactttgttgcccaggctggagtgcagtggtgtggtctcggctcactgcaacctccacctcctgggttcaagtgattctcctgcctcagcctcctgagtagctgggattacaggtgcccagctaatttttgtatttatagtagagacaggcttttgccgtgttggccaggctggtctcgaactcctgacctcaggtaatccacctgcctcagcctcccaaagtgctgagattgtaggtgtgagccaccgcgcccagcctaagttcacaattttaatttgattttcccctgtttgaaatgtatctctaagtaaggtttcttttgttgactatttctcatcattcagtagctgctgcttttttgcagaattttgaaaatacttttgaaaagtgaagaaatggtaatgttatggtttctcaatcaagtgctgagaatttgacctaattctccttcttagtcccgtacttaatgacctactagtccataaataaacatgtagactttaaggtatgggatttccattgattatggatctctctctgcttgtttattagttattattttgcaccagcctggggcctgtgtgtgtttttccctttattaccctgaattctattctcgtcttaatattatatttatctgtcagatgctaactaggttgtaactatatgtaattgcccaaaacataggaaaataatttcttcattgtgttagtggccatttataaagttcagattgggagtctggatcagtgttttttctgtaagcaagcatattatgacatctctaagggaagtgatatcactcatgcccaaatttataacaccaagccacaaggcagtatgtatttctgaatataaaagtggtttttaatgtattgtagctcagccaaatcaggaaccttttgttttcatccactagaaacttactgcacctatactgtgtttatgttcaagcactgggccaaaaagaggtagaggatgcaatgcttgccccgtgtgagcatggtgtgaagttgcgtttttaacataaattgttagtatcaattcagcatagcacagtaagtggtttaatgctgagaggagaaagcggggcagtctatgaggagatgggtggcaccccaatggaaagtagaccctcagctggagaagagcgtgggaaggatggggtaaatgtcaaggtattggttttctggtggtatgtgtagcatcttttggagaaagatcagctgcccgtggtagctggagctcacagggaaggcatgaacattaagtttgggaaggttaggcgttacccaccaccactaccaccctattccaggggcgttttcctgggagagctgaagaaccacataagaattctgagtagggcctgtttgctctgtaaagtgtgctttgggaatgggaacctgagagcatcatattagaattagagataccatgcaagcaggaaagttgttgggaaagtgtcccgagagtcccaacttgtgttgaagagggccttgaccaaagtgggacggtctggaggcactgtttaactttttaatctctgcatttatttggggttttttaaattaaaaaagaaaagcatgtaacaaaaagtgattttatgatgtaggaaattgtttaaattcaaatgattgttttagttgtttgttattaagcatttggctgtattgctgatctgtcaaggtggagtggtcttacaaaggcacgagacagtgcctgcctcctcctgacagtgggtttccgccagatgtgaggctgagaagtctgcttgtacagcctgcacgcattagatttcacacgaacctgccatcactgaatacatctgggacgggagggttgcatatgaatgcagcttccaaagaaacaagttgaaaatgacaaaatctaggtaaagaaaatcctttaatgcctaacttaactagcatttttagggaatgaggtagctgcctaggagaatttggtaaatagctgacattactcttgactgacttgaactctttcatggaactcctgccatatccatgtttgttggcccctcctcattgaggaatctcctctctttgctatcatggcagacagtccagtggtttctccctctcctgactgcttttctgcatctgcttcttcctcccgctccctaagtgtagcagtagtggagcagtctgatcacatttggtttaaagaaagttctaggagagtgtgggctgtggagaagaagcaggaggaaggagccagcaagctcccagcatgtgtgactttgtgaagcccagtagtgacaagaaaggggcagaaaggggcgggagtgggaagagcacctgcctctcaggggtctgggtgggtcccttagaaatgcaaggagctcctgcagtgaggaagtcggggaagcaggtgacgcgtggcctcaagggaccctcagctggacaatttccaagttactagaggtgagtggagagaataggttgttattaatgcattcctttatgaacatttgaaattaattgttggtttcagtgctagcacttcagtatttcagaattctaagccaaaatagcatattagagcatttaaaaaccacatggcatattgaactgtgttcataggtaacttcatttcttgataagtttattctgacttgcttaagaatgagtttgctcatctataaactttttgtttgttttttaatctgtaaatgtttattttctccaaaacatcatgtagtgactctaagagtacaaaatagacttttggtaaagtacaaataccattttcccttttagtattcaggcaactcagaagctcttttttaaaagcctcctctaggctagatgtggtggctcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtctctaccaaaaaaaaaaaaaaaaaaaactagcagccaagtggtgggggcaacacaccaaaactcaaagcaactaagaagggtgaggccagaggatcacctgagcccagtgagccatgatggcatcactacacacatacacacacacacacacacacacccctcctctactctaatctgacaattaatttaaatgtataggagttgtatgtaccatgtaatttagagtttagtgttctgatttcatcaccaattatcttatataataacaaatataatttgcatgttgatgatccactttccttatgtacctaatgcaggaaggctaacagatacacttcttgagggttttaataaatgttttcaggccaggtgtggtagctcacgcctgttatcccagcacttagggagaccgaagtgggtggatcgcttgagctcaggagttcaagaccagtgtgggtaacatggcgaaacgccatctctacaaaaaaatacaaaaaattagccaggcgtggtggcgcgtgcctatagtcccagctacttggatgctgaggtaggaggatcacctaagcccgggaggttgaggctgctgtgagccatgatcacaccactgcactccagcctgggcaatgaagtgagaccctgtctcagagaaaaataaatgttttccaggcctgcttgtgcatgactaagaaatttcctatcaacccagccaaatttaatctagctgcagctgagttcaagaaagttaatgcagctctgatgcctctagttctctcatttctcccaggtgggtcatcacagcttctaactaagaatcttaagtcaatccgtgattcctactaaagggcagaaaagtcctttggttccttcaatgccaagtaaatatttacatgcttgagcagtcggtgtaggttggtgagccctggactcacacagatccatgtggacctcacctcactaagcctcagctttgccagccgtgaagtgggaccaatagaaataaaaatcataccttaaatgtctagatttgtgcctggcctgtattgggcactgaataaagtgtatcgaatatttcagactgtccttttgttctgtgttgagttggtacagtagtttgttgcaacaaccctggaagtcaattgatactttcacctttgagataaagaatttgttctctaatcaactagcttttccattggcccaaggtgacatttctgtctttacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccaggtatgcgcggaagggcagcaggtgggggccaagcgctctcatgggcgcagaggtgtccattttctgtttacaggtactccacggtctgctttttagaatatattgttgttgttttttttacctcaaaacaggctggccctgtttcttcctcccctttccttgtaaccctcacataaacttttgcctgagaatggagagcactgaaaatgagcattgcatacagttcaagttagcagaaagacacaaactcaagtccatttcacctggtgtccgcccttgctgatagggaaggacacacaagatacagagaaaccacaaacagcacattgctgccttgtgacctagaacgcttccccctggaagttggtgtgagtgtagtcgtgaccccagtattcatttcacacctgtgggctggtgataggaagctgtttgtgctaaaagaatactttccacataagttagcagaagtcattttacaggtagctgcaactctttcatcatttttacctttaaaaatggcgggttaaacctttcacttatggtttagcccaggagttcaaggatgtagtgtgcactgactgtgcctgtgaaaagctactgcactctagcctgggcaacataatgaaaccctgtctttaccaaaaaaaaaaataaaatgtcacagccagttgtggtggcacacacctatagtcctagctacagttcctttcacttatggtttagcccaccataattttggggatgtttaagcgtaaatgggaatataaaaaagttaactaatcttagtgagcttatttagctttcttcttccaagtaattagttggttactataaaaaaggaagtccctgcttttagagtacctgatagcaatgatatagtaaataacctaacatagtcccttgaaagaacaaaacactatctgaactgactgcacagctaactttgtgtgaagcagtgcagcctggcttactgtgtaaagagtaacccagaaaaaccatcatgttctagttactgttttcctccttacttagcatgaatcatctttatttcttactgccaaaaagtacctgccagtgtccagtctacttcttggccatatgatgtgtcatcatctttctgagagaaagatgatgcagagtcattggagacttctctgaaacattaaaattagtcttgtcataattcccacagttgagcagacacaggtgggagttgtgacttaccaattcatattgaaaacagcagaatggaaagaaatgacttgaggttacatgatataacctgaaataagaaaggaaaatggagtttaagtatttcctgtgtgactggtttgctttgtcttcagtgatagttagaattcagccctcagtactattttatccttgagtttatctaagtgacattttaaaatgtgatccgtggagttgctgagtgacttgtaatgttatcaaaacaggtgtcatgtcttttaatatttttagtccgtttttcactcatttctgttatttctattttgtctcatcaaatccaccatcattataatattgtcatgaaactgaattatagaaatatgtttattaggtagaattgagggaagtatagaatacaaattattcgtattcatgttaaagttctgagatgtttttgtgtttagttagagcagtaattcagcaatgagtggtttcctctgcttaggctccatccctgtgtttagaattaccatagggagggcagtgggctcctggctgtcacaggctggccttagggctgtgctgatcagagctcagggctctgggcggctccagcactacatgggtagatggttttcaagaaggcctaggacaacgctgagctaaagaaaacttgaggctgggcgtggtggctcacgcctgtaatcccagcactttgggaggctgaaacgggcagatcacctgaggttgggatttgagaccagcctgaccaacatggagaaaccccgtctccactaaaaatacaaaagtagccgggcttggtggcgcatgcctgtgatcccagctacttgggaggctgaggcaggagaattgcttgaacctgggaggcaaggttgcagtgagccgagatcacaacattgcactccagcctgagcaacaagagcgaaactccgtctcaaaaaaaaaaagtcaggagtgacagacacataaaccatgtctagtaggtaatgagaggatgatggcaaaatgtggggcacgtaggaaatcctgacagccacagaaagcagtagataataggcagcgcatcacattggtgaggagctcagatcccaaatcacaaactgaattggaccccaccatgtactagctgaatagggcttattgcaattcaattcatgtctttaagtctcatttttttaagctacaaaatcaggataatgatggtcagtaccccacactgctgatcccagtcaggtgccaaagaggttatctaattaaaatgaactctacagatatgaataatcaatcaaaaacttaacacttccaggggatatttgcatctgaaagtccaggccaatatgattggtggagtgggtaggaggcattctgtagtcctgacccatttttccccttcccttggaagaagtgctgctgggagtccagtgtgaccccggcttctgtccttgtgtaaccagagctgtgagcagaagcattttctagaaagacaagtggagtcaagctctaaaggtacctttgtgtagtaagtataatattaaaaagtataaaaagcttcaaatatatgatagtgagagaaaacagccttatattgactctgctgtttttatggtttaattatttgtttgttatttgggactttctctccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcaggtctgttcttcgatggcacctgggaagtcaggggtgctgggtggaggacatggggaagatgatgtgagacagcacagctgtccaacaatgtgcagatactgggttggggagggcagttacttgggaaacttgatttaaagtaaaatgtattctgttcttaaaatgtattcatcctgtttgtatgtatttagaatcgccagccacttatgaatcaaatcagcaatgtttccaatgtgaacttgactctgaggcctggagtaccaacacaggtaaggcaacataccagccattagctttcattgtatgcatgcagctgcttttgtcatttcttcctctctgaagaaagttaacttagtagacgtggatccagatcagcacactagccctgtactgtcatctagttacctactagtgtgttatatttttcccttctaatcactgccatttttattgccaggtacagtcaattcttgttattctaagaagttgtgctacataaagttactgcaaacactgaattagagaacagccaactatcgttcctaggaggaatacagggttgggttcctgcagacctctggtcacaacattgtcatcatccagtcaacacataaccttgttttatgtgtgtttctgtttaaagaactcactgtaactcaggcctgaatggcgcttatctagcacacctgttttctccagaaggcacatcaccgcctcttgcacttaggaacactagagagcactgcagcaccatgcctgggagccagtttaagcagcaaaatcaccaacaggaaaagcaaaaaatgcaaaaatcttggcaccaaatagatcacagaggacactagtttacagtatgagagctgaaaccagaaggcaaagtgttgccttgttcaacctctgctggaagtgtgcacattgcatatctgaaatgttttaccactgtgctcatgtctacgaatgactgtgacagtggcatgtgtattgatttgggggttacaaataaattttactgagtaggcaacttcagaaatgtggaattcataaatgaggatcaacgatatcttagcagcctcatgcctctcactgacagcaagcactgggatcccttcccttcatccatcctgcctttcctccctctccaccctccacctctgactcggtctctgtgcgttcttatcaggcactctcctcgctctccccttttcctcctgcctctgctcagccttttgtgaagtgcaccacgtcaccttttgtcccagtgattttatttctctatagacttgaatgtcacttgaatgagactctaaactaccatcctcagggtttatattacagtcttcttatagaaaggactgtgttattttgagatccttcagttaattgtgtccttacaaaatgatttaattgatattagcatcaaacttaactctgctgagtcatagcaaagcttcagaataatcatatctttagaacttagaagctcatgttctcaatcactagttgttcaactctgagtcattcctttcatgtaatttttttccaaataattttacagatgatagtaccatttgctagcctctctataatactcactttgttttttaatctatgtctgtccccgacattttcctccatgtgttgccccggatttcaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggtactggacttagatccccaccacctttcaccagtcctttctccccagtgtcccccagtgttgggtcacagctcctctctcacagctctttgcatggctcccagatgaatctggctaaccagggaatgataggaaacctgggaggacagttggggcctgtgaggagtccccaagtccagcacagtaccttccaggctctcagctcaggtacctccttttctctgagtgcaggtcttactttaagaatgaccgaagtaagtgtgtgtgcatagactgtgtctatcttgtgtgcgagcgtgtatggatctatgtttatgtcaatgtctacaagttcatatatgtttatatatttgaaagcctctgagtctgactcaaacaaatcaatagatacaaaatgtaaaaagacctctataaatttaaatatagacattctgcgacttttgaaaaatactttacagattataccagatcattaatgaataggtaattcttgagaagtactgtatagaaactacagtgggagaccttttagtcctcttcatattgatttgttgtttaatgtcagtcttaagagataccaagtgtgtaatgtcatgaacattaatatttgtgtgcatgtcatgttcagttaatggttgaattattgataaagtaagtgcttacattaatgttaatattcaaaaatgactttccctaccctttgccagttatctgtaaataactgtgaagtctgttgccgaaatccaagtctcctgtttctttaaagaacagaaagataatgtgcagcctttttctatatgatcttaagcttttcttttgtagctaatttaaatattaattaaatatgcatgttttacaagtcttctatgcaaaagtgtacttaataccatcctcaaaatactctaagttgcctcctttgtttcccagctcctttctctatttccttcttgatgatttagaaaagtgtgctgaaagttctctttccttttagtttaaattctgtttgcctcgaaactgaacaagaagcatacattgaatttttttcttattcttactaatattggatagccctaaagtaccacagagctctttataaagacaaaacaagctaaccatgaatacagctatttatttttaaaggtggatccatctcatcatggaatggcttcagctaatttaatataaatttattcaaatgtgttgacttttgatatatagctgaactttaatccaatttaaatttaatttaaacaatctggccaggtgcaatggctcatgcctgtaatcccagcactttgggaggccaagaatctcttgagctcaggagttcaagaccagcctgagcaacatagtgagaccttatctctactaaaaattaaaaaaattagctgggcatggtcgtgcatgcctgtagtcccagctactcaggaagctgaggtgagaggatcctttgcgcccaggaggtcaaggctgcagtgaactatgatcacgccactgtactccagcctgggcaacagagcaagcaagaccctatgtcaaaataataataataagcttaatttaaactaattgcagtgatactttgagattttatatgtgtatatatatatatatttcttgttgatcaaaatatgtgactcattcttgatttggaaaggaatttgaagaaagaatagcattgtttctttctaactctagctatgatggttaatggttcctaggcaccatctaactactaaggggaatcagtatggagattttattttctccatattttatccgagcttggaatctttcttaaatgtatgtaattaatcagtacacaatcatatatttgaaagtaattttttatgcatgcctaatttggaatgttctttcccccccaccagtctctacaatataactaacagtctcttttggatttctgtttctgtttttttttttaaggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacaggtaaccgcaaatccttctccttttcataccgccactgtgacagctgaaggacatcccccaccttcatgcctgcacccgaggagctttctgtttgtttttatcaaacgtagtgataaaggatggcttctaggtcaccgccttccacagcaatttctatcataaattggtcggtggtaccttgttagggatgttcttgttcctccaaagaatgttccttgctaagcttttgtaaattctagtgactcctgctctaggaaaagtaaactggcttatttagaagtttgcttgatatcgcttgcatgagcaaagactttaaaaaaaaaaaaacagaaagaaagaaaggagacaggtagtctatagaaagtttccctggtgatcatttatcacagcaacacacagaattgcccccacagcttcattgaatgccacttcccctgctgtctcggcttcagcaagcccaccacctgccggctgtctcagcctgggttcatgcagttcaggtttattcactcagagtaaacgcctgagaaacaagtgccctgagctgcctgcctctggataccagcaagctgtaacattcattcaatctttccattgtattccagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggtgagtgcccaaggagaagcaacccagtggcttcatatcacggctttttttctacttctgcatcaaatatatctttccatgtatctgactttagccaccaactcccacatttactttgaggagtgtttttcacccttcacctgtgttagtgacattaataaaaatctttgttaatgattaaataaacagaaaggattcctgactgcttgaggagcttttaaaatattttgtaactttcttatcattgacatttttctcttgaggaattcaccagtatctaaaatgaatctctaaagatgaaatagtgagtgtacttttaaaatagctctatttgggggttatcgtttgggggggttttgttttgtttgatagagagtctcactctgtcacctaggctggagcgcagtggcactatcttggctcactgcaacatccgtctcccggctcaagcagtcctcccacctcagcctcctgggtagctgggattataggcacatactaccgtgcccggctagaggattatagtttaataatggatttatttctaagtgtaaaaccagatgaaaagcaaaggccaaactacctgccatccagttagtttgaaatgatccttcatttatgcaaagagaccgacacagataatccaaaaactattctttttactttggaacgtgaaggcaatgattttttaaaataattgttttgcgttgaacaacatcaaaatgattctgttcctaacttcactagatggcagagagactcaaagcatttgagatagcagtagccagcctggaatccaaaaatctgtggctgattcagaggtaaaagtagaggttaataattgtaccatggtatttacagaagatcttgtttttaaaggcccaaaatgctgaccactctaccactgatcctcagtagttcacacaagtaaaaaatatggcaagaccttgactcttatttcatataaggagaaagtgcagtatggaaagtgtaaatgacttaagcatgaaatcactgacaggtctgtgaatgtctgttagaacaagattgtgagaatggtgaaagattgaagagtttgattagatctatttaattctgttagtagaccacaatttttgtgaaaattttaagaactattacagagcttccgtgttttatttaaaacgattaataaaaatggaaagtggtacatgagaaaatttaaagccctttgcattttaagaaggttgtgtgcttgtagtaataacttacacttctgttgttgaattgatggcagttaaatgcttatttggatacattaagcagacataaagaaatacagacttttagcctggcatgttggcttgtgcctataatcccagctattcaggaggctgaagtgggaagatggcttgaagccaggaattcaagaccagtctgggcaacatagtaagactctgtctctgaaaaaaaaaaaaaaagtttaaattagctaggcatggtggcaggtgcttataattccagctacttgggaaattgaggctggaggatctattgagcccaagagtttgaggctgcagtgagctaagattgtaccactgcactccagcctgggtaacagatcaagaccctatctcttaaaatatatgcgtgtgtttatagagagatatctatgcttttatttcttcaatggagaaatgtagggttgatgttttatttcctgcaaaaatgggccactaatgactcctaatttgcttgctgaggaaaagcgtacaaagtaagggctactgagatagtctagtgtaatacgatcttagtccagtctgctcagcaatgaattgatgcatttttatttgatgtatttttaacaatccagattgttttgaaacttctgcatgattttaaaccatttgaatcccatggttaatttggaagccccaaggcacaactgcagtgtgtcttcctacaaaaatcattattctattagcatttgcaaatttactttctaatgtgtaaagaaatgtacaaatgcaaatgaatagtccatttggtcagagtaaattgacaaagtccagcactagtttgggtatttacacttgctcttgataattaataacttgcctaagtagcaaagatgtcaggaatttctcagatgacttcaaagtcccaaatgtgagtcattggtctaatttgaataagccaagaaagcatgctggttatggcacaaaaatggctctattattattaagtcaattgaatttgatttctgtacagcatgcagataaaggttaattttgaaggcagctagtatttcatgagtattttcatgttcctctagactccgcaaaatacgtacatgggagagcttgtgtaggatgaggccattgttctgcagttccttttccccgtttttacacccctaaaaacagaggaagggcggcggccacttgttttccagtgcactcttggacattctgctctgcgtagccactgtcctgtcttcttgtccttaggttaatgatcctgctctgaggggaggcaacctgttcccaaaccagctgcctggaatggatatgattaagcaggagggagacacaacacgggtaagaaagaacagtgaaatatatgaatatggaagtaaagcaaacatgaatatttgatagaccaaaactggcatagatatattgtcaaccagtagattaaagataatcgtaaaatatcttctggtttcatctggcatacagtgcttttgtgtgaatgattatttctttaagctcattttaactcagctaatggtaccatatgaattaagaacactaaatttttttttatttatttatcttttttttctgtagtcttcgtagccaacaaaagaacagtaattttgccctggaatgatactatgatagcaaaggaagaaataatgtggcaaataattagttgtgttagggcaaacttttatttttgctatttctgaattataaggctagatttttaggaggattaagaggaattaacttacattgttcactcccttaattaagtcttcttaagggttttctatatttcgttgtgtttaggaacaatctagtacattatttacattattgtgttatttgcctattacaccttaaacacttctctttttgttttgtttttttgttttgttttgttttgtttttttgagacagtgtcttgctttgttgcccaggctggaatgcagtggcacagtcttggctcactgcaacctccacctcgcgggttcaggcaactctcctgcctcagcctcttgagtagctgggattacaggcacatgccaccatgcctggctaatttttgtatttttagtagagatggggtttcaccatgttggccaggctggtcttgaactcctgacctcaggtgatccacccacctcagcctcccaaagtgctgggattataggcgtgaaccaccacacctggcctattaaacacttgttctaaagagaatgatattaccatgttcagccaatgaaactgtagaataattagtacttagacgtaattgaaatgtgtacctagcagcagatctcttgcaggaagaagtctgagcagtttggcacatagaataaatgggcctatgtggccctttaaggtaagagatattacccttcacagtaggtagctcttttttaaaaaatcctatcccatacaacctgttaagtggaagaaaatatttgcaaaccatttatccaacaagggactaatatctataatatacagagaactcaacaggaataaaacagataatcccattaaaaagtgggcaaagtttgtgaccagcctggccaacatagtgaaaccccatctttactaaaaatacaaaaattagccaggtgtggtggcacgtgcctgtagtcccaactacttgggaggctgaggtgggagaatcacttatactttggaggtggaggttgcagtgagtggagaccatgccattgcactccagcctaggtgacagagtgagactccatctcaaaaaaaaaaaaagtggacaaaggacatgaataatttctcaaaagaaaatgtacaggtggccagcagttatattaaaaatgctcagcatcagtaatcatcagagaaatacaaataaaaaccataaggagataccatcttaccccagtcagaatggctattattaaaaacacaaaaaataacagatgtcggcaagatagagtaaaaaagggaactctcatacactgttggaatgtaaactagtagagccagtatggagatttctcaaaaaactaaaaacagaattatcatttgatccaggagtcacactgctgggtttctacccaaaggaagaaaggtcagtatatcaaagggatacctgcactcttgtggttattgcagcactattcacaatagcaaagatacagaatcaacctgtgtgtccatcagtggataaaatggataaagaaaatgtggtacatatacacagtagaatactatttagccattaaaaaaatgaaatcatgtcatttgtggcaacgtagatggaactggaggtcattatcttaactgagataaggcaggcacaaaaagacaaatatctattgcatgttcttacatatgagagctagaaaatttgttcacatggaagtagagagtggaaaaatagataacagagactgagaagggtgactgtgagggcaggagaggaggaagagaagtgggtgagaggttacagacatacagttagaaggaataaatgtaatgttagcagagtagcataactatagttaaaaatgtattgcatctgggtaatggacaccctaaaaccctgtcttgatccctcactatgcattatgtaatgaaatttcatatgtacccccataaatttgaacaaataaaaataaaataaaaaatcctctcctggccaggtgcagtggctcaagcctgtaatcccaacactttcggaggctgaggcggatggatcacctgaggtcaagagtttgagactagcctggctaacatggtgaaacctcacctctactaaaaatacaaaattagccgagtgtagaagcacacgcctgtagtcccagctactcgggaggctgagataggagaattgcttgaacctgggaggcggaagttgtagtgagccgagatcatgccgttgcactccagcatgggtgacaagagcaaaactctgtctcaaaaaaaaaaaaaaaaatcctcccccagtagagacagtacaaggttgttgttcagtttcctcccaaaaaaaagtgggtatttgatgatttggttaatactagcattcaagttgagaaagtaatagcataagtttgctccagattttaacttactgtgtgcatattctccatgcggtttctcttgtttttaagaatcacagtcccgagtggcagaggtgctggctgttggtgggagtcctgtagatgttgtctgtatatacctagaggggctggtgtctttcctggtgccaatcctgttctctcctccactgagtacaggaaatgagtggccacacaactcagtcgtggcttatgtgcagaagttgaaatcaggaatgcacttcccagaagaacagtgatgttactgataattgggctcccacagaggggccattttaacccaaaagtgccagggagctcaacctctgagcgtatcatatctctatgggagaaaaatggatttgggaggccaggcttacgtctccctccctgaattcaccacagtgagattagacctccctgcctcacccttcatcatgcggctgcatgctagccacctaggccagggctccagcagagcaggtgccccgagaaagccactccgtagggtaaggccctcaaatattgcatgggccccgtctgccacccctgtctcccaagaaccccaggaattgacctgccctgccttgtgctctttcttcagctgccatgtaacctccaagaagagactcacctactataaaagcagaacactgagatggtcccacattctgccttttaaaaatttacagaaacaaccaacatgtactgagcatttactgcaagcctattctctattaaaagttttgtttagattccctcatttaaaccacaccacaactgtctggtagagctactgttttgagagtttaatgactcgatcaaggtcttacaacactgggaagtaaatccaggccggctgaccccaaatatgcattcttaacccctgcaccctcctgccacttccctaaagggaacactgagggcttgtgagatttttctaaggggttttatgcaggtaacattggagaaggccaacaatggataattttcttctttggtgccactcccttctctatttagatcttgaagggacaagaaagatattgataaacaatgtggacagacagtaaatattcagctacatttttggaagcatcctcagcctcaggcattgggattcttcatctcaggagggaggaacctcccagagcgagggaagggaatgaatcttttggcctcgaatttaccagggatagtgccaggcccttcgtaggtatttaaggttccccaccatttcagatgagactgaatctcagaggatgagataatttatgcagggctaccagctagtctgaagacttagagaactggtgacccagaccaatcaaggtagaaagtgcccggctgggggtttaggggtaggcctgcaaccagccctgtggtgcgggccacacggcaggctggcaggaccaggggttcaccttcacgtgcatcctggtggcccatgggggccctttaaacccaaaatggaaagagtagtgttaggatgtaagacatcaattttcagtaaatataggatgttctctcttcccagcaaaggcgtctttcaggtgaggcacagtgggtggcacgcttgtagtcacagctactcaggtggcttgaggccaggagttctaggctgcaatgagctatgactacacctgtgaacagccactgcactccagcctgggcgacacagcacctctctgttaccatcttgctcaggccactgataacctcgtcaactttccctgtttttttctagtccccctcttgaatctgcctcatccacctgcactttcttcatgctgattgttaaggccagagaacagtccgtcatagagactcatttgctttagagaataatctgtataggatatcccttttcattcatcagaaataaccggaagttacttggatttgtcactgtgctacttatgtgcacattgacaggggttcagtcatcatcccgtgtttccgtaataagctctgctgctgttatgaatcaaggagctttttccagaattttttttttttttgagacggactctgtgtcgaccaggctagagtgcagtggcgcgatcttagctcactgcagcctctgtctcccaggttcaagcgaatctcctgcctccacttcccaagtagctggattacaggcccatgccaccacacccagctaatttttgtatttttagtagagacagggtctcaccatgttggccaggctgctctcaaactcctgacctcaaatgatccgcctgcctcggcctcccgaagtgctgggattacaggcgtgagccactgtgccctgctcttttccagaattgttattggtaacttggttctatttgttgaacaagatactactgtcatcctttttttttttttttttttttaagacagagtctcgctttgtcgcccaggctggagtgcagtggcgcaatctcggctcactgcaagctccgcctcccaggttcatgccattctccttcctcagcctccctagtagctgggactacaggcaccctccaccacgcccggctaatttttttgtatttttagtagagacggggtttcaccgtgttagccaggatggtctcgatctcctaacctcatgatctgcctgcctcggcctcccaaagtgctgggattacaggtgtgagccactgcgcctggccctgtcatccatttttaattgactgttccatttatcttgaattggaaattataatggtaccttgctttaagcagagctagtatgtacaaccgttgacttaccaaaaatatatatttagagaagggcagttatttgacctaaccagaagattcttccttttataagaacttacagtatttctttatattttagatatatttaaatagattaaaattgagtttactgctcagcagcatggttctcttgtaattacttgtatttactagtgttatgaaaattgattactaatagggtcggcttttagttgatgatgatggtgatagtggtgatgacatttactgagcacttatgatgttccaagaactatttaaacacttcatgtgcatcattttgtttaatccttacaaccatcctagaagtattaggtacataatggaccccacccctaaagtgacacagccagggtacaccccaggcagcatgactccagaggtgtgtgcggagcacagcattctccttcatcaaactgattctggccggtggctgctcattgatgttagtccatgccagagaatactgccttacaaagtttctaagcctcagaaacgcaataggtataaatacttctccgggaggctgaggcaggagaattgctttaacctgggaggcagaggttgcagtgagccgagatcgtaccattgaactccagcctgggcaacaagagcgaaactccgtctcaaaaataaataaataaataaataaataaatacttctcagtagactttttctagactaactggaaaattgagggtttttcatattttaatcagcaccatggagtgtttttatatgaaatcataaaagtgacacaagttaggaatacatatctattcagctttatattataaagtatgctaaatgttcttctctgagaagtaaaatcacaggtattctaagctcattttttaagcttaggagaattgtgcacctgatcaggggctaatgtaattccacctttggccactagaactcatgatctggcaatactttccccagaactctctttttggagtgctaaggtaaaatagattatttggagctggcttcctctctaatcttacttaaattagataatttctaatggccctgatgggctagaattctgtgtctaaatatctaaatcccagaagcaattgttcccaaagcagacagtatttccactaaccaaactcagatcatgttgttatttgtaataatttgatttgtagcaaggtacaattataatctccagtgttgtcagccttgcctagtcgggcaatttttgtgatagcagtgaccaagaatgtcttgttgtggatatatcccagcacctagcatgtaatagatgctgaattaatatttgctaagtgaatgaaaacttttggaaggaagatagtcggtagccaaagaaaatcattgacagatatatttgcaccaaccaaagaaacaacgccacataatttgctcactataacctttggtattcagtcattcacatcatcagcacatagcagccaaaaaccagcaagaacaccccaagaggccgggtgcagtgcctcacacctgtaatcccagcattttgagaggccaaggcgggcagatcacttgaggtcaggagtttgagaccaacctggccaacatggtgaaaccccatctctactaaaaatacaaaaccccaggagtcaaaacccatcatgatctagcttgctgaagccagggagaacacacccagagaaccttgggagtatctgattagggaaaatcaggagggccattttatagaagaagggtttgtactggatgaatttgaggaagaattaggaagcagtggccccttctggatcggatgctgccaaaaagcagctgggtgaattgttctgtcatctttattgaaggtgggagaaatgaaattgagctaggatgttgttggttggagagcggtcattaaggagagattcatcatccatttgcagacgatggcctgcgagaaatagcatgtaggattcgctgggctcctccttggctcctggaagcgttgtgtggagggaggaatggcgccctctgcctgttcacctccacatcgaatgtactcatccagatgcggcctctgtgatttgctttattgaaaacagtcaggaattttgatgtttttgtggtgggctttatgatgtttttttcaaaacctcaaagatgtttcacaactttttatctgttttcctacagaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttca

SEQ ID NO: 12610 - DNA, 174029 bp, Human
  misc_feature (1)...(174029): n = A,T,C or G
gttcaagtgttgattgaattctcaaagagcgacttaaaaaggataggtgcataagaacaagataaacaatctggctctaatataaacaaggattacattacaccaaaattgttgagagaagattttgtactcagtattttattcagcagaacattttttataacaataaggttgattagagcaagctctgaaaatgcttcaagttagacagtctgattgtttatttcaaggataaaaaaataaagtggtaaaatagggggatacgaagaagtagaaattgaaaccaggacctagcgaagagtatttgacatcattttcctctctaggttgaatctcattcaggatttttccttaccccgtagggttttggctttttaaccatgagtatcttgtttttaggggcttagggccatcctagacccacagcagatttaaagtgctctgatggtgtatttgtctggtgtttcattttaaccaagtaagtagctctctgtaagatctttgtctaccttcttggtagtaccaggaagctacagggagatcacatctggcccttgcagtttagtattagttagcatgtcccctttctgacctctctgctttttggggtgggtctgctcatggaggaggctctgtaggggcagcttctgcctgctttgtttcggcgccttctattttcacaggctgagaagctggagcaagcgcgcagtgctgcaaatgagctgccgagaggcattcagccttgtcacttggcagagtagctgggttcagggtatatttggagcgggggtagggggcacaaaaagggtacatggttttgctttactgtttattcctgctcaaaggagggtgggggcaagtgaaaaagacatgtcttcatcatcgtattacttgatggtgactagaagtgcgggctgtacacagcattctcttccaaatggggattttggaaacagcgttgaggaggactgatatgcaaaagcttatggttgtgctctctgtcagccccaaatatttactgaagctgggagaagaaaaggcagactttctttttttctctcccaaacgtgtgattgtttagaactcaagtgcaacatctggaagtcagatatacagagaacaatttatggagtgtgagagatttgaaatattcagtgtcttttagtgggaactcaactttctggggctgcttttttttttttttttaacccagcacaaagcaggcaattctgagatctcctttgcctctctgaattaaaccctttgtgcctgggtcccataaacaatgtgctttttaaaggggagccccctcccagctccggcctttttctccagcgtgggcagccaatcagctgcgcagagctgcatagctggaccgctttccattctgagtagcaacaacgtactaatttgatgcacacatggatgcctcgcgcactctgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctgcaggaggaagggcgggtaggcaggagggctggaagcagccggtgctggcggcccctgtgctccaggggctgctcccgactcctccccgcacccccgcccgcctgcccgccgggacaggttggaggcgggagagagggaccgaggcagggcgggagcgcagaggctcggtccaggcgcgtgatcgctcccgggaggtcactttctaggcagcccagcctgtgcttgggcggggtggttgcttctccgaggaatcgcgtttcccagccttgtatttcaggacctaactcttcccacccctacgttcctaggcttgcccatgtaattacaattgcatttcacttttccatagcctgtggggacctctaggtagcttataaacagttgacgtgatgccactggtgcgagggagaaaaggctcccctgaagaagggacacccattcctgggggtcaggtggggaccgtgaggtgaatctgccttttggagctgggagcagcaccctagtggcctgacatagttaggacaccttcacaaatgcttgagggttacgcccttatcagtgtggagatgaaggtataggatctggtagttgttactgcctccattttaagatgacggtgatggggggcagtgggtgccattaatgagatagagacccagaaaccattgtgaggagtgtgatgcttctatgccctggagtcttactttgtaagctctttgcagactgaatttaaaatatctactctgctgctaccacttggtctctgttgctgttttaacgtttttgctttagtaattttttcttctttctctgttgttgatctctcagtctctctactgaggagtcctctctgttgttctgcgggcctcacagtttcttttgctctgtgccttggtgtttctgtctggcatgttattttatttctatattgcttctcctaagacctctgaaagcatcacttggcttgtgtatacacttcggttgggcacacgaacatattggcacatacttttctctaacccttttccttactggcaaggtgaaatgatagaactaggaaatctttaagactgacattctgtgactccgagaaattttgggctgttcctcttgttccctgttgttgccagggtctggcagggctttggaagcctcttaaggaactgaagagcccctggccagtactcgttttagaaaggtggacatgcgtgtcttcggagtgtgttcataacactctagttttccaaacgtagtagcaaggttgtttcaaaaagcacatagaatgttgtcaccacaaacttgattgcctcattatttgagacgtagaaagatcagataactgagaatctgtagatttttaaacttcacaaatgagcgcaatattaaatacctttattggacatattctgatactggttacctacatgttttccaaatggagaagactagagtttgttttaatacttccatggtatgctattgaggaaagacaataggctagagctaaaaaaattaataaatttaaaaatcaccaaataagggctctctcaccagccagactgtcacctagggaaaactagaccagaggcagtaaactatgctttagagaaataaccacaattcatccttgacaaggaaaatgcgactccaaattttggtttatcagcatttttaaaagttacctttgacataatggtcagagctcacttactgttatgatgcctggttccgggactttcagccatggaatacatgtatcttaccttggccaaaaagtcctttttcccagtcaggtaagtacctatgtgtggcctagttattctcccattgtctctctcttgcccagatgttcctatgagcagcattttttaccagcctatatttgatactatacattttgttaacttctgttcactgtgcctgattactaatttggcgaaaatagtttgcagaagcccgtggggctgcagaagaagggaggcctgatgagggaagtttttttgagcacgtgctatgtatctcagaccctgtgtcaggagctttacatgtgtcctcattttgtccttaccaaaatccagaaggtaggtggtggtagtcacattttacagatgaggaaactgaggcttataagaagttaagaaacatagccccgtttgcccagctgttaagtgacagagtggagattcggacatggtccatctgtcttcatggactacaccattttgcgtctccatgagatgagatggcagagtagccctggtgtgctgtgtttcagggcctgggtcaggggcagtctcctttacttaagtgttccccaagtgaaaggaagaaatttcattcttgaagaatgagttgatttcatttctgtctttgtgtttagtttttatactcaggtgtttagattgtacatcattcccaccccatgatatcatggggtaggagttagagatgaaatcattcaaatcttacctttggaaatacaggtcaattcccattactgtgaactccaagtctcacatcaaatattccttaaagtatgtgggctgtcagccaaagcttgaaagagcttttgttatacagacatctctgttgtgaaggtatttgttgtgatgggatttgagctgtataatgacattgctctcagaggattacagcccttagccgcttacctagagagagcaacagcccccactttattcatgttgatacctatgcatgccattattattttgcctgtttacatgtaaaataagacctcacatttactttgattcagactttgtcggcagagtacaattatcatgttttcacagggctgatatcagagcctcagaaactagaattactggaggtggtttgggttatgtgagtgaggcttttggagaggccttgattcattgccttacccgtgttgatggtcccaggcaaagagacagtcaggctgttacctaataatcctggtgaattagattttccccctcactttccatttcatcttctgtttagtcgtgagacacaaagacttggtcatacttgtgaaatcatcctttcagggttcgagcctgagatacctatattctcactgtaggggcatgtattgaccaagcaggctgagtaactctggggactctggctcagtaaactctctcccacatgaggactttggaaaagtgtgttttattcagggttcatctgtttggtctgtagatggtgagcaataccacagagagttaagaacatggcttctgaaattggagaaccctaaatttaatttctggctctactgcttctttgctacgggccttgggcatgttacttaatcacatcttaaagtggaggcagtccttgtagtgttgctgtgtgatgaggtgatgtgctctccacagagctaggatacagtaggagctggttatggcagtcatgatgatcatagttgttgttattatctccatcaatgtctccaagaacgtaaactctaaaagggacaagaaggcaggtccacaggtaactctcatacaaaagaacatgagctaagagtaaatgagtaagaaagagatgggcttactggaaccatggaagttgagcgaggaaatgaataagtcgcagcttatgggagatgaaaaagatggcatctttaccaaatcttgaaaacagtcttaggatttcagtaaataatgatggtgaacattacaaatggatggactggcctgcttcaggcatgcaggtgcggaagtgcagggcaatttctgggaactgtgaattctcccacagttcagaggaaatgggaaatacgtgacatgaagtagaggaagggaaggccacaaagcctagagctataggctagagcagctcttagcaagccttccttcccaggctgaaggatttaaaattcctttgttagactctcgagactctaggaatattttagcaacaagaggctcagaggctgatgcagtgtgttgacgtgtgttgaggtcaggatgtcgtctgtcatgggaatggaaggggaggctgagggacagacggacagtggaaggaagaggacttgataactaaattgggctcagtgaagaccaggaggctttggcttaactgggaggattgtgagcacagtcagcagtggtgggaatggaggagaagagcattaagttcagttttgattgagttgagtctgcagtgtcacagaagagtcaagaaggatgcaggccaagaaaaaccatgggatttggtgactgggaggacccaagagtatttcagaagaaggatagaggttgtggggaaaggaaatgcatggatgtatacatggtgctgagtgtagatgtgcctttctagtagtctggcatgaagggagaggaagcttagacatgcagtttgtttgttcagcaaatgataagttgtacagcaaaggagattgtcaaagtgtaaggtagagatgactctgcctcaggtctgtgaaagagtggaaagatacttcatttgagacagaggggcattcaggaaggagtaacaacacaaagtttcagaaataggagacacttcgtacaagcgcctgccctcagacttctcagtaaataggaaatttctgaagtcccaatgaattgaagacttaaaaggaatggaaaaggtttgaaatgactgctttgggaaattgaatggaaagagtggtaaaactgttgaagagcagggagaggccggtcacacttagatcatgtccatctggagtgggccctgatggttgtggactgtttatccctgagtgaggaaagatacagagtcatagagaacccagagttggagatgttcaagaaggcatcgtagaaggccaggaagggtagcagatatgctaggaagttctctcggaggtctgaagtaaggaagccggcaatgctgaaagacagctcctggtccaggaggtggaggaggaggagttgaagggttggcagttgatgttcaatgggagaagttggcagatatggaaagtgtgttcaagcgagaccatacttggaacctagaatcagtagataaattatgtgctttggatcatcgctctcgtaatgtgttagttaatcaaagttacaatcccaaatcatagcactctgagaaagcgtgttctataatgaacactttacatttttctaaacttaaatggttaggtactgtcattctgattttatggaagtgaaaaccgagtgatagattaaaatcacttggcatttgagattagaaggtaggaacagcacctcagtcctaaccaaatgtcttgttgatcacattttactggtctcttttggcaacttctcagctcaaagagaaatagaaaagggaagtggcttttgttgactatcactacgtaccaaaggaaaaaacttccttttttcttgcagtatgttgggaggtcatggcataactgctgtgcaactgcatcgcaacagtactgcaagccagagctttctggatggatcagaaattgtattcatggcttctttgggaagagttattaccttaagtttcacaagagcagcttttgtgtgggttagatgctcttgctgtttcagcctcgtcttggtcaggctgcagtgagggttacactggggctggcccgactgatcttcgaataggatgatgagttgtttctttccatcttaaaggctttacttcagccttcaggaagtcgttagtaaaatcttagtttgtctcaatctctctctagttcagtacaatggaaaagtttcttgagaatcagaccagactgctggggaatgaacaggaagaaggaaacaggaacagaagcataaagacaccaaagactaactttacttatttcagaattggcccgaaggtagccctaaatccagaagtttcttctgtgccatggtagagtgagggtaggccctggggaagaggacttagtactggtacttatcatgaccagctcatgcagagaatgagccttgctttctttatccatgcagtagaaataatacccacttcacaagttgctttacatattcactaaggtaacaaatgtgtgagtgctgctggcatggtctaaagcgggttgatcatcttacaaaccatttgtttcttctttaaaatgttaaaggtttgtaaggaatgcctttggccgctttatggaggactggagtggggagggtcattttcatgtttcatgcctttcctttcttcctaaaaacatgtccgaaagttcacttaagtaatagaagtggacctgggagcccgtttatttaagcaatgttatcttgaaatcaggaattgagaaagaattcaaactgcaggaagatgaacctacactacattttaacgcatgcaagtagggaatgggatttctgtcctacatttcttgaaaagcagggttgctgccctagattttctgggacagccccagttttggtgctgcctcagtggcccacaggaagggcatctcatcctgaattaatgttatgttaacagaaggctctgtgttacttactgtgacatcctttcattgttggctgaccgacgacctatgggacaaacataaaatgcagtcagaatttttagattcatgcaagcggaggatccttgtcacatctttgtgaaaggtggcttcactgcctacatcatacagctatattaaaagatataacaattcattttatgaaatgcaattttaaaatatttttactgatactgactctagccattgtgctgattgagataaagccagggacaaaggttaaataagcctcctttaagttacaggaagaaggaatccctttaaatgccccatactctggtgatgccgagactgtgcccgtcggtcacagtgctgaatttctgtgacttctatcaaagggcagcgtctgccctggcagataatacctatcatgggtacgttttgatccttatatctctggagagaaaaggaggaagaaggggaaggagggagacaaaaaagaccgacagagcgagctaatatcaaagaagaaaagaaattactcctggccgcttttaaccattttgttttcttctcttctgtctggggcattaagacttcagctagtccccagtcgtcttttccccagtagctttgcttttctggaattaaagtagcagaagaataaagaaaacaggcgctggatgaaaggagaacagacttctttggtagaaatgtgacatgaaaagaaaacccagggtttctaggcttctgtttcaatccctccagcacgtattgcaggtagattgaaaaagtgaagtctaggtgatctcacaatttgcatttgccactgagtgcatgtctaggctgcctgtctaggctgcctgtctagaagcctcacttgcctttttatttgcagccagcaagaaagagatagctccccactagagatgtcttaccatcagtcacccagttgtaccactctgggctaccataccgtgggggcattaggcaaccagtcctttggaggggacaagtccagtttcctggccagaaggagaggtgttgtcaacagggtgacgctgttagttactctgaaactcacacacattgcctcagagctgccttagcgtgacctacctgcctttccttgctttcgctccagagaccccagataatcaggcattcgggttgaaaggtttacttgctgcctccttcacactctgcttctaatgaaagtttaaaattaaccatagttaagttgtattttagaagtgttcagaattctagcattaattaaaaaatcatgacataccttttgaagaagtttattatcttgaataattccaaccatggtgaaacgtgaaacaccactagcataattagtactgctttttgtatcttatgttagtagattcttaaaagactgaattttcatccttggacatacagccccagattctaacctcatcataatttcactgattctgaggccatccattctcctgcttcattatctaatattgggtgggccaaaccttttacgagaacagctcacaggcatgccagagcgtacagccatgaataagtacagaataatcattatgatcttcgaaaccattggaacctaagaagggctggaaagataattgaccaaaagggaaaaagtggaaactaggctaaaataagatgatttagcgacagattgacataggtttatatattctgaaaatagaaatgatgacgataatgtgttgggttctgagacagtcgggagaattgaagatgttccgacccatactgagaaattccgtggggaatcagtcagacatgaggttatctgagtgatgtatattaggtataatactaaggaaatttgtagtgaactagagctcttacctatgttaaagaatcaaggtcttcaaatatgtcttcaaatgtttctacatttgccttgatgagtctttgttacagagaaaggaatgcaggaaaaaaaggcatgtgtgagctggtggattatgctgtacaggaatttgtcaaagcctgaatcacatagacaaacacacacacacaaatggcaagcagagaagaaagttttgctgtaaatggaaaaaggggctagttagctacactggggaatgctgtaatggtaaagccaatgggtcagacagtggagatggccttggaaacactgcaggaattggtattttggatcagtattcttttcattctctatgtaagtgacagacatgtttctaatccagtatccacattcaggtattaattcacattggagaaacccataagatacactctggacagtgatcagtttgaagaataaaggaatataatttctctatttctactggaagatcataaataggaattagggagaagaattaaagggctgagagaatatttactcaccacactatttaactgacccaccatctgatcattataaaatatgttgggctttattgcttatgtaggacaaattctgcagctttacccgcatgtgggtcaaaacctgtctctttatagtagtcttccagctttgtctgcatttactaagttcatgaattgctgctattttgttgcctttttagcttttggggaaaaaatccttcccaaactactatagtttaatgggaactgcatcctagtcaagtaaagaaataacgcaaacatcagggagggggaggagcagaggaaacaaggccttactcagaattgctatcaattttaatacctccctactaaacattctgtgtaggggatgccttagtaatctgaattttttagaaaggggtgttttttagagagggatatttatgaaagctagtattaacatgtttaaagtctgcccccccgccccaaatgctaaacgttcccagtgatgcaccagacaccaagtgttacggaacaggtaatccaccacttttcacagaaagctttttagctcctaactaggccactgtacctgatattgggaaacgtttttgaaggatatcaaggagatggaggagttccaagggagagcagcatgaatcgcaaaggtccgggaaggtgagcccacatggaaaggtctaggaggttaacttaaaagacctcagagcattgagtcatgagattgaaaagggggaaaggctgtagcaagacattaaaaggagggattgtgttctcaaaaaaaagagagaatatgattgaagttttgaagacgctaaagtgcagagtgaagctatatatagataagttctttcaattaatgctaaaccctgggatactgctgctgatgtttaaaatgttggaacagcaggcaacatgtagagtttgagccaaacttttacagagacgaggtggtgaacttagagcatgttacaaaagttaaggagatggtggggcagctcacccagcagtccccaggagggggcctccggtcagctctcacataggcttaatgcagagcccttttgtaacaatgagttgaggttagggtacccttcaaagccctgggaccgttttaatgttgaactgaatatagaacagaaacgatgaaaaatgtggtgccggcagctgacacagtgtttaccaaagcaccagtcatgtggcagtagatgcttctgggtgcctactgtgtgcaaggcatcattctcagtgctgagaacataaagatgagcaagccatgttctttgccccagaaggagagaaagaattgtctgtagtaaagagaggagagccacaattacctcgaaatgtaaaaccagtttcgggttagccatgtccgttgcacacatgcatgcatgtgtgttcttgtgcgcgtgtgttttctgtttagcagagaatgcgctagagagcgtgatcatcctgtgctattcatataataaagatgaagtgagagaacattagaggaaccaaggccatgtgatggtacacgtctgacgttttttcctttcggttacatgcccgtatctcctctttcccctttttcccctttgtcttcatttggttcccctccctatagggagtttaggacaagaagaggctaaagtttcactgatgagcctttctgagggttctccattaaatccaaggacagaaaatgtacagtcctcttattagcataacgaagccatcagcattgcatcaagcgggtcctcgtacccttttccttgtaatggtgtttggtgtagggtcctgaggaagagctgccagcccctacctgatggatcaaaatccccttggcaccaaagagtgactgatagtgttaaccatcacaggagacatgtatgtatgtgtgtggaactctgacgtgtattttaaactttgcaatagcccaaagttaatttgtttctttgccatttgttttcgaatgggtgtggcattgcttataaaatgttgaatgtaagttgcctaggacagcgcctggcatatggtggaaactgaataaaggctgctaggtagtgtagactagatggactagaaaacagtacagatgcagatgctttcagatgttctctctgccacagagagacctttctgtgtgctttgttcaaagttgacagtgtgagtaaactaccatcaacaaggcgttacttttgggtaattttttcaatgtttatcccagttccttcatccgcttttacatagcctcttgtactgcaagctacactcagttttgaagatggtgggttagcgttagagtggtgttctgtggccagtggaggaggaagcttgctcactttaatgcagaatgtctaagcatcctgcgctaaccattggcaggaaggttatttcagtgagacgctggttccttctcacccctgcacccttcctggaatcaccactggttgcagaagcctatatagggtggctcatttggacgaagtattgttaaggtggttattagaagactcgcaacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaagagaaaattaggttattaaaaggaggatatgaaccaaaatgttggcatgaattaagaaaaatcagtgaagaaatgttgcttaatttgtacacttccctgcagtgctggaaatggacttttcctttgcatttccatgagtcagggagaaaacagaccagcctggtttcacgttccagacagcatgaagtacctcaacagcaaagaaggaaataggggccttagtttttaaatcctctgtaagatagtcaaggcttctccagtagaaagttaggttttgtaataagggaccattttgtcctttctgttcaggattcaacaattgcttgttgatttggggtgaagatgccatgaactcaggagcgggtgaggagggcctttctctgcctcccattcccaaagcattctccctaaccccatggtggaggctgcggagagtgttgtaggcagttgcagtgcccgtcactctctgggtgaagccagtatgtcctggtggtggccttagaagacagcccctgtgaggctcagtaagccgcagcctagattggaacagcgtgactgcctggtaggataaaggagacgacatctgaaaagagggtttcaggtgtttgcaaagaggtcagatccctacacatgaaacgctgcggccacagctgcagccatgctacctgccacatgccctggcctgcgtcagcgttatggagtaggcaacctggttcggcgcaaagaggaaatgcgcgttctgtgcccagtcctcgctcccctttgccaaccgggctgctgagtgtgatgctccctttgtgaagtggacatctgtctaatgggaactggacggtgaccaccagtccgttttacacaggccaccatacagctgccaggtggcgctggctcttagctgttctgcaagtccagcacagggtgtattcagctctagaggtggcaaacacggggcccttccaccaggcccactccctgcaaaggaagtgcttccgagagccaaggctttgctctaatctctgtgaaggaagaaaaagacttggggaaaggtaatgaataaattaaagacacacttttgtaatcgtatattttaggctttcctctctacctaattgtgctctaatctgtacttaggagtatagttttttaagtgggacatgtcaggcttttatgccacagattaaactccaaggcaaataaatgtgtgacagcttaagaggcgaaaagaagagtcttcgtcaaatggcagagtttgattgtttaacctagactaatcagtctttggagggcctgccacatgtcttccagacggctagaatgctcaggagataagagtggggcctatcgctctgtggctttctccccctgcattagccgcagagctgagtgagtctatgaaaacccattggtcgggctgccctagcaacacagaatgctgtgctgacacatactccatcacatgtttgcgatgaaaatgctgtatttttagaacacttcaaagtcaggaaaccgttaaaccacactgcatcctctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgttaaaaaaaaaaaatcaaagctccacgcacactttgaaaatcttttagaatttatgacgcttattttcttaagtatctttatgcaaataaagatcagaagtcctttgagtttacatcgcttgctgaaggactgtatcttgtgtgtctctgaaatttgcgtgcctagctcggtgcctgacatggaatagccattgaaaagtagctgcagattgaacgaatgaagtaaatgctacctctctctgatccaccactaacttacccatttttacagttactattctgtggagcagagacatgcttgtattcattcttaggacatgtgttgagaaccctacgtgccaggcagtgtgccgcatcccaggaatacaaagatgactactggggcatgatggaatggagtgaggaacatgagggtatgtgtgtgcgtgtgcctgtgttggggagagagcctgtgacagtcttcttttctttcccccctgaaggctctgtgatcctataaaggttaagaacaactgcattgtacaaacagggggaaggagggtcagagttgtccagctcgtatagagtgttgccaggtgcatgctgaaaatcaggtcttaaattagcaaagcttacgtggtgtcaggtaacagtcacactcagccctagttctcaaaatagtcctaaaccaaaaaatgttcactcggactcctagccccctagtcttctctgtcagcagccccaaatatataaggctgaggtgtttctaatgtgaggttctgttagcctgttggtgctcctcagtcactgggggccaaagaggaaaacataataaagagagtgaaagactttctaaattgtaaaactccatacccgtctgagccatgatgtctggttctgtgcgtttcctggtttcggtgaatctccatgtcttgcttagcttttttctaccctttggctaccagatcaaatgccactttcccagaaagcggcaacaagagtggaaggtggtgaacctaaaaggcagcatagggtggtggtcgagaacagggccttggagactgcgtgcctctccggatccctcctccaccaccgcttctgtgacctagactaagggttgacttccccacgcctctgcttcctcatctgcaggatgaacagggccgttgagcagattcagtgaggtcgtggaggcagagcagtgacaacagtgtctggactcggtaaaaccgacaccgtactcagtctcctcctgatgaggaaacccaagtccggaaacatgaagggggcccttccaggctgacgctatctcccagtgacagctctgggtatagcctgccatccgagcagatgagcctttcagtgacaggaagatcagttctcggtagtattgacaataagaataataactagtatttctctggagtactcgccatgcgctaggtcctgtactaagggctgactatacattatcttgttaaaatgtgtcctcacaataatcctgtgagattatactacttatggtgcccattttacagagaagaaaactgaaacttagcaaagtaacacatctaagtatgtggcagcatggaatgaatgaatgaatgagtttatttatttatttatttaaagaccaagtcttgctttgttgcccaggctggagtgcaatgacgcgatctcggctcactgcaagttctgcctcccaggttcaagcgattctcctgcctcagcttccctaataactgggactacaggtggctgccagtatgccctgctaatttttgtgtttttagtagaggtggggttttgccatgttggccaggctggtctcaaactcctgacctcaagtgatcagcccgccttggcctcccaaagtgctgggattacaggggtaagccaacattcctggcccagacatggaatttaaacctaaatattttgttggtagcatccccacttttaaccatgacattgtccttgttcggttccagggtttctgtagcgtggagctgggcacatctctctgcctgctgtgcttgtcaaactgacgttacctctctcatttcggaatgaatactcctctcgactgtcagttgtcattgatgtctctgtattcataccagttagcacagtgtgtggtaaccaataggtgcttaatgtttgttcaagtacactgaattattccttcaacattccttggatttcgtgctcccatgcctgagtcttgccatttcctctacctagaggtgtcatttcttcttcccagttctgatggtttctgttgtggcctttcagcatccagtgcatatgccattgcatccataatggctcttcctcctggacaccccagcagagtcatgtctcgctctgctgaaattcctgtgacgctgtatgcccctctcactgtgcacagtactttgtgccattctgcagttgcatacgcatttgtcatctctaactctaagtgtcttgccttggggctgttttagtccattggtatacattataggacctcatcgaacttagtacggtgccttaaaacagtgaagaacatttcctgatggagagaatgcaaagcattcaagataaagggacattattttcccaccagcctgtatcctgccttgttcttctttccttttcatggcacgttgacatggaacaccccgttgcattcctggttttgaatcagctgatgggcactccatggagcatgaaaaaatattgtttcagctgaagcaatggaagtaagagaatcattttagggtgtcactgtagtgtgaaaagctttgacatttaaaataaaataaggaaggagaaaaacagttcactctgtcattggagtctcttgccagcaagggctctgagccctctgagcagcgtgctcacctgaaaccccgccagacttacagatgtttcgtttggctccagtgtgaagaaccacactgcagttctcaggaacaattccattctggcaaggactgatgtaaccggggagcggggcagcaaacagaaatgacttcataggtcctatccctctctactttcctagatcccgtagtgcacactgcccttttcctttgagttttcatccatcactttattcacttagtgccaagacatacgacccttttatgaggctatgaaaactccacttagccaagtgcatgtttggaactctaagacaatgatatactttgcccctagttgtgatcctagagcttccctgaaggtcatgtgtaggtgaatggaactcttccagacttggattttcttcctttgaggacttggattataacatggaggaaaatttatttttggggatcagagaagaatttgagtcaaggataacaaagaggtatgaagagaaaatgagagtggaagttccaaaggctagtgtctctcacctctccctaccaccccatgttttaagctgccccttttaattagacattctgccagcatacagcttgtccaaaaccaaacacattatctgctctttggttggccctgttgtgttaatggaacagtcttccttcttgtcgcccaatctcagaagctcggcattattcctgactgctgcctttcctttccttcacatccaaatcctgtgaacttgagttttttaatgttcctaccgccatttgtgcattcctactgttgtcacccttggtgccacctagaatatcaaagggtcttttcaacagctcaatggagacataattgatatgcggcaaacttcacgtacttaaagtataaaatttgatacatcttaacatatgtatacacctgtgaaaccatcacaacaatcaaaataacaaacacatctctcacccctgaaagcttcctcatgcaccttggcagtcccttctgtcctggctgccccatgcctcaattactgacctactttctgttgtatgtggttaccatttcctagaatgttacataactgcagccatacagcatgtgctttcttggatctggcttcctttgctcagcctgattcatccccgtcactcattgattccttttgattgctgagtaacgtttcatagaatggaggtaccacagctcatcacctctcctcttgatgagcctttgggttgttgtcatttgctgaatattttaaacaaaaagctgctgggaacatccatgtacaagtatttgtaaagacaagtgcttttgtcgctcagctagacaccttaagagtggaatggctgtatcatatagtaggtttatatcgaacttcttaagaaaccgcctgtttgctaaagggattgtaccattttacattcctaccagcaatacctgagagtttcattccctccacattccctccaacacttggtgtaatcactattcctaattttaccccttctaatctgtgtgtagtggtatgtcattatggtcttaattttaatttgcctgatggctaacgatgctgagcatcttttgatatgtttgattcgtgtatatctatcttcaattcagatcttttgctcattttttacttgggttattgccttattgttgagttctgagagttctggatatgctctttgatcaaagtacttcactagatacacgttttgcaaatatttactgctagtttgtttcttgttatctcttaatattttttaaaaagcagtttctaattttggtgaagccttatttataaattccttcttttactgattgtgctttgggttttatatcaaagaaaacctaacccaaggtcataaaggttttttctatattttcttctagaagtgttacaggtttaggctttacattttagtctttgatctattttgagttaatttttatattcagcatgaattatttattgaagttcatctttttgcatgtggatattcaattgttccagcactatttgtcctttctccactgattgcttttgtatatgtgtcaaaaatcagttgtctgtatatgtgtcagtttatttaaagacagtctgacctgctccagtgatcttatttgtctgtctttgcatcagtattacattgcattagttactgcaactttatcacgagtcttgaagtcagatactgttagtcttccaacttcgttcctcattttcaaagttgttttggctagtctagattctttgtatctcctcgtaaattttaggatcatttgggcagtttttacaataaagtcctactacagtttctataggaaatgcattggatctgttcatcaattgggagaaatttgtcatcttagcaatattgagtcttcaaaaccatgaagtggtatatttctccacttctttaggtcttctttgatttctctcacaaatgttttgtggtttgccatgaacaggaccttgcatatccctagtcagatttatccctaggtgttttatattttccgtggtcttctaactaattttattctatttgctatttccaatcatttgtttctagcatatagaaatataattgatttttgtgtattgattatgtatcctacaaccttgctaaactcattctagtagcttttttaaagagtctgttggattttctacgtaaatggtcgtgtcatttgcacataaagacagttctacttcttttccaatctaagtcttgtcttttcttgcctgcttgcactggccaaaacgtccactatggaggtgaatagaaatagtgagagcagacattattatcatgttcttgatattagaggaagactttttctttacactgaaaagcatgatgtaatgtataggtttttcacaaatgccctttatcaaggacattgtcttgtcttcctgttttgctgagaattatcatcaggaatggatattagattttttttaatgtttttttctgagtctgttgagatgatcatatcgggttttttgtctgtttgtaaatatgacaaatcacattgtttttgtgtgttttttttaagacaggatcttgctctgttgcccatgctacagtgaactgacgcagtcacagctcactgcagcctcgaactcctgggctcaagtgatcctcttgtcttagcctcccaaagtgctggaattacaggtgcacgtcaccacacccagctatattgactgatttggatattgagccaaccttgaattgctgggataagtcttacttggtcatgatgatccccccgctgcacccactgcccccaagatggagtttcactcttgtcacccaggctagagttcaatggcacgatctcggctccccgcaacctccgcctcctggattcaagtgattctcctgcctcagcctctagagtagctgggattacagccacgcgccaacatgcttggctaattttgtatttttagtagagagggggtttctccatgttggtcaagctggtctcgaactcctgacctcaggtgatgcgcccgcctcagcctcccaaagtactgggattacaagcatgagccaccacgcctggctggtcataatgattttattggattccatttgctcaaattttgtttagaatttttacatctgtgttcgggaagaatatttttctgtagtttgtttataacttctttggctggttttggtataatggcaatcctgatctcatagaatgaattgggaagtgttctctcctcttcagtttcctggaaaattgtgtataaagttgtattatttctttagttgtttggtagaattcatcacataagttacccagacttcaagttaactatgtaagaaggtttttaactacaaattgaatttctttagtacctataggaataattaggttctatatttttctttgagtgcatttttcctttcagataatatgtccatttaccctacgtggtcaagtttattgtcataaaactgtgtataatcccttaatatccttctaatgtcttcaaaatctacacataaagacagttctacttgtcatgtctcctgatactcctggtactgttaatttgtgcctgcattcttttttccctttgtcttaaagttcccaggtttatttgtctactaaagaactagcctttggttttgttgctttttttttttttttttctatttctttggctttcactttaattgttattgcttccattcttttgcttatttggggtctaacttgcttttatttttctgacttttaagatgaaagctgaggttactgatttgaaatctttttttctccaaatgaaagtatataatggtatataattcctcctaagtaccattttacctacatccacaaattctgatatgctgtagtttcattttcattcagttgaaaatacttcctaatttctcttttgatttcttctttgacctgtgggttattcagaatgtgtcatttagtttctaaatacagattgcgcatccctaatccaaaaatccaaactttgaaatgctctaaaacctgaaatttttttcagtactgacatgatgttcaaaggaaatgttcattggagcattttggatcaggaaagggatgctcaaccagtaagtataatgcaaatattcaaaaatctgaaagcaaaaatccaatacatttacgggcccaggcattttggataaaggatctcaacctgtatttgagaggggtatgggagttttttctgttactgatctctaattaaatgtccttttggtcaagaaatataccttgtatggcttaagaactcttaaattcattgagacttgtttgatgccccataatatgacttatcttggtaaacagtccatgtgcatctcaaaagaacaggtatcctgttgttcttggactgagtgttctacaaaagtgagtttgattgagttgtgttctgcaaatcttcagtatctttactgattttctggatattaatacttgttctatcagttattgagaaaggctattgaaatctcgtgtatttgtgtatttctcctttgagttctatttttgccttatgtattttgaagttctgtttttttgatgaatagatatttagaatttttgtgttctctttgtgaattgactccttggtggttttgaaatgacctttatttctgggattatcctttgatttgaaattattatgatattagtatagccacttcagctttctttgactcctgttaaataatatatatttttacattctctctcttcacgtgtatgtatctgtctatttaaagtgcatttattgtacacagcaggtagtcggatcataatttttttgaatccactcagacaagttctaccttttaattggagtgtttagataattaacatataatgtaattgttgataaagtttggtttaggtctctaatctcactaaggtcgcccccccgccccaacctgttcttcccttttgcctcttcttattacttcaaattactttttcattttaccttctttgttggcttactagttatagctcttttttgttgttttagagtatttgttacacgtctttatcattcaagtgatagtatgcaacttcatgtatagcatgagaatctacttccatttctcccttcgcagactttatgctgttgctgtttttacattttgcttttacatgttaaaatacatccacaataccttgttacaattttgtttaattggccaaatttcttttatagatatttccatcataagaaaactatctcgcctgtttatgctcgtagttaatacttccgtgctccgttcctttgtgtagatccatatttccttctggcatcattttccttctgcctgaaggacttcttttaatatttcttgggcagccaatcatctggtggtaaatcctttcaccttttgtgtgtctttcaccttttgtgttttgccccttttttgaagtatgtatctagatctagatatatatattttttgagactgagtttcgctcttgttgcccaggttggagtgcagtggtgcaatctcagctcaccgcaacctccgcctcctgggttcaagtgattctcctgcctcagcctcccaagtagctgggattacaggcatgtgccaccacacctggctaattttgtatttttagtagagatggggtttctccatgttagtcagggtggtatcgaactcccaacctcaggtgatctgcccacctcggcctcccaaagtggcgggattacaggcgtgagtcaccacgcccagactgaagtatatttttactggctatagatttctaggtggacaggattttccttttctttcagtatgttaaagacattgcttcactgtcttctcacttgtattgtttcagatgtcatccttctccttctgtttttttttcctcagtctgcttttaacattttctctttatgtgactgggtttgagtaatttgattatgatgtgccttggtttggttttctttgtatttcttgtacttggagttcattgagatttttggacatgtgagcttacagttttcatcaaatttggaaaactttcatccctttcttttgtcagatatttttaatgtctgctttctctcaactctccttgtagactcagattacttgtatatttggccatttgaagttgccttacagctcactaatgtgtttttttcttccttttttaaagtctctgtttctctattccattttgaaacacagttcactcatcttttcttcagtgtttaatctgccgttaatcccatccagtgttttcttcatctcagacattgtagtttttaatctctagaagtccgtttcggatctttcttagatcttccaggtctctgcttgtcttgtggaacataccaaatacagcgataaataacttttttgagtccttgtctgctaattctagcatctgtatgattattttctacttctaaagtgaggcctctcctagtcctctacccaagaccgtgaattgtgagtattttcggtctggctggtaaggacaggcactattccaagcctttcatctttttggagggctctttgtctggtagtttcttcactcatgtgcattgatcatcactggatactcaagagggacctctgcagatctctttgactcctgttaaataatatatatttttacattctctctcttcacatatatgtatctttctatttaaagtgcatttattgtacacagcaggtagttggatcttaattttttttgaatccactccgacaagctctaccttttaattggagtgtttagataattaacatataatgtaatcgttgataaaatttggtttaggtctctaatctcactgagggtttttttcccctcacctgttcttcccttttgcctcttcttactactctctctctgcagctcattcctctttgctactctttacggtgaattctaatggccctcgcactctcagctcagggagtatactgggtcctgcctggtgtccagctccctgtgctgtggcctggaaactctttcaggccatgagctgttttcaggcaagaggactgtccatctaggccagaggcagaagtctgcaactcttaattatatttcctgtccctggttcttttctcacagtgccttctatttatccagaggaattccagcaccagcgatggtatgcaaacctttagtggcacacgttgactcagatacagcccagattccttggccatgctttccaggtcttccataaaccattctgttctttctcctctcattcccttcattaccttcatttccattcctacagatttgttaactggaatttctgtacttccatctctttttgttgacagcttctctttgttcaggttctccatttcctgcacatttttaacacatttgcaagttgtaaattatcttctttctgcaaactcctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttcttttaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcagtggctgggttttgtatctcttttctttaaaaaaaaaaaaaaaaaaaaaaaaaaagccattgaaatgattccacttctgagttacctggagcagtcaaattcagaaagacagaaaataggttggtggttggccaggggctggagcaggagggaacagggagtaagagtgtaagggggatggaggtttagtgtggggagatgtgagagttctggagatggacagtggttacagttgcacagcagcatcaatgtatttaatgctgctgaccttcatggacatcctggtcatgtgtacagaaaacttagaagtaaattagggtttaaatccagttccctgaggttgggcaagctgctggtcctctctgaatctgttttcttgtctgtaaatggggcctgatgtattgaaaggcacctggctcagtgcctgtaacaatggacactcatgttcatctagttctgtcccttttcagctttacagagaggcttcctacttagatggttctctctagctatggggcttggagagtaaatgggcaggagtgggagtgtgggaaggggccatgctctgttgatctcagccagttgaagctgatgcctctgtcctggtgtttataaggggctccatcacacatgtacccgtcctctattgtgtgggaggtaccccaggcaatgaaacggagaggtgtctcctggtgttgcagtggggaggagacctctggaccaggacgtgctgtggggcgtcagctaccaaccttgtggtctcgggaaagtgacctatcaagggggcatacaacagggacaccaccttgaaatctgaagtcactgagtagcaggggaggttggagcctggggcaccccatggcctgcccttgggtttcatttaactgtggcctccccaggatgttacacgtcctggcctcctccctgcagaagatgaggcttattcccagtcggcagactggacttcttcataagtgaaaaatagttacataatggttatctcattggtgtttagatttctgaacaaaacgatgatccaaaatctgagtgtggagaaacggatccccagtgaaggaggagggaggggccgtgtgcatgctcatgctgtttatcccaagcctgttttccaccctccctgccctcccatgcagaggccccgccctgtgtccactctacttcttaggaacctggcaaccccagggaattttcctgacaagtcagtgtcattttatgggttattgctgttttcccagaatagccaattagtattgagggagtgtcacctgctcttctccatgttcagccccttcctgagcacactcatcaggtttaaggagccagctgtcccacctgctcagctgtgcacccctacaggctgggatcttgtgagattcatacctactgaggagggtgcttgcgttcagtcatggttgagatggggctcttccagcacagccccaaaatacttcaagaggcgcagaggaaactcggcctcccgagtgagcatccccttgatcccagcaaggctggagggaggcagtgctgtgggtagttagttggaggaaccaagggcatggcctcttttattctagtgacattcaagggcaccagctgttttgactcccaggaagctgtttttcccatgctgagtagtctcatggcactgtgtgccaccacagtgctgcccagccctgccaccctggactgaccgatagaggggagaccacagcgtcagctgctaacatggaaggacttgattgtgcaagagctgggtttcctgggaagtcaggcaccctgctccttcacctccccataacagctgtccccatggcagtctcatgacaataacaagccagccttgctattttggaaagcagtgagggacgtggagatccgatctggacagtattcatctcctgtgtgacctgggtgagttgcccaccctcacagagttcttttcaccgagttcacatgggactcaaatgggatgccatggttttaacccctggcgtgcgttagaatcacctagaggaattgaaacagagaaataccagtgtcccaaccccaccctcaggaatttggatttaattcccctgctgggtcccaggtggcacctgaaggtattgaggtgattctaatgtgcagccgaggttgagaaggaccaagctggacgttgcgagagtgctctggtaaatttcgtttggtgttactctcattacattctccactgactttggcagtgtctgtgaattttcacatttttcatgtaaagatcttcatgactttttttcttaacattgtttccaacaactactgcaggtcatttagcaagaattagtcatggtagttcacagccctgaacccaaacacccccagatcttcagcctcgcgtggggcttccagtgacttcgtggaatgtcatcatagtccttcctttggagagctggattttctcaggcaccgtgaggatctgggccaagcttctccagggctgtcattgcttcctggttggaaaacccctaggtgccaaatgcaagaggagaaagagtgaaattaaccagctcacccatcaatagcagtctcaaaatcatagaactgggagcctgtaagaaatcacacatttctgtgaatgtgtagagaataactccaaagtttcaccgtgacaagtgcagaaattacatttaaatgagtacagaagaaaatttcgccacaaactgtgttagccaaagaaggttctgtacaatgagacgtaactgaattatgggtaagttctgtgttcctgctgatgccctccccactccgtctggggctggggctgtcttgagccagcattcctgttcattccacctgaggactccagtgtgtgggaaggaggaagagacttaaacccacctaggggccgggtgtacagcagaaggatagtacccattgaggggccaatataggtttcgtagtgagaacataataatgcaggtttaaccaaaagaatgtgatctttgaagactgtttgatcttatgcatggtttatggtattttgtaaatggaatagcttttccaagaaattcaaaaaagtgcccatatgacgcttcatgtttatagatttatgaagtattggttctcagtataacctgggaaagaggctggggaggtccggtcatcttcattttctgatgagacaactgagatttagtttaaatagtggtcacattgctaggaatttggtagttcaaggacaagacttacagtgttgaaactctcattttggtgcgtttcatgttttagaatttttcacagtatttttactttttaaaaattttttattttatatatatttttgtgacagagtctcactctgtcgccaggctggagtgtagtggcatgatctcagctcactgcaacctccacctcccaggttcaagcgattctcctgcctcagcctcctgagtagctgggactacaggcacacgccaccacacccagctaatttttgtatttttagtagagacggggtttcaccatcttggccaggatgatctcgatctcttgacctcgtgatccacctgcctcggcttcccaaagtgctgggattacaggtgtgagccaccacacccagcctatttttactttttaaattgagttttcattttgaaatgaaaaatgagaaaattcaaaatttttaaatgaaaacattggtctttgcccagtaacgaacatgtgtacacctttgcattcatacagtcccctagaaccagtaagtcctttccctgcaaagctgtcctgaacattcagggtccacacattgaccactgaagggtaggaggaaaggcaaagcaagctgcacaaagggaagatggcccgtagccttgaaatgcactcttgctagccctccccattttggttattatcagcaaagatcagtgacatgttaatatattcggctattttactgtgaatataatggtaaattttaatagaaattgagttagatagcagtttctgaatctgaaagaaagtgacattgcttgcgaatgctcacagtagcacttaacattgtgaagttcaactcaatttttatttgctgtttcacagaaagcaataatccctcatattttatagtaccatctgggttacaaaaatcccgatgcgtctttgttggacaagccaggatctcaggaaggagtggaggggagcttcatctcagtggcttctgccctgaatttgaatttttaacaggcagcttttaagcatcctgtggcactcatcccatctcagtgtagcagagacagtaatgtctttccctctatggttgagaaggagcttttgaatgcccttttggaagctgtagaaatctatgatactcatcgtcagcattcgaccatgaacttaaactcctatcacacctctaggtgtgataatatttctccttctgttacaacagagtaatgtcacacttggcacttttactgtcctcttgcgagactatcctccaagtgctgtctgagagtgttaactgctatttggctcatttttctgcaccaaggagaacagaaacacagcaggcaccaagaggaggtttagtgtgcagtgggttgttctgaaaggcagtgagtaaaatgaggtattccctgacttctgcttttgctacatgaagtcatgaggtccttgaagccagacttaggtaccgtttctttcatcccttgctagttcctaatcgtagacacaaaccttccacatccatccaggcggatggcagtgcttcttgtagaaagcaatgtcactaaggcagtgtcactaaggaaaacaggacaaggcaacagttgtgttcagagttttgactggcgtctgattggaattagaaggaagattattttgccataacctaggtaccgtgacccaagctcttttggcagaccttgacgtcacaaaccgtacgcttgctggagaagggaaaaggagagttgcagccactaagagagtcaaggctgtggcctgcctggtggtgttttataggaactggctcagggaggctgcatgtcctttgttttctgaggccttgttccacgtggcctcccacttgaggccaggaatattgcagcaatgccgaagagtgggtggacaaatagccttattattaacctaagttggaaacatggctttttgagtgtcttcattcacagatgcagtcacaaaatattaatactctttttttgaacatgacaaaacaaagtattcatttaaacctcctttgtccacgtccatggtaaaagagcacctcaggcaggggagaaaaaaaaaaaaaactggtcccttgagaattactttatcctttgcatttgcatatagtttgaattcataattaggctatttttattggctagcagctgtattatcatataaatccctgaatatgtaatttggagtcatttagaccagtcgtcccacagtaaccctgggaagcacgtgagcagcgtcagcgtctttctcgaggaagaaaatgaagatggggagtaacttgctgcaggcagcttagctcctgctgtggtggattgggtttttacgctaaagaacatagatacctgttcagtaataacttacattggcatagaattcatctattaacaggatgttttgaggccagacgtggtgactcacacctgtaatcccagcactttgggagaccaaggctggaggatcacttaagcccaggagttggcaagaccagcctgggcaatacagcgagacccccagctctgcaaaaaaaataacaaaattagccaggcatgattgttcatgccggtggtcccagctactcaggaggctgaggagggaggacagcatgggcccaggagtttgtggttatactgcactccagcctggcaacagagcaagaccctctctctttaaaaaaaacaaaacaaaacaaaacagaaccgggcgcagtggctcacacctgtaatcccagcactttgggaggccaaggcaggcagatcacgaggtcaggagttcaagaccagccagaccaacatggtgaaaccccgtctctacaaaaaaatacaaaaattagccaggcgtggtggcgcatgcgcttgtaatcccagccgctcatggggctgaggcaggagaatgacttgaacctgggaggcggaggttgcagtgagccgagatcgcaccactgcactccagcctgggcgacagagcgagactctgtctcaaaagaaaaagaaagaaagagagaaagaaagaaaggaaggaaggagaaagaaagaaagaaagaaagaaaagaaagaaagaaagaaagaaagaaagaaagaaaagaaagaaaggaaagaaagaaagaagaaagaaagaagggttcccattgttctcgcattcattgtctgcgttggttgagtctgtaggcagggtagggatgagcatcttccattttcttcattttacacggaaaagaaatctctggttgaacgtggtcagtgacttgcttcagctgggagacttgggactgaagctgccctctgtgactctgcactctgtccgtgataccagggaactggtgaatccaggagcctcccattgtgatgctcactccttctcctgtccattcatatgggtaaaaaaggttttgtggcttaagtagcatccagtttcatctcaagtttcagttcccataaaataaacagatactagggtagcaaatggtcccttattaaatgtcacaggggaaaaagagaacaaaaatcattttctgtactctccagaatacagttgagtgtcccgattgcctcatacctccagtgagaacagcagcagcatttatgggctatctcagtgagccacttttctgttaaacaatccaacacggaagtaacacaggctgtcctttgggctcccccgcctgatccgctgaacagaatctcagttctgtttgacttacacggtcggtggcagagggaggagggagaaactcttccatctttattcccaaatggggatctcattttgggtgcatgtatgcaaaatctgttctgtctcctcatgcttagtgtgctagtatatatttactgctgactgcatttctttatgaggactcttctgtagcgttttgatactgacaattttatgaaggctatttcttgatatttgtttattactcctttaaaaatgtatttttgtggcagcttcaaggcagttgcaagatagtgtatttttcaatagagaagttggattaaaacttacagcaactgtcacctggtaaccagaccccatataactgtgtcaacattaaccagtgatttattgctttaaattggaatcagctgatttgtggttccacggcttttaacgctgcaggattaatctggaacccactggtacacatgaaatagttgtattatctgctgttctaagactgatgaaatgtttaaaaggatagctgtgtaatcagtccattatctcctggtgttccagcttattctgttccgtgtggcagtgtacaatttcaaaaataattattctgctgtccttaatatgggagccgaatgcagtgactgataaaaactgcattcagcaagccctttcccaaattgggtagttctattttgttatcttctgaagggaaaacatgggttgtgatggtcagacctcctaggagtctggaagctttagagcaagccctgggaggcagaacacttaatctgttgccaacatctttttctgtttaatattttgaattttttgtttgtaggtaaacttgtttagactacactttcatgtactcatctgaacataggtagacctcttgaaaataaggatattgatgcttacagttttcttttgttctgaaagcagtcagaacatagccatagttacagaatgtgggttttaaaaagcaatctagaccagtgtccctttcttagcatcctactttgacagccagctattgaaggagacccagaagggcatggtcaagtggtttgcttcagacttgcgttctgtacaaagctcatccaaaggaaaagcgttgtagatttttttgcatagactaggtagtctctagggataattattcttgtttacaaagatgttcgtggcaatctatagactgttagtgatgttttgaggaaaacccaagactcaacatcttgtatataaaggattgcccatgaaatcacagtctgtcttcaaactgtaagtagaacatgagctttccagttaatagggaaaacataaaacaatggattttattgcagggcagtcctggccttgtatagaccaagagtagttgactttccaggtaaccatggataccttaggaggaggggttggtaggacctgagaggaggatggcatacaattgtatgactgttctctagtggcgagagattgtcaaggaagaaatgaacagttttattagaacccaagaccatgatctctgggaccaacatctttaattggagacttgttagaagccattcagttaagaagacagtatgagatgcatcaccttgtttctgcgatgttatcttctactccccgattcggttgctggttatctcttaggcctgcttttcccccctcttgaacatggagctaataactttcaaacaaatcttgagccctctaggcagacactctgttgttccttgagcccgggccatccttgctattgctacctgaccacaagtgctggaagtagatgtcacacctgcgagcagagaaggcccgcaggttgggtatggtctgtgtagagcctgaatcagaagggtctgggctggaaaggaagatggtcagatgttgccctctgccaccaccccttcccccaagtgtgccttctcttgaaaaatgtggtaaattccatgaaattcatttctagtcacagttaagagcaggccctccagactccactcagcttgtctgttatgaggaaaaagccatcaatattttaaaagctgctgagaggcaagaagttagcctcgatggctggaaattaagaattttttttattctatgcaaaatctgtccattgcttctctaaagcagcagcagggctgagggaaagcttagcctagaacagggatgtgatgaagactaataagataaaaccagtcagagtgtttaagctagaggtaacctggaagtgtcctaattggatggcctgaatttctcacccgggagttttccagagcagttaacacccagatatgccccggcattgatgtcacaaaactgggtcgtggcagggtgctccagagagtagatttcagggcagatcttccagggacagattttgttgacacgccttctggatttctagttgtggttgagaatgtatgatgtgaaaattcacccaaactttccagagttcaacttaatgagaagagaagaggtttaggggagtgtattaactctttgggcccactagaggagttttacaaatagttttcaagaaccagttcgcccacatgattttcagtctgcctacgaatttgttaggggttgcattcatatttataggtaggtatctcacattcagcctcacctttgcctccattccgtctattaatttttctttgttcccgtaccaaaatgctaaaagcctaagagcatgttcttacagcaaagatatgaattcccaaccaagggagatgaagaagtgaattggttaaatgtactgaataccagttctctgtcttttcatagcacatccctttgatatttcttatactctgcagaatgtgggcatgtgcttattttcatgaatacctggaaagcattttaaatgatggcagtgctacctgggtaccaagaggacttaaatgccacttgctggctcatgacttacccaggaacatggtgcagggtctccctcttttccttgcccagtgggcacagatctctgcaagacatttccaggtcagacttctgtgcccctctgcataggcctgcctgtcatttgatgctgctggtaggttggagaagcagtccaaggggatggagataagcctcagctactgggtcagcgttttgaaacctgctagcaaaaggaagggagaaaagattgagaaaaagaagacagaaattaacttctgtgtcattgtgggctgagtcgcaccgtacaagttgttttccctctgagcaaatgaaatttgagaattgttcatcagtgaggatgaaatgtcagatattcttgtcgggaagtatattcctctctcaaacgggtcagttttaccaagtggtttgctcaaaaaggtgttctcatcaagaaagtgtaaatgtgggtttcagtgcttcaatggctttgtctacctgacttctctacagcagttcaccaacttctaattttctgaaacgaaattctaaaacatactcactttgatcctgctagtacatttttcttgtagctgtgttgggtagtcccctgaagtgtgaggcagagatagcactgacatgggcagaattgttactgtttcacctgtattttccttgtgtgtgttttttaatctgtaggtattaggataggtttaactgtcagtattttcgcagacccaaaaatatattaggacttttaaacacagaacccttatggatattggtgggtggctttcctccatgtggtgatgcagggatccaggcttctccatcttgtcactctaccatctctttggtttttgtgtgtgtgtgtgttttgttactttttttgtcacctgtgtccattcaaaaggagaggaaagaaagtatggaggactcatatctgctctgttaaaagctctggctcttaagcagcacaggtcacttccacttgtatttctttaggaagcctttagtcacgtggcaaggggcaaatgtggtttcaccatgagctctgttccagtgttggccctgaggaaggagaggatggacttcagcagacactggtagtccctgcaacagctgtcctttgctgtgttgtttcccaggcttcctggaggataagaatcccagggaacactgccctatagatgaccaggcctttcgcctggaaagcctgagctgaggggcatggcttggctccaagaatccatgtttttgccaatgttccaggcaattatcatcttcaggaacatttgggaaatgctattgtaagaggtgattagattgtagaaaggtatttggtaccttcgttgcagttttctgctgagaatcctgtgttgtaaggaatggtggtggactcggtggtgaaacgttaactcctggcacccatgcttaactctcttcagtcttaaaatttggcctcactgcatagacaagatcatgactgtaccatgtaacactaagacatctgttcctacctgaatttttcttggagtagcagattgtttcattgagttgaccaagtttacgactcattttgacagatggtgattctatggtttatatcaactacttggaatttatcatctaatgacagctgtttaacacataggtcagcgtataagattgactagtaatgaaatcttcggggcatttttttcacctcctgtcataatgttgaatctttgggaaacctaccaccttggaaatgaaaagcttataaatatattgggtgaacagcagttgaattatttatgtgacaaaaaattctttgtcatcccaaaaagaaaggatggaaaagttgtccccgatggtttcggaagctgcagtgagatggacacagtatgtggagtatctgtggggtgagcttttcgtagcaaatttggatcctagactgccctctctgagctacccagtagtcagtcaaatgggtcaagtccttttccacagtttggaatgtgctcagggaatcaaaccgactttaatattagcctgtgacagttatattcagggagctaagacttgctctcactaacatcgaaagcgttccagcacatgttggaaaggtgtttggggtagccactgtttagacttgccttagctattgatcttcttgttatcgaatataatttagaactaacagtgagacccttagtggtgggagaatattattatcatttgttatctgcacaattaggaagcaggagagtacagcagaggctttatcctataaaccatctcgttgcctagagcattttagctccttgcagagtggtctaccacatgcctgccttcccacccccatcctcatctctctctctctctctctctctctctctctctctctctctctctctctctgtgtgtgtgtgtgtgtgtgtaatccaaacaggcattggccctacagtccaaagggctaaaaagactcagaaatccatcctcatccagtcatccagggaagaaataggagcctgcagggtgtttcttttcttttttctgaaggtttaatagaatcagtgtcattggcaatgattgagaaaaatgaaagtttttagatcaaatactactctagcgtgcatgcagcatgggaacaattgatgggcggcgtgctcttcctcagacaaaacccagtggctgctaatcagtgtgtggtgtggagagttttttgttatcctgaaatcaaggaaatattttacttttccctctgaggtgttccagagaaagattcttgatcaaagaagataaatcctcttcctacctgctaatgagtgagcagctggatttcaagcacatcacgtacaaggaccatgtgttacatttttttagtatccataatcaggtacacttatttaattttctaaaaatggaaagccaagcattctctttggttagagacatggagcggtgaagaagtaaggcagtgtttggcaagatgagtccacctaactggaatcaggccaggctttatcgggaaccagaggggcgactctgtcaagacaccccctctccatgcctccacttctttaactggaagcaagaacttaaaccagatggttaagatcttttttctgtcttccgtctggcatttaaagttgatcgctgtcaaatccagaatggacccttttcagaattacaatgtgactgaagtttgtcactttcttcccagccatccccattttgggggtcatccttcttcttttaggacatcccctcttgccccatgacccgcgttctcaccatggaaactcttatcaaacctagtggccataagattcattgatactacagcgtaaatggttgggaaacagattgcggtgttgtgtcttctgaggcatttttattttaatatgaatctgagcctccaactgaaaggatgaagctcagaggctgagtggaaagactgggggagaggacagaagaggaggggcgcagagggtttgcccacatcagccccgttttcttcttttgtcccagaatcatcgttaacattatcccctccgctttcaaaagggtcctcacttggagaatgaattatttgatcaccctggatatcaagaaacccttcatactgcccctaaaattgtacagtggaaggaagaaaagaagctaacctcttttcggtattttctttgtgccagattctgggcttggcactgtgtatacattattttactaaatggatcaaacagaatctatttcacctagccattaaacagcatctctcttaggctagaagtaactataccagagtcatttcacaggaaatgggttgagagtgttgcgtggaccatttttacccctaggaacctgaatcagaaaggctcatggaactccaagttgaaaagaaaaccatattgctataggggaagggggtgtgaaaatgctccggtgagagtcaaccccctgagtatacagtaggaacctccggtgcctggcaccacgccatgccttgtcgggggccggtggggggacccaggaagcgtaagaggtagcagccacccgcagagagctgcattccttaggagaacaggagcacggcagcggaaccacagtcagacggcagtgatctcctgcgcttgatccccgtgtgacaggaactctcaaaatgaaatccagctgctggaaaccccttggccaagaggtgcctgacacacatggtggtctgtgccccaggcttccgccggacatctcctcctccccgtcctcatcgcagcgtttaggacatcacgtcttcttgtgaagcccagtgttaactgcttttgttttttcttcctctattgttgctgagataaaggaaagtgaccaatctggttaaactcgtatagtagtgaaacctgggtgtgctccttagccgtaggttttattttaaataacaaactgttttagggattttttgcctcttgggggcatatcatagagcatacagttggggaaaattttgttgtaccctgaataagaaagtcatgaaaatgattacattaaaattgattgactatttagaggtcacgtaaatggatgttcagagtattcaaaggccatgcgaatgggtgaactctgctagttccaagtaattacttcagaaagcaagacaacacaatcaattctaagccctattaaagggctcgtggtcatcacttagaaaagcggcttccctaccagggaagcacagcggcagcgcagcctgcggcaggcctgtcgcggctgcatttccgtattgcatttgttataaaagtggagtaaagctacctatcccttacctgcctcaaagggagcctgcatagtgtctgttagggctcagcgctctatggagaaacatgttaaatttaaagtggacaatagctgctaacatttactaagcactcttatttacatgccaggaactgtgttaaacattttcatacgttgtttggcttaatgtgatacatctataatatagctgtcactaaccccatgttattaagaaccagaggcttagggaggtgaggtcatcagcttgtgatgctaatcaggaatgactgtaccagcctcactgcaaggattatgaatgggcatgagaagactatccagcatcactttgaaaactgtcatggtatctgccatgagaactcagggaccaccttggccccaaaagtgaatttcttaaatgatttccgctgttccaggcagtatggagaaatatctctgtctctgatctccgtacacatgaaatgcgactcagctattgccggagtggggtgaagacagttataacggccataaatattagttctccagcatcatatccaacaagaaaaaacaatctacaataagtacaaatgtttacttcagcctagccttggatttctatagccaaagggtttgcctctccatttcactttgactgtaaagaccagagtgaggaagtagattatgacgtccttattccatttccagaaaaaataacctttgttctgctttggattgcaaataacccttttgagagttcagaggcacctagaacccttgagtaataagttagaataccactgataggtgctcaggaacagagctgagctgtgttttattcaggctaacaataaggggcctgcattcttagtccagggaattcaagctgatgcatcgtcaaagcaaggcagtgaagtggagacttgagagatcggcctggcctggaagcatctaatagcccagcttgctgtgaattgagaatcgtaggaaaatagatgtgattctaacctacctctcattgccactagcctcctaattataatgctatcctatcctctacagaatctatactatgaaataaccttatattagaaactttcttctaatgaggtccctcagtactttagaaactaaatccttcttaattggattcaagacagaactaccttacacctaccgcgtttaaccccgtgatgcctccttggtgtatgggaagtgatcttggtttggttagcctgaaggcctgcctgctgctgagccactggtctctacctcaccatgagaccccagggagaccagctggccagggagttgagccaattaacgtccactttagggaagccagaccctctagttggcttgttacattcaacctgaagtttttcattcttccttaccttcagagaaaaatatggttctgctcactactttggaattaggttttgaaaaatacaaagcgtgataaattctatggctagcttattatctttcattcctatagtcaagtgacgttttctctaacaaagaagactccttgctttcttcacgtcaccccctgggggcctggacaaatgcacacgtcaccctacctttctgatgctcagagcagggtgggagagttcgtgaaacagctgaacacgatgattgtcccatcgggggaaaaaaggatgatgctgaaattcttccaatgctttcatagctattagacaattgaaatggtttaacataagtgtcttatttcaaagaaccagagaaggggaaaagcacattccagcaattttgcccttgttaccttttctatctgtgtcgtgctttggtggaatttacataatcatgggtgaggaagtgttacagtatacacatagctgtgcatattaggctgcacttgctttcccaagaggcttgaaaatgcagtcaatttaatctaggtcaaaaggaaagaaagaaactccattttccctgcagaaaacagggagcttgctagtcttcacggggtcacggaaataacagaagatggttcctccagggaaagtccccagggcaacaggaggctgccaggggcctggatcttgtggccagttgacagacaggtggtcctagcgtgtcaaatggagagttggagggaaggtatggggttgccagggaccccagtgagatcattgttccctcccgggctgaaaaggtggctcagatttgctgtctgcgaggaatcttgcagggaaagtgaggaaggatgttggtggagcatcgcacgactgcctcaggcggccagagggcggtgcgggtcccacgctgccagtgtaagtttcccaggggaattcctgggatggcacttggtaatccaaaccgtggagtccacataactcacatacggaaggcccgatggcagcatcgcccgtcagcttcctaggcagtggccagatggtgataccgctgacatcagggtgccaattatatcaaactctataaaactaagctaattggatacggtttccttaaaagtagatttctacaggatgaggcgttcgtatttgggtagctgctactctagctatggaagtcccatttttaggtggggaaaaaagggttgtgttaggtgactgttggagagacatttcagatgagaggtttaggttataaagagacattttaggtgacatgaacagagtgtgaagcagatctttcagagtgaggtggaccctgttagaggtggttcagggacattctccctatgagaggcatagactttgaggggtgctcatcgactcgtggttgctgggatggttttggctttgctcttggctcctggtgtgacttgggggcagcctgctaacctgtagactggtgttttcccatctgtaaaatgggagggtgtggggagttaggctggtagaactagtgtagggaccaagagaaaacctccccttggccctatgaaggttcactaagagtccctgacaagaggcacatccacaggagaaaaggcacgcaggttgatgagatcacggtttctgtgacacaggcgccttcgggatgcagacccaaagatacaggggaaatggtatacttaggtccaacaaagtgtgcctaggctcatttgcatacttaggttccacaaagtatggtcagccatgtagtaatgtgattggacaaaaaggacatgacgtaacgctaacagactgagcagggacactcggcaaggcctgcctgtccgcattctccctggcctctctgagcaggattcttccttctgggtgtgggaaggaccttccctggaatgggggtcttatgacctacagtcaaacaaggtaggtcagagaatttgtttctggccagttttgtacagaatgacggaaggaaagttagagcagtatttttaagttttatggctggctttggggaaagggggttctggtttctgtgacctgctatgaggaagagagggattccagtttctgtggctgggcttaggggaggctgggactgagagacaggagggcaggagggggtcagagagaaactttttcttgtgaggcttttatgctggagtactgcttcccgactcccaacgtttgctacttgtaaaattttgtgattccacaggaaaggcaaaggcatggaagtcatgagaaggcaacgctaccttaacttcttctcattttattttttatagtgttcagtttaaaggcgtaaaaggctggaggagcagtacaacacagatatgtctgatcttcttggaggttctccctttagctaacttttgctgtgatgggtacttttttcatgcccctggttcctgtatctctcagttgatgtcattatagccatctgcgttcagcatcaaatacaggggagccacgataataaaattacaggcaggaatacgtgagagagctgagaggcaaggggactgggctttagacggagcttgtgaaatcggtggcctcatttgttcacttgtatctagcactcctagaaagcaagcactgcgtggaggtccagccacaggaattcacaccaacgggcccagagtcggtcatagtgccctgatgtgaccatttcctagcagtgccagttcttcttggtggttggattttgggctaaaaaaagggctacatgggtgaccctccaggatctcatatcatgtcctgaggcctccttgtactttctaagaatgtcattttgtcattgccttttgcctcaagatgctaggggtataaatcaccttctaccacggaaaaaggactactcttttttttttttttttaaggttaatgctaagttttcttgaaaattttaattcaggggatttttgatgggtttttttttaacctttaactgccttgtagaaagtgaaagtagggggtcctggcagggccaaagccagtgactgagagttgaaaccgtagtgcatggcagattcgcttgagcacaaaatgccccacttagatccacagcctttggactctggaaaaaaaaaaaagtattaaattcttctccaagtggctaagattgagggagaaaatagatggcaaggggaatcaagtaagaggagtgtgtcctcttttgacttaaactggcttgcatgctactgacttgacaagaagccaagatcccagttgcagttcgacttgtgtgaagcaggcacctgctttgcttgcaaatgcacatacaaaagagagcttcattcacaggaaaaaaaaatagcgggttcactaatttagccttccagggccttcgtcccttgatctgtcagccccttagaattcaaaggcagcgtgtaaaggaatttcctatttacaacatgatgacttttttgatgtcctgaattcgaatataactcgagttgaagttgtctgctagggctattgctttgttgtttaataaaaaaaagaaaaaatatatagagagctcagtcatcagatgatcagtctggggctgctttcaagtgtttatgtgcttagatttagaaaacaaagtaggttttcatatatgtaagatgtcgaatggccttgaagacgtggacaggcccgtcttgaccctggggcagagtccacttagggagggaaacagctgttctcatgcccaaccccataagctccgaaacggaaatactttttatttgaccagctttgccgcagaattgcaggaaaccatttttcagtttgtctcattagccctcaagttgtatagttattttgtattccagaaaatgctccacagttccccataagaagatattactgaagggtggtatcagaaaaagaattagcagttagaactagaactttccagaaaggtccctcctgccatggtagagaacaccttacacaggggagtttctccttgcttcaggcgggtggctgcagaagagtcatgaggaatgcctccctgaaaccagccttgctacgcggggtcagctcctgcctttggcgttgtgactcgttggcatgtgatctgaagttcctgccctgcagctgacgagccagtgtttcaataattaaaaacaactcaactcactgtcctcctgccttgaatttgatcattgcgctttgcatgtatgtatcacaataccacatgtaccccataaatatgtacaaagattatgtgtcaataaaaaacaaaaattaaaatcccaatttttaaaaagaaaacatgaaagtaatttttaaaactgcgtcagccatgctcagtggctcatgcctgtaatcgtagcactttgggaggccaaggcaggaggaccacttgagacgaggagtttgagaagcctgagctatgtagcaagacccagtctctactaaataatttaaaaattagcctggtgtagtggcacatgcctgcagtcctggatactcagcagcctacagtggagaagatgactttagctcaggagtttgaagttaaagtgaactatgattgcaccactgcactctaacctggggaacagagtgagatcctgtctcttaaaacaaaaattgctttgtccatatattagagtcaaggaatttaaagaaaaccgcctttttaaaacagtgtctcagagcatcaaaccttggtttagaaaccttggaggaagtttctttaatgagtatggtgtcagttttcttaagggcagaatgagtttaaaatctgacctcatatcattgtctagagtggtgtctacattacctccacactgaaaaatataaatacgttattgctctttgattcacagcaaaccgtgatataaactggttatctttatatatcagtacatttttttttcctgtgagtattattacccagagtttccaagtaaagattttcaagggaaacagctgtggtttgaaaaggtttgtgataatccagatggtttctttgaggataaatctacttgatcatttaaaattaaagtctttcagtacagttgagtgtttctttatgattttaaacacactactgtgtgtgagtgagtgagagtgtgtgtgtatgtgtgtgagagagagagagagagagtgtgtgtgtgtgtgtgtgtgtgtgtgtgtgtgtgtaactaccattggcctttggggctttatctttggaaacagcaaaaatctcataccagtgtctcaaattatctaacagttaagcaggcaaaatacctgagggaactcttcatgacagcagaaactattagtgaaaaaatatagcgagacaccagctaccctgtgtggagtatgtcacactcagcctctctgggaattgccactctccacttctgatccatgatggcataatcatagctcacaattataatactgattacagattgctttccaagctgaacatatgcaactgtattgctaaacttaccaatttcagggaatctgggcgtcaaaagcatccacatccctgcagcaggcccctggggaggtaggcagggtgacagctgggaaatggggaaccagggctttccatacctgtctccttctctcagtgtccaggatcttcttgctgcttcatggctgccccgagatgctccctgtgaggcccccccgggcctgccttcacagacaatgctctgtgcccctggacctttcttctgtgctttttctgtcttgtgttcctttcctaagggccctgctagatgttgacagtgaacagcagaatcacagtgatgtgttagtggccagtaagatctggtgtatttcccctctaagttacagagaatcagcacagtctttttgtagtcaacagaagaagtcatcactagtgggactgctaggctctgtatggacctaagactgtgatatttggttctgggctcacctctcccgagttttccactggacctgatggacctatgaattttaaaagtcctggtgaggagtcgtgggaggtgcttgttaaactggcacatgaagaaggatggtgtttttttgtgttttgggttttttttttttttttttttgcttcaaggaccaaagcttttattattacaatgaattgttgaggtcgctgaaacaagggatatcctgaagtcacccgggcatggaacaccatgtttgtcttttctaactaggccactgccactggcagaagctcctgaatgagtagataagcagtggcatgaatcgtcccatgcaggtgcttattagatagtgtcaaatgagcaaagtggaaataggtgaagcagcagaaattaccagcattaagcagcaatgggagggttgagacctgcagaagcacctggttcatcagactgcatcagcctgtgctgatccccagagccccctggccggtcacctctaacatggagcgaggcctctcactccactccatggacagtagggaaggtgggtttcccagaatgaattctgaagcccaagggactgtcccctctgatgcatggtgcgaccactgaccatcaaagagccagcccctgggtgttgtagatgtgtgactaccccttacaccgatgttggaaacagagcctgcaggggaggaggcttgcccctgaatcagactgctgagccatctggtgctgcagctgacctggagaggaatccagtacatttcagacctgagttacagctggcgtggggaaatctaggagacaggtggttcccttaacagctgtatatttggttagggctgacaagaaagaaaatttcatccttgttgagccttcgtggtttttcagggatctgtagtagctccttgaccttttgccataataattgtcatttcagggaaaataatgatatttctctctttgttgaaatattgtctgcaggtgggtaatctaatattttacaggagcatattaagtgataggtggataaaaagactatggttgttaactaggagaaactcatagaaagtctttcaaacacattccagtatctggaaaggtacacactacagtcctgctggggaaaaacactaattgctgtatctaagctgactgtttcaatttggaggtctgtattcatcctgcaaattttaataaaacttaaccaatcactgtacttgttaagtgaaccattatgaatgctgaacaaagcataagacttcctttagtctaatagaagtaaagaatgcttttgaccctttttcttttttggtcctgaatgaaacactttggctgcatatccacctagtttcgtggggggatattaagcagacctgctttttacttactgatgagactaggccgggcacagtagctcatgcctatagtctaagggctttgggaggccgaggtgggaggaccacttgaggccaggagtccaagaccagcctgggcaacatagtgggacccctatctctacaaaaatgtaaaaagtagtcaggcatggtagcacacacctgtactcccaggtactcagggaaggggcaggagaaccacttgagccaaggagttcaaggctgcagtgagctgtgatcacaccactgcattccagccaggacaacagagtgacatcctgtctcaaaaataaataaattttttaatgatgaaactaactaaggtactgaggaggtaagatatttccccacggtaagtcattcagaaactaaatgtgaaaaaccaaaagaagcctctggggttagtattcccagtctccttgtctgcccaggaccccacatttgtgtaagttgctaattgcacaagggtatcctactgaggccgtgaatagagtagaaatccaggctgggatgggcttatcaagccatggactgtggcaaggagctacgcccacctggagatgggatcccctcttggaatcggcacaaaggctccaggcttccctgccaaacgcggcgcctgtggagctgtgctggggctcagctcttgggtcggacagatgaacggtaaggcacattagcagtgttacctacggtatcctcctgcgtgtcacactggaactagagcttctcttggcatgatgttaaagaatacctgtttagatgagtgtacacttttaactgaaacacttaagaactatgcatagttggaagaggatctgtagtgataagtgactgacttcaccgtactagttgtaaaggcagagtggaccttggatgaaactagaaagtatttgagatcttggggatcttcccatctccccttctgtatgtttgagtcctttcttccttcctttctcctattcacctgccatcccaccctgcttagataccagcttcaatctgtccgtttctgaaaaacaaaaaccacccaccttcttttcactaagaactttgttcaagaggaagaccctttaaagtagctaaaatcacactaagctgtaataactagcaacaattaaatgtctccttcctcaagggtcatgttttagtatgtaaatagcagaaggactacaccttcctagtggactctcaggcagcgagccatggcagggattttgcttgggtgtctgaggcaggagtgctccctttatccctgagaccactgtatgttggtcaaagctctccacagctggctcacacagaagtgcacacaattcactccatttacgtcatcattgttccttgtcgcttttatcttagcgttgtttaattctctattttcattttccctgtcataccattggtcttccagaccaacctcaactcttcgttcttggctgtggcgtggccaaactggcatcggtttttcatctcctgaacttactctttcgtaatttcctttatttcagccagtaaatggctgcatccctaagtcttcttttttaaaacatctcattcccaaaagttacctgcctgaaagtatcagattctgctttttttttttttaactgtggttattaaatgaggcggtaattcagaacttccccactgcttccttatccagaagctaacgccataagcccaggacagggaaaggagaagtcactgagactgtgtttgctagaagcgtttagtaaggcttgtcctgtttttctttgtataccaagcctgatgaggcatggttggtgtttttcttctaaaaatggttactggaaactgggatgttagtttccttttggaaattattccttggcatgaagcaattcctatggcttttctggggcttacatcacgccactgaagctgaactcaccagtgaagttgatcggttcagtaaaaaatctaccatcaagaagcagagccaagtggattctggtcaaagaactcaaaatagctgaaataagatgctcgtgaaaatggtcagtctcttcaggttgattctttaaagaaatgttataatgttcagttcccttcattcaagtgatacatttgaagggttcctgatctttggatgcgtggagtttttcaaatgccaagatgctatggtcatagtctaccttgtccaaaaggcaaaggttttgtatatattgactgtcagtagactctaactaaatcaagtgtaaaatgacaaggtttcaaatttctcttccaaacgaggaagaatcttggatgtctttagaaatcttgtatgaatgagattatactttattttccccctgaaatggcagcacctctcaaagctcttctggcccctgtctggctccgtgcgttatgttcctttaataaagccaaaataaaatacatacagtcttggtgagtgcatcactttactttttttcctcaaccacttaccaaagacagcccagatcaaaggttagcatctttgtttcttaaatttcaagtttttgtcctaccctcttttcccaaactgattgtgctgagaaactatattgctgaacaaatagccaatatctttatctacaagttgaagaaggtgcaagccctcctccaggatgcagaaggaatagtctaggatttccataccgttttctttggtggaggaggttggctggaaaaaggatatatgctggcctgcgcggaagggccggggactcccacaggctctttggaaaggaggaatcaaaatgttgccagtttgtatgccacagccatatatgtaatgcatgggccagagtccactaacatctgtttgggcatgtacccatctgtattgtagcttaatttctaagccagttaaaatacagtcttccatattggcaaatgagtattgagggtcatatgtacagaactttacatcatgtaatgtggtggagataaagaagaatgcactatcccagcttttaagaagcttataatccagttgtctgaagctttgagtttagaaagtctttcaaaaacctgacgttctggagatacactttaagaaaattataattaatgtaagcttgtgctgttgttattgtgattaaatgcttctcttcacgtaggtgctataacacaggtcccattcacatctcacccattcctccaccacctcccaccctcattcttgaatagctgtattccagagaggtgaggcacagagtcaggaattgatctccaacgtgggtaaagctaataaatatgatttaggatgaaaaggtactgtgtaaatgcttgagatgttgttattgctgttctcatatgctttattatttttaaattgtgcgtccttttaagtagattgtttgttcgccacagtctccattatatctaagcaaagcattcacagaaatttctaaaaccttttcatttctctctgtaggttgttgtttcgtaacattttatacaagaaaagctgcacttgaggcccagaatgcactgcacaatattaaaactttacctggggtgagtcggtttacttttgtaccagaatcactttattgcttgaaaatggtcctttcaactgaaggttctagttatgggctcttagtgccaaaaatgactttggtcttttgaggagtgtgtgctgaccccccagttccctgcagcagccacaccagctggccagcccataaaggagcgctggcattaacactgacgggaagcattctcaaatagtgcatcccctggttagaaaatcagagtgaccccactgggcagccacggctgccaaagagtattgggtgggctaagattttaaaaggaaaaaaaaacccaacacacacaagagaagcaaatggaaaagaaaaagcttttattcaccaggagctccttttcaaattttgtctttagattttcttttgaaaggacaaaatgtaccctttacagccataatattaagcctcctaatggtttctaaacagtcaatggtggttaacaaagtcagtgttttaatacccaatttgtggcttcatgttgatataggacagaaaatacaaagcttacaatttttttctccgtttccttcccagtaatatttgatagttggcacaattcaccagaaatgaactgatgttgcatgtaggaacaccagaatacagtttttctaaaggattttgtggcacttttatgtatttcatgctattaatttcctgatgctgtttgaatgttttccccattgacccaaatatcagtgatgagttcataatgacatgcatttgttataatgaagcacctgtggtaaccagtgcaaggataatgattttattgaaacctagtttgataagaataaaagaaagataagataatgtccctaatgttttcagggtataattctacctttgtgtcttttatttgtctctgaacgcatacacaaacacctctgtgtatatacacattcacacatgcacacataaccattgaaccaccacaggcccccagaaaagatagcatttgtatgattcatcctagactcgttcacaatacaagatcgtagtggcaaaaagctcagcaaaagattttcacaacatgaggttcttcatcacccaaaagtcataaattaagaaccttgattttgaatcatactactttggtattcccctttgtatgcgaggaaatcaaagaatagaaggttcgaagaagcaagtgtgtggtcccacaatggtcctgcccagtttcactgcttctctctgaaactgctaaggtggttcttagtaaagctgtttttattgagtctaagtgcttcactcagtgactttaaaaaaattgtattattttatctgcattcttcatgtaaatggacttttttttaacacagattctaggagattgcagtgttgggtcacattgtggaatgaacaagccaaggcaaatatttactgactcagccaataatagatgaaaatcatttttatttcccaggctcctaatcaaacccaaagaccactttgtatttcttcttttaaaaacaaatgctttctagtaatgagcatgccgaatcccttctaggtgtgttttttaaaattacttgagacagtgaactgttgttaatttagcatttaaggtatagtgtagtttgatgccaagtcacatcatattttaagtgaatgcagagcttggtgaatatgtatttatccctctactagaaacacagctcccagcatgcgatcttcatagtcgagggtgcgctcaagaaacccagagtgaatatgatgaatggggcatgttgaaatgcatgaaagcgacttatgagtatgcttctgtttgggattcttacactgactcttagaaaacaacatgttttatattttttaaatattgtacgtgtgttacttcttttcttcctaaaaatcctgcatgtagaattcaggggaggtgatgttacagacccactgtcaaggacaataatttgggagctggaaaagttggtcggtggattatttttggttttctccttatctagtttcatatgcccaattacttgaggcaggttgaaggaatttgaaaagtcagatctgatttgtaaggctgatagcctttccagtgcacacacttgctacatttgctattccaaatatggtaaatgaggagagagtttcacatcttgcatttatgtacagcttcgtccagtacacattacccttaacagctataggaaaaacatgaaagtgttttccttttagctgtgtgagtctttggtggacagaaagaaatgggaccagacataaaagattaatgcatattcttggaagaaaaaatattacagggtgccttgcggtttgattacaagccttgaaattagtcaacatttccataattctaaaccaatatacacctgttttcccactgtgatgtgaaggcacaacttaatttaacagagaccctgctgtgctaaatctctcattaaataccaagtgagttcggtaatttaaagttgtacactactattttaactggttgccttcatattatgaaattaataagaaattaatgatgcactttgccatatgccttcaatttctttctgaataaaactaaaagtgataaagaaaaaatacatcaccagctgacactttaaagcttttctggttgtaatcattttcctgtggataaaatccattaaaaagtcacttgctgccttttttctaaagtgtccaaaactttcgatttaaaacaagatcaaataatgctagggttttttccgatgtaattttcttttgcagttgatgttttgtttcataaggaacttttattatgcggccaagcttgattgatgtttggagtttgctttcctctgtatgcgccatctttctttcttgagggacacaaagaacttggttagttaggaagcagaaacaagttgataggatggtctgttgtgcaatcaaatgtgtctgccataagattttgatttaaaggcaccctcctttacatgtcaggaatgaattttagaaaccctttacatggggctggagaaacgactcccagattgaggtgacagatcagggctcttacggagcagtgcaaaatcattgaagacacgtttctcaaacttgcctcttactgggtaaccaaagaagacgctctgttttacatcccctgaaattctcaacataaaccctagaaatacaatggcagtcataaaggaagcaaattcaacagctcaacacagagcaagggatgagagtctgggagtccttcccttggtttgatcacacatctcctctagaagtggttgctggatgctccagcaacagaagaaattttaggtacagtgcctcattagttactgacatttcatgagattaatcccaaatgatcatggagtgcctacagtgtgcctagctctaagctaggtattggcaggaagtagcagggatcgagcccaagggggcctctagctaatctagctggaagggtggacagtagacaggtagttaatacttacatggttcgtgctttcacgcttttctgctgcagaatacccattccaccacacacacacatccttgagatgcctagtaagtagagcctttgtagcctgaagataacactgtgagtgtatctgcacaggctgggctacctgagaagctgttggatttggtgccttgttaggctgacttttcctactgctgggccatttatggttttggactaattttggttgcacctgctttgatgatatgtcaatttggggttacagatagcatcccttcttgagggttttatctaggcacaacctaactggtagtttgttcagtagaaatgtcattatctaccattgtgtttcccagagggacatctttgtcaaggcaacttgcaagattttcattttgttttttattgagctaatttagctcaattaaaaaataaagtaaaatagagacttacctgaggcccagaaaaactaccaagatcttttcaataatcagatgtcagggccaaatatcccttgtgccggtgtcagcaccgtgctgggtgtcattctctttccaaggtcttaacacatattgtctctggtaataaggcttttggattgaaatccacagcagtatcattagagcattcactgtataaattaatttaattaaggatgtaataacagagaggaatacagttttgagaaacctcttaaattttaacagcaaggaggaagctgcggaatctaaatgtcttgtaaaatattaattgcaaatttcttccagacatcttctctgaatatgccttacccatttctttttagaatcaccaccagttttattaaatgcagtttatattaaggagttattgccctaagagaacatttgtttagagtgctccattttagcagcagcatgccaaaagatgttttacaataacccatgcaaggtgagcgaggactgccagagatctggggtagaaaaacaaatgagcctgatccaatcggaggaggcaggaagggaaatggcctcctgggacaagtgtgttcacccaggtggagtgaatgggccccttcctggcctgccctggaagagataatggaccagtgtgggtaggcaccttcctcccaagcaggcttcactctgctcgccatggagttggcctctgtgttctttcctagtggagtgctgcagtttctctcttcagcaaaaaagcttgactctcactggggccaaatttcatttgcccattttaatgcatttggaggtgttcattttctttgaaccacctctcctacttagtgataggtattaatgcctttgttctcagagccacgattatcatcattttatcattgtcatcatcattattatttttgccataaaatctctcaaacctcatctcactgtgtcagagaaatttctcctgaaaccatcccattggaatcaaagcctaactgggccaagttagagtatttttttctcacatgcctttggtttaaaattatcatggaaaacaaccgaaacatctgtatgaacaggtttgagtcctcgaagtcttgtgccatgcggggcacacaaagcgctgatgcatttctttattcggcaaccatgtattgaacgtttattgtttgccaggcactgttctagataccagggaatactgtagtagcagccatgccctttataaccaaatcaccaaaccacaaagcctgccaccatgcttacacgtggtatgtgtttagtaagtagctcttacatagtgaatgcccgaataagttagtttttataatgaaatatttccaaaggcctacagttttattttctaaaaaaagataattatgcctaaaaatatttcaaatgttccaaaatataaaatgaatgtagatacgttatcacatgtatgtgtgtttagtgatacaaattgtttcatagacacagatctatatatgtgtatgtctatatgcccataaacataccttccacacgtacacctgtggatgtcagtccaaataaatggaggaagatgaaagttaaagtcctccccgttctctgtgcagcctgctggcttagtctcaattactttgtagcgaactttcttatttgaggcttcaccaacgatctcagttccttggtgtaattataattctttgtttatgggtgctttgagtccggatcatggcagattcatggtgcgtgttagagagggtgcttgagaaatggccgtgcgatgatggtgagctctgcttcccagcatcctcacagtcaggcctgagcggggcactgcctgaggagcttcctgagccatgaggaaacatgcctcaaaaggcactgtgtctgcctcctcatttgtgtaggtgtgaactctccttgtggagcaccccagcatacaaacgtgtggaacatacacgtattccacacatgtattctgctgcggaatgtgtcagtcaggacatccatttggtgcagatgcttcagatgtacatttgcagaatttggcctgggctgagaaattcgccctcatgggactgcctaggaggagccatttccctgccatctgtgttttcagataatactcaaatctcatacaaataaaagccaaacaaacaaaataaggactttgtttctcttggagatgactttttaaggactgtgacagagagtagcagggggagctccggaggagtccttgagggtgcagaagctcccttccccctgcaggagtcacagcagtatgaaaggggtaggggcagagtgtagacccagccccaagtcgggctcagccaggtgcaacaggatggctcccagctgagcggtatagatccaggagaggatatcggaggatggaaggaaatcctgggcccagtgagttccattctgcaggcccaggccccagggcaatgggaaagtatattttaatgcttaataaaaggccattacaaattgtctatttcacccgccataaagttttacacactacctgaatagcaggttgttttggttttggctggcagtctgttgattcagtaatgttgatgggcagttatttacgtacggctttgattaaaataaaaaactagttatttttaaagcatggcctactcggtataaggaattgtacgagagaaaatgtatgaggattcttcagtggtgcaaagttgaaaatgccagcacaggattacagtagggaatagccacaccacttttggcctcagaacccagtggaaggcaatgtttagttttgcaaacaacgtagtctcagctatatccctaattaataggactgttgccagggcttgtgtgagaaagtatgttaacgcgctggtactggtgcctgatcagatttgcaaaagtgccttgtgtcattgcttgagggatactggtatctcattagtatcttgtgaggggatggtaggatggtacaatggcaaaatgaagccatagttagatttcagagataatcatttctctacgacagcccaagattaaactgggaatatgcagttcacttacgtcgaccttagttcccaaaaggttgataggatttcaaaagaagattgtgggggaggcgggggatccatgaatttgattaaaggtctgcatggaattacagaggaaggaggtgagctatgataatcaaatgatgaaaggagaagtttgatatacacctagaaaattgtccaaattctgtcattagcgtatagggtttccatgagaactcatctctgagaatatcatatctggctggacagatctttaatctttgacatcagctgagcgtaactcaggagatgatgtccaggtgaagtgcgctcgtgagttcggagcctggagctttaggccacacaaaaagcatacagcatgggtagatgtggagagagttctcccaggaacaccaaggttcttcccccacacactaggaaatagggaatggctgagctggggagagccaaggccaggatcagagggagtcagggctctgccggatatggtctggtttgtgcagggaagcgcgctggacacttacaggagggcggtgtggggagggaaagaagtttcgtctgtccctctgctcgtttcaaccataaatggtcatagcatacaggtgcctgggaagtctcattagtagtatgacataagctgttgaagttggtttgataatgaaggaatatttcaggcccgtaccctcaccactctcactgcccaccagccgcagagatgaaagaataaacagtaaacagtgcgtgtggagatcgcagaaagggacactgtgacaaaggctctctttcatggtcctcattgtccctgcctgtcattacttcccattaacactcaaaacacacatttgtgctgccatcccctcctcctccagccttaaaaacgcttgcaatgccctctgtacttgatctgcaaaacaaaaatggttggactgagtggctctttccaatcttgcaaaactcttctttgctgtccatgcattgtctgtggtcatgtcctatttaacgaaaatctctacactgtgacttaacttggttctgtgatgggttagtcattttagagtacttcacgtagacaaacgtggattattcaagctttgactataccctttgagattgtctgggcatctgctttcctctctggttgagaaccaacagggagcttagtactcataatttttccaccgggaaatggagaaaagaaagggcaaggggatggactcgaacgagtcagtttatttccttgtgtacagccctggtttgacaagaaagggtatttaacctaatgaggtttcaggatttttggtggatttttttatctatttgattcctgtcctcagctaacatgggtaagtgactcctctgtgtttgtaaatggctttatagagttgtttatttgttatcccttctaaaaatatttcaggtgatgtatcgatagcattcaccttgttacactgaggacatctctgaagtgccagagattaaattaacttctctgacctccctaagcaaagcagtgatggaactggaattagaagtcgtcatttctaggactgcccagttgggttggcctcgtggtggtggatttaggtgtcatgctcactgcattgtagggtggaatgggcgtggcttaagaggccagcacagcacaacgggaacagtcaccgtgaaggaagtagctcctctttatgggttgccatggggaggctccatggctgtggtttaattttcacaactccacaggacatctgttgtataccctgttttactgacaaggaagctgaaactcaaagaagatgagtaacttgtttggggttaaacagctggcacctgactttacaggcagttgggtagaaccagtatgtctggactctaagccaaggaactttccattctgctgtgtgttggtgcaggcttgccggtcccggcaagtggtcctggcaggtggagggcctcagaaggaccacatttgcccctttggcactgtcacaaggtaaatctaaatcctcagtcctgccccactcctgcagctcgtcatagatgtggaacagcaggaccatgacagttctggctgtgtcagatggcatggacctgctgacagggtgcagcagcatgaacctagaagtcagctgggcaggcagtggccacacaaacacacacacacacacacacacacacacacacgagctggccctgccacagcaggggcatcggggcacctggcagcggctgtgcccaaggtgggaagccatgttcccttgcacaggtcctgaaaaacattcagcgagcgaggcaaggtatttgctagagacttttgggtgtgaagttactaacacggagctttctaagaggaagtgatagatcaaagacagtcatcactgtaagaggtactgctttgcgaaagtgattataaatgcaccatctttcttcagcagcatcatcgcattgacattcatgttattagggtgcatttctttatctgcatccacaggctttcagtcccaatccacaatctgcattttaatgcccagctccgtccaactgtcctcgccattgctctgcttccgtgttccacagacaggggaagggcaagtatggaggctcaccctggaagagtgagcaggactctgttacctgcaaccccaagctttaggcagcaggacaagaggccgaggttgtgaaacaaacggaaacctcaacctgcctgccatcatcacaccctcctgccctgaaaactcctggaggcctttagaaaggaactgttctaccctgttgttttactaatgaggaagtgatggtccaagcagtcaagtctgcataaccatctaagcttctgaatctgctgctgccgacaagggaccagactcaccaccacaaaccagggcactgagaggtagaaccaggcagcccacgccacagatggcacagcaggatgaacacggccccatgagacagcgctgctgctctccgcatcacagcaaagtcaaggcaaaggaggatgggtgccaggggtgcctctgcatgaagtgctggaagcttggacattcctaggccagttaggatcaaaggctgagcactggctgcgatattagggccagttctgggttggctctgtctagccatcacattgtggtttttgctgttatctgctgttagattcggccggaatctaagggatagagatgtatcatgaggtggaagctcaggctacctctatcttagttacaacagtcagagctcatgatgtcatggtggcctctggcagcttgggttagaccaggtggttatttgccacctgtaggctggcactttctacaacactgtcacgcatcagggacgagggtaccgagtgagagcaaaggataggctcctgcaaactcatctcctctcctggaggcttaactgagtgactgtgggtcgctgggtgtattttaatctgtgacattccacactttgtgtactcaccagcacatacacggtattattgtttcctcagaagagtgtgtatttaaatacctgccaggaaactgtgcaggtatttcacattaagtagcatatggggctcagtgtagtcaagaagtcacagggattaggaaagagaaaatgaattgctgtcattctatatatgttatatgcttagtaaatgtcagaacagtagtcacagaacctcaggatgtttctagcatattttggcttataaatgttttgtctacataatggatatctatcagtagctttcagaattcaagtaattttaatgaaataacactaaatgttcaagtattaaaagtagtggtaacagttaacagctattgagtgtttactatgtcctcagaactatgccaagaactttatatatacttgatctcacataaaaaacaaataaggtagtaatttgtcttccttacctgtttgccttttcaactagaagcctattgttctacattcaagaaagtgaaagtggctacacctcttagagaacatttctttaatgatacatcagtgagtatcttttatgggtaataatctacctattttaactagatacaagtatgataagaaagagacctttcagttaactgaagctaagctcatcctgtcttccttacattgctaatatctgacttacaatttactaatatttgtaaggtgtcatttaagtaggtgtggaagcattagcctagattttgactagttctttggtgtcttctgcagctcatagaggcactataatcacaacccccacccgcgcccctcgcaaaaaaaaaaaaaaacttggaaccaccattttatcatttgagaatctcagtcactgagttaacctgaatcactcctaaggcagagttaccaagattttaaaaactctgcaggtcactgacaaaaactaagtatcatcagtaaggaaaatacttaagagagaatcaaaagcccaggaaatcctgtagctgatttcagtcggttctcgtttctttgaatgttatgtgggtcaacagaggaagaaaggacctgtgcaggaaagtaggccggatggaattatagatcacagaccctagaagcacgtcctgtccaagctcctcacttgatagatgaggaagctggagcccaggaaggtgggaggacaggtgagatgctgaaggtcacaccagtcagtgctggggtgagtacagatcacatctcctaactccgagcctgttgctcttttcagcaaaccatgcccccgtgatttctctgcaaggttatgccaagcatgtcaccttaaagaatcagaaatccagaatccaaatttccagtctgtgtgtagcatttcattccatgacttgaggctgttgaacttggtgttttctttttctcatttccattctctgggaaagacccagaaacctaataagattcttcctggccatctacccaaaatgatatgtgcagtagatgaacttataaagaaccgatgaagacaaaggaaagcggtcctttgtacttcagtccatttgcatataaaaccggggcagtgattctcagcctcagctgcacaggaatagaatccctcgggagcttttaaaactgtgtatgcccaggccacaccacagccaaataagactcacttgggatgagagtctggcatcagtattttttttttttttttgagacagtctcgctctgttggctggagtgcagtggcgcaatcttggctcactgcaacctccacctcccaggttcacatgattctcctgcctcagcctcccaagtagctgggattataggcatgtgccaccacatccagctaagttttatatttttagcagagacagggttttgccatgttagccaggctagtcttgaactcctaacctcaagtgatccacccacctcagcctctcaaagagctgggattgcaggcctgagccaccatgcccagcctagtatttttacagcttcccaaatgattccagtgtgcaggcaagttttagaacttctgttaagagaatgaaccattgttgaccccaagggctaggtggtggtgacataacttgttttcatcttccgctttcatctggatgtacaggcactgactctgacctgctcatcatcttcccacaggtacactggagtcttggtactcaagcagcagtcacgtcatctgagaaagtgttagaagtgcagccttgcaggccctcccccaggacctgcatttgaactagatccctgggtcttacacgttcacacagaaataatcatgtgaggtgacagatacgttaactagcttgattgtgatcatcatttcacagtgcgtctgtgtgtcagaacatcactctgaaaaaattaattttttttttaattgaaaatactgaatcctgggtgacatggatacatagcaaagtttgagaagtgctgttctgtagaaccggtcctctccgatgctctttccctgggagtccctcacagggtgcactgtagggcaaccccgtttgtgtgtgcacacacacttctcgcaagtgctgggttgctgtgttccctcatctgagtaccaaagtcaagagagatcctctggagaggctgccaccctccctgtttccttccagacattctgaaggtggggtggagtagggcagcctgactatggaggacaggaggtgagaaagtaaatggagatgtgaggacatgctggtttttccagcatccttgaatgagcaactgggtttttccctcccaaccatcctctaaattgtgggaaatctctgagtgggacttacatagaattaatgtgtgtcagactgtaaggggatgaatggaaatgctgctattttaagcacagtttttctggccagaacaagctaattctaaagcatgaggaacaattttctgccacaaagagttaatctgtaatactcagcagctcatttccaccttgcagaaagcatcggagtgtagagtcctgctgtttcatcattcacggactcgaaattcgttaccaggaaagcaaagcatttattaccctgtgtctcttgctatccgcagcttgagagacttttgctgacaaagaaaatgtaactaccacatgaatgctagagtggaatatactattgcctgatgagggatgctgggtctatgtatgtttttgcaatttgggaggcttaaaaagaatgtcatctgccctgaacagtgtaagatttccccttgagtgagttctgagttcttgtttttcattcttccttcttgtgaatctggagaagtttttcacattgtgggttattcctaattattgtagctacaacaaacatcctggattgtagtctgtaaggacaaaatcatttgttgctgcataaaacctgaacttaaccatggtcagcgtttgcctaaatcagcagctgctgcttattagaccagcatcaaagagtgagctgcagttgggcgaccaaataagaaacaaagtgattagaagatccttgtggaacaggaaacagagtggggcaagacaagagagagcatatacccaggggaggagacaagctagggtatcatatctgcttgatggggtgtcagccctgagcagagaaggggatccggaaggagtatgtgggctggaagataaaaaggaccagggttcctgcagaacttacagaagcacacacattgtgtccattttgctcattgcaaccaaatgattaactcttcagaaaaaaaaaaaatcctgtttacttagtttgtatatggttgctttcttttttttttttttttcccaaaaaggcaagaaacgtttagtctttgatagaggagacagctttccaaacaacgggactcaataaagacagcatgaggttaactgaacctgatcctgtctcttctctttcccctctcttctctccattttacctgcagtgcactcaaaggcaaaaaaataaaaaataaaaaaataaattaaaatctttcatcatctcaatattacataaaaattgtgttcaaaagagaaaaccaaattttacctttgcattcatgtattattagtgttaagtaccaccgccccatctttttttttattatactttaagttttagggtacatgtgcacaacgtgcaggtttgttacttatgtatacatgtgccatgttggtgtgctgcacccattaactcgtcagttaacattaggtatatctcctaatgctatccctcccctctccccccaccccacaacaggccccggtgtgtgatgttccccttcctgtgtccatgtgttctcattgttcagttcccacctatgagtgctgtctttcattctcacattcctgtactcatttctgttgtttcagtatctgattagagctgaattaatgtagtcggggctaaaaaatagcttctatctctcagtgacacatttttggagactcataagcctcattgttttctcatcagtgacaactttgtctctgagtcagatgactcgagtctccttcacccgtgatcttggggggaaaaaatagaagtgagtaactcacacagccacaggaccaagtgatcacaatcacagcatccactcattagtggaaatgagctctggactcagtccagttgacgaatggtaaaatctatggctcggaaagaagggaaagagcagtgctgaagatgtttgagttcttggggtgacctttgtagctcctcctgagatgtgccttgatgatgttgccttgatgatgttgcatggtactgatttcaaggacacaccacgctatatttttacataatctgcttcagaggagttagcccacattcatggataggagatggcccacattcatggataggagatagcccacattcatggatgggagaagaaaaatggcagagcatgctgcatatgtggcgggactgtcatgaggctgtcagagtcaattgtgccaggttcccaattcccagagcagcatcccggagtcttgtttagtcatgatcttcagcctcttgacagcatttggttagcagacactatagcttggactccttggatgtgttcataggcattttatcttgactctgttctctaaacatggcacactctgtaagtttcattgtaatgtggctattaaacatgtccactgtacattaagatttactgggaaagaaaacctacctagaattcagtaaaattctaactaatgaaagagtaaatacaccagctgttcaggcccaacactgatttttaaaagggcagattgggcctgggctacagctcagaatgttgaagaggctggattggagcagagctgagggaaaaagagaaaaagacaccttacgccatgggctttcacacacgcaggagaaacaaacgctgtctcctaagttacaggaacttgggtgtactttttcagagactgcaagtaaagggtgtgatcaaatgctgccctttaaacactgacatgccccgagttctgttttcactgctttcttctcacgccgcgtgatttctttaggtcccagtgatcccaggcttccgctacctctacaggctgctgccagccaaatgtttatctgaaaatcgggcttctctgctaaaccccagacttagatacccagtatctgctattgaacagatccattcaaatggtctacaggaaattccagtactaaaattactattaaccaggtcttcctcctgtattgcccatcttaagtgaattggtgggtcagccaaagccaaacgcaagaaatggtcttcctcatctcctcttcctacatacacttcacctttctaacccccaacctccaacagtgaagataccgggatgctaccttaatggcacctctagaattgctccgtctttatcaagttgggactcaccagttgtcattaggggtaataaaggcacagcaagggtgaggggatttgggaggttatccctgtaatccccatgcttcctagtattctagatgctctctagaatgggagaggtgggtgtgccagagttgtacatcaccccctacacccacaggcatatgtgaacattgctgcatcttgtatcagaaaaatcagatgtgactgctgagtttgaagggtgagatccacgctctatactgtgcccctacctttttcttcagcttctgggacatttttgctcatgtgctgtgtcccagctgtatgatacgagacacacatttggtgtcttatcctgggaaggtagaggtgaacattgcttcattgtaatttactgtgtcacatggttcaatttatcctgtcacctgctgttcttcattcccctccatggctgaggtctcagctgctcctgttctgagctccaaactccttgagagggaacattgtcagagcccggcttaacacctcacaccatagatagtgctcaacaaatgtttgttgaatagatgaactctgaagaacagcttttattcatagacactctttcaacataaaaaaaattcaagttctggctgggcgcggtggctcacgcctataatcccaggactttgggaggccgaggcgggtggatcacgaggtcaggagacggagaccatcctagctaacacggtgaaaccccatctctactaaaaatacaaaaaattagccagatgaggtggcgggcacctgtagtcccagctaatcgggaggttgaggcaggagaatggcgtgaaccccggggggcggagcctgcagtgagccgagatcgcgccactgcactccagcctgggtgacagtgagactccatctcaaaaaaaaaaaaaaaaaaaaaaaattcaagttctttacaaactggtgggtgggggtgagaggaggcagggagatcttgatcccctcatccccatcgcaatcctttccatcaggtagatccgccctccacagacaacaaacgcagtagagacaggaagccctgcagagttaaaaaggcactttttactctaattataatccttaactgaatgaagaagagggttgacaatccctacgtcactttacattttactgtgtactttcatatatattttcttattcagtcctcacaatgatgcagtgagttttctggtacaatccctgcttcaaacatgagtttaccaagttttaacgaggtcaagcaacttgactcacatacttggaattggcagagtcagcattcaaactcagaccttacgcttctgtgatgttctttccactaacaaaaaacaaacataaagacaaaaacaaaacagacataaagacaaaaaaaacaaagcaaacataaagaggcaagcttcgcaagtccccattaaatgctacatttccacagttgttagaaattatgaaagtagaagctatgtcaccacaggtcaagtgctgtcaataaagagttcttgctttactccttaacataaaatctctcccacatgcttgtctcacatattcctcatctgtgtttacctttgccatttcaatttcagttacgtgcggtatatctgaaggcctaatccttgaattttctctttaaaagattgaacttgaagataagcatatttatagaacaattgaaccttagtcataatttctctaagctctaccaaccagtattttccaaagttggtgaacaatctcacacattagaatagaaggtagaaatcaaaatgagtgaaattaaactcaaactcatgaagactgagcaacgctggaggagagctctttgtttagcaaaataccaagcaaagtcagtgcaactatggaagacgagatgaataaatgtagctgctgaaaacaatatctgatgtcttgctcagatgtttaatggatttgcattttaaacatgggtaataagaaatagcccttaaggcactttgtaaaacttgccatttatttttaggagagaagttttttttggggggtggggggacagccttgtttgtttaaaaggaaaaaaacagatatttaatcatttttgcttaaacgtgagtaagaatggggaattaccctagttatgttttcattcactcagtacaactcccaaaggccatggaggtaaatgaatggaaaaagattgctgagtgaggtgtggtatttatgtgtctgtcgtaaatgaagttgtcattcctaaaccaatgaaatcatacattttttatgagaggttgcaacttgcagagaggtggaaatgttagacactaattaataaacgtggctggcaaagcaactcagacaactcaggactcataaactaagctatgggaggatcgttagaatacgaaattcagtagtgcttttccattgatttcatgaaatgcccgtatcctgtcagaaggttcaagataaaatacaatcggcttaaattttccaagttagttttgaaccagagattttaaagatttgcttgttagaggggtattcttgtggtggctttagattgtcttaaagttcaaaggaaactagagattactggataagcatcaataacattaacagagcattgaagctgcctggagtggatggaggatgccttgcgttgtgcaggaaacactcatcaattctgtggtttgtttagagggtagtgttgttttaagtcatcaagtcactgtttaacttgaattgaaactagtaaatactgcagatgaattactggatagctttccaaaccttaaaaaagaaagtctacaaaagtggaacttcttggaccttttaatgagttatctgaaaagaagagaatgtggtttcattcgtatgcaatatataaggttgaaccatatgaaacggtcactattaacccatgtttttaaaaaactacaaaaacggcaatttcacagcaattacccaacctaacttgaagtatagctgtttctgtataataaatgtagaacagttagattggcaaaggaaatacgtgtgtacgtgcatgagaagggtcattgtgccgttgtgtggataaacacacagcagaagttcatggaatagggggttgcctgattccactagaagagagagtgatggaataatgcgaaataggcctgaaaagagagctgagggtcaaagcatggaattccctgaaatacatgccaaggagctggatattaatttggtagataagtcaaagtctttgagtgggggagaaaaatttctagactgagttttagacagattaaaaaggcaatggtgtagaagatggaaggcaatgaccagaactggtgaggaggctgtttcggggatccaggtgagcaggaatgaaaacctcactagggctgtagccgtggaaatagaaaagtctatgagaaggaaaagaaattaggagagagagagagagctaaactgaggatttcaaggggtagaaaattaagcaaatttagagccacgccagagtgttaggtgagaggtctgagaagctggaagagctgcccccatcccggggttgatgtccccataagccgtggtctctgtccagcttctcaagttctctgtggggtacccagattcaggtcatttcctatggggtgaggcaggagtgtggctggaagagtctgagtagtaggtcatcctgggaagcagtgtaagagatcagggtggacagagtcgagccctgcaaagaggctcagaagatccaggtgaggagacttgttcccaatttgaggccagcacatgtaccaggtcgtcaaggggagcccaggtgcaagggctgcttcagccccactagcatctccacactgggtgagggttacaagggaggctgggggtcagccactcactggcttttggggctttgttcatcccagttcccaagatgtcgagaactgagtcacagtgagccccacctgacaacagctggcactggggagggcaccgaaggctgagggagcactgaggccccaggcagcgtcacggccagagacaaatgtcacaaggatgatttgttgttaaaccacaactcgtttctcttaaaatatgagagaatactgtttgtcggtatatgttattgaaagtaatggtaaaaaccacaatcactttcgtacaaacctaatagaatctaggattggaaatgtaaatgagccaccaggtaattaaaccacgcctttagtcgcctttaatggccaggtcaggcattatcatttcagtgtgtattttgcattgctcagttgggcagcttgtctgatttagcgcctgggtaagatctggagaacatctggaagaatgagtattggagcgcccatcattgacttcggaagacagttccacaagtcagaaaggaatcatggctgagaggatgtcagtatacttcccacttagtgataagggaagattattacctttctcttaatttgagctcattaatcagtagtgattgtgatcttccgagtgtcgcacacaattctcgtggtcttttgttgtaattgtagctgtcatagtacagccttagcagcactataatcctataaggcttttcatacgttgaatctttccatttatctccattttcaaaattgttttataccctctagtttcttgctattaaaacatagatctaagcaaaggattccagacaaacctaggtataaacttttaaataaaaactagttttgctttgtatttatttgggagctcaactgactggattcattgcttcttatatcacaaaggtgcattgacataaagggaagaactaaagtattatcaaataaatttcctgttcacaataacattgctaaacacagtgacaataccttctactgagatgatagctagttgggtgccacatctaatgggaaggttaaaaaacggcatcagtttattcatctttatcactaatatagtaaaaatatttctaagaaaaattgaactaagaaaagattgccatttttttgagtagcagtgcttctgaaagcggcacactcacactttgatcatagctgttatttttcattcatggtccgtgcctcctattttaagcctattcatttttcttctaattttaacattaaataaagcaaaatgaaagcttgtgttattatttagtatgaaaacacagaacctaatcacagctaacgagtgtgataaatgctaggctgtaccttctcttgtttggtgtgtgttttatatacaggaggtaacataggctgaggaactaggatgccaagttacagatggggttgtggaatgctgtctgacagccgattagagtaatctgtcagaaatgatgacttaatcaccataacagactccaaattccctcatagaattccacccagagtaatctagttttcctgcaatattttattttattttattttttgccaggactaaatggctttgttgcttgttttttcccctttggtgtacgacgtgattttaatggaaatgtaaataggtggtatctttacagcacaaaggctgatttggagcctgataagccaaaatcagatatataatcctgggttctgcagtttttctccatcactagattattagcctgtggagttgagcactgctggctgtatatatcccaggtgaccgagaaaggccattctctccaatgtgttctcttagctttcagatgggaccttgtctccttcccctcagggaagctcctatactttgcaaaataataatgaagaggatgatgatgacaactgtagcgggcacttactgtgccatcagtgttttaagtgtgtcacacacatcatggctatcaggaaaaagttgtaatttatttccactgtagtttttttcccctggttgggagaaggggatatgagataaggatcacttctgtttctttgttgttaccaaactcaaatccacttttttttttaaactggcttagatcacttttataaaattatgtcagcaaatggtgattgaaagttttctgacaaggcacagtgggtcgtgcctgtaatctcagcactttgggaggcctaggcaggtggatcatcttaggagtttgagaccaacctggccaacatggtgaaaccccgtctctacaaaaatacaaaaaattagccaggcctggtgcaggcgcctgtaatcccagctattcgggaggctaaggcaggagaatcgcttgaaccgagaggcagaggttgcagtgagctaacgtcatgccattgcattacagcctgggcaacaagagcaaaactccatctcaaaaaaagttttttgtgtgcctactatgttaatcgtgatatgtaaaagaacaacttgaaatagcgctgagacttggaggttaggtaaatgccatatattctgcctccatcatggaattggcatcttcagagggtaacagttttttcccgaatttccaaagcagtgttcagataaatagaccttgcataatccaggcagttaacataaagccacatagtagggccttttgacatgaatgattgttcacccaacaatgagtggtcttcactttgattcgttttatagattccagtgtacttttttgcactatcagtttgtgaatacaccacaaaatgtaagatcaattaacgtcagtgattcacaaccattgtttcctctcacacttctcagcgtctatgtagaacatttcagacagctggccctgtgaaagaaacctcagagtctaatccactgtgtgagttttgaacctctggatccaagcatagatttagctctgtccttgttagtcgaatggcaaattagccggggctacacttccctggcctgactctaaagctatttttttttcattacatgtttttatttctttcctgcccttttcataaaacccaaacagtaatttttgttcttgggctaattgttaaaacattgtatgtgtatatgcaaatacacaggtatactgcacacacatataaagtatgagttcctcattggaaagaagcctgtaggtggaggcaatctttatgtgtagcgtggaagagggaaattatggtaatgttacagattcttagaaaccccaaacttacttacaccacaactgtgtggatgcacatgacaggcggcgtggggtagaggcctcaggcttgtgctcccaccggacagacctggattcgaatccctgctctgccacctgcttgctgtctgactcggccaagttatttagcctctctctgcctgggttcctcataggtaccgatttctggggctcttgtcaaaattcagttaatgaccatgcataaagagcctgtagagtgacggcgaaggggaggcttcctctgtgttgacagcagttgtctaaaggctccattccacttatcaggaatagttatgacctccagatatggctttgtcccagtgataaaaactgcttgttatttattttttgaaacagggtcttgctctgttacccaagctggagtgcaggggcacagtttgggcttactgcaacctcttcctcccaggttcaagcgattctcctgcctcagtctcccaagtagctgggattacaggtgtgcgccaccatgcccagctaatttttgtatttttagtagagacagagtttcaccatgttggctaggctggtctcaacctcctgacctgaagtgatccacccaccttggcctcccaaagtgctgggattacaggtgtgagtgaccgcgctgggccagctgcttgttattgatctgacagattatttttgtcatctgtattcttttagagatgtccttctattaaagatatcttagcaagtttaccgtagtgttagtgttttgtttttatttttttaatttgaaggttcttctttagtgctgattgatgttcctaagtcaccatccctaaagctatttttgattattccccatctctgctatcaggagcataatagaacagtggctggaattagagtcactcatgagggagacaggcaaacctgtgtgggttgggggtgtcttcctatgtaatagaaggtctcgtggtggggcatgctgtctttcatttgaggggatgatgggcctccagttggtggcgaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtctttactggccataatattttcgttttctcagttggcacatagctctttcgtgaattcacttctttccatcccctctctctacttttaaatattttatgggcagtaagctcacaatatgtgctagcacggctgctctctccagaggtcaggatgggtttaataatgagatgcgtaacagtgactctgtaaaaacccatttcaggttaaaaatggcatgttttattgaatctcatgttaaaggtggttaactcatcaattggtgatggctggggttaaacaagttccaacatgagttctcctgtgtgtgaggagccagctgtgccccctgcccgcagctgcttccttcccccaggactctgtctccagactaggcctgtgttggctcggaaccctcccttcctacagcagagacccaccgaggcagagggcttcagagagccccacgaggttgtgtccatagtggcgactctggagagtatagctgctgggtgcagctgctccgtggccagcttcacggcggcaccaggtggtgacagctgttggcagagctgtgtgcagcgctctgtgcatgcacttacccctcagacttgagaaatggctttgctccaaagtcgtactctcattttcattttcatgagtcacagctggggccttgtgggaagaatcgaaggtcagcttactcaggagtgaggggcatcaggtccagtcacaggccagccagggtgaggaccagggtggaccactcagctctgggaccctgtgtgtgtgtagggagggagaagaggtgggaggaccatgggctgcttatccccaggaggtgggacgaagggggaggcctgatgctgggaggcttgtgtggtccgccaccaacagatggctcctaccagggcgacagggacggaggcgccggtggcaactggtgctgggtcagaaccaagccactgcgtgctgtcgtgggtgcagaagcttagctttggggtagaagggacagtgggccaggggccttccctcaagaagctccagctcactgaaagcccaagcagacccctgaaggactatatctctgtgtgccgagatgctcccctccatgagctccaccttcattgtgcataggacgctgattcttagtacacagcagcaacagagcttcagcagatgccttcttgggaccgcgcttgactctagttccttctccccgggagggagaaagggaaggagcctttgaaatttcccctttcgctatgtttcactggtttttaaacaaatagggctaaatagagaccaagaagttaaccatgtaccttaacgtgcggctttaggcaaaatgttattcaaaaaaaaaaaaaaaaagcttctaaaaattcatgtaccatcaaggaaatcttcacatgaatgggtttagaagcctttcttgatagcaatgtgaacttgaagaaatgtgtgacatcccgtttactcccatcaacaggatctatttccaaaactcatgctcctgccatttccccacaagcatgctgcggccttgcgtgagaggaccagagatctcctgtcgtcttccaggcttgctgcaagtgcagctgagatgaacataagtaatagactcattaattgtttcatcgtgactcaggaaaaccactctgtaaagtcagaggctggtgtttgtaaaattcttagactcgtcgaacagcatagacagatcatgacagcacagaccactgaagatttttttagatacagcccatactgtgtctgaaaaatactcactcctgaattaaaacttcccattctgtgtggctggagatgcagcctcagtttaattagcacacgtctcttcagagactccttgcaaaaattctggaagatcgtgtactcccttgtcatagacagaggaaggaggtggcccctgggaactagcctcagccctgaccctagccacacagtaggtagattgaattagcgaccaccacatcacctgggccctcccccgtctcctgctgtctactgggacctgcaggcatgtgcagggcacagcatgagatcctgcctccagccccatctagctctggcagcagggagggccagggtccctagtcatggggaagcagttgagaagcaacagttctgaccccactcatttcatcattagctcttgagaagggtgctcagggtgtggccactggctgccgcctgtcctggcacctagggaagatttcattcaggagtgagtagatgggcattgtttctttttacttgaaattgtccagcctatgaacatatccctcactgttagtcttgtgctttaggtgtcttgttttcggtgaatgttctttttaacaacttccattggccgggcgtggtggctcacgcctataatcccagcactttgggaggccgaggtgggtggatcccaaggtcaggagatcgagaccatcgtggctaacatggtgaaaccctgtctctgctaaaaatacaaagaaaattagttgggcgtggtggcgggcgcctgtagtcccagctactcaggaggctgaggcaggagaatggcatgaacccgggaggcagagctttcagtgagccgagatcatgccactgcactccatccagcctaggtgacagagcaagactccgtctcaaaaaaaaaaaaacagcataaaaacaacaacaacttccgttgcttcctctgttggttaggatatcgtatcattgttcttgatcaacagtagggcctattttctcttattctgtgcctccaaataaattgttcttttccctgaaatgtcctttccacatcttccggttaacatgaggattgctttgagaatgaatgcagacatagcttcatctgagacgccttccccagcgtgtccttcctccatctgtgtctggtgtctcttctctgagttcgcaccgtacagctcttaccacgtctcttatcacgctgtgggaaatgcttgctgtatctgtctctcctaccacactgcaagctccatcacaatgagaaccccttctcatcctcctcttcccagcatctaacatatagtgtctggtaaaaacagaaacacgtgaataaacgagcagtcatactgggtcaaatcattgaaaccatttctgttacagggaaagaattctttttccatccttatactttaaaactttgaactagaatgtctactcttttataataacttctcaagaaatctcccaaagttctgggagtcggaagattttgaggaagtgaaacagtattatgacaatgactcctcccacccatttttttgtcttccttgacatttacatcttgtatgtgatcagaaatctgtaactcaaatgaactgttcatggtaatgagccattattaatacagtcctgattgaacacctttctctaagaaggtcacagtgctttgcatacattatctagcttgtcttcagaacatacctgaagtggggtgaccatctattcagaattcaccatggtctgacaatccacggctctgcgaagttgatttttcccctgctgagcccaggaaagagcaaaacaaagttcaggtgtgcagtggcagtagctgagttatcaccatcactgctgcttcgcagagccttctgaagagtcttacggcagcacaagccaattctctgagcagctgcacgaatgctaagggtgcagtcttggtgtcatatgagtcatacagctatagagatcaggtcctacaggagttggggggaagggaagattactttcccctagggatattgcaggtgcctttagacgagtgtgtgtctgccctcttcagtgagtgaagcatgccgttcttaaccgaaggctcatatggccaagtcccacattggacattttatggagaagcagtgtggtttaggggaggcatcaccagattaagagtggagatattagagttgtgtgatcccagctctgtcgttaatcacctgtgtctatgcagtcacttattcccttcatacctgtcagccgagagcactgactgcgtgatttccagggtcctttacagctttagagtataggggctctgtttttgctgctcccgaatttccacctgccatcatccacgcatttcacagatgcatctgaatgctcacagtgctctatttgtgctcttctgtttgtccctgttttttatgtggatgcgtatcgaccgccatgatagactgcacactccctgtgggcaggagccatgttcatttcatttttgtgtcccaggcataatgtaggtgcgctcacctcatctctcccatatcttgaacctgtgaatctcagtggactcttttcagcagatgaacctgtataagtctttcctgtcttgaaaggacagatgggtggcccccatcctccactgagcttcctgttgaactccctttgcaggtgacctcaaaatagaagaagccctcattcaccctatctactgttaccctcctcctttcccctctacttcccatgaccagttgttcactgcccctccacagaacctacttctgataaatcccgtgaagaattttttattgccagatccaaattctttggcctctcacagtgtttgctgtggcctgattctccctcattctggaaactcctctcctctcatggctcccatgggaccagttgctcctgcagctcctcctgcccctcactctgctctccttggactcctctttcctggtattctctgcagttctgtcctcggctctcagctctttgcacccttctttccctcgctgacagcttcgcgcatacctgtggcttcactgtcacgctaaggaacattctctgtggccctggcccgtctctcgagcctgagccccatgattacaacttctgtctgtaccccacagtcacatcaaccttagcatgtccagacctgcgctcgtcagccgcctctgaaactctttgctcatgctttccccattcgggcagtcatcccacagtcacctggttgtacagacctggagttccccttctccaccatccccacaaccagccagtcgccatgaagttcagcctccaccagtgttccctggcctgcggcagcagcctcttaactgtcctccctgcctgtgtctctcgtctgtaatccaccctccacacggcagccaaaatggcttttctagaatttcgatcttgtttcctttgttacttcttctgtacctgaccacatactttcagacaaaatttcagttccttagcttgcaagaccctctgagagctgggtgttgcccaccttcaccgccccttcccgtggtcctccatgctcacactgggagctccctgtgagagggaactgtcacccttccacttcctgggtcactgcggggctgccccgtgagtttcacatgccggccccccttcagtgctcgcacgtccaaggactcggcccagatgcagccttggctttcctcgccaggcaggattaagtcccacacccctggacccctgtgggctctgtcctgcctctccccacatgcttgccagggtgcttaccggctgagggctcagtgtctctcctgcccctgccatcccaccccctccatcctatgcccgccatcccatgcccgccatcccacccctgccacactgagcacctgaagggaggaccttcttcactggcctttgttcccagtttttggcctagagactgacatagggtacctgtttgctccatacctgctggacaaccagacagatgcatgctgggaggatcgcttgctcaaagactctgcccatctcccccaggcatgttgctggtccttctctccatttctataggatagaggtcacattcctcagcccaactcatggctttccacaggtgacttgtcctgcttttgaagaggcagctcacttagcctctttcttctccctcctcctctgttctgaagacccaggccggcattaggtgcacgtgatcctgactgcctgatgataatttcccatgatgaaagtatcagagccaagtgccatttccctttcattgaaattagataaaacccagagctgtggcttgcaagtgatggaagtccactggggaaatgaaaggtgccgagagaatgggacccattataatgaaagcatttgcgcagccagtgattccttccaccccgtggctcctgtgttcctcagggtgcaatgaaatgtgaagcaggaggacctttggaggtggtttgaggaattgattctaattggtaatggtggcagcattgtgtgcttggagcatgctctgcggaccaggcaccgggtgtgatgggcactttaggaagagccatgggtcccccgggtccgctgtagctcaggacctcggccccgctgtgtctagtcctttctactcctgtcatgtgctggacatgatcagaaggtgtctccctcccttccaccctcctcctctccatccttccttccatccttccttccattcttcagtggctctttgttcgtattctgtatttgtattagcatttaataaaaattatatactgataccaaagtcagtcaactgctagaccttcaaattactcatgaggcctaagaaaaacctatgtgacaaacataggatggccagaaaagtctgcatgatttaattttataataatttttataatgatacaataacaatagctaagttattttcaacgcatcttagcctctacttatgaagcactttacatgcattttctcgtttaattctgacagccttacaattcaggtgttacctccatctcacagatgaggagaccaaagctcagagaagttgagacacttgctcgagattgcatggctgtaataaatggcaggagcagaattgcctgtaacatagaggcagaaatcatatcgagtggcagaaccaggtttcacactgaagtctgactgcagagcccaagcttttaaatatgttctgtgttacagggccccgtgacttcaaagggtttgattcccgaacagaaaatacaggcttactttttaacatagttaatagtacctggagacgtcttgttgtcacttatgtgcccttaaaacagtatcagtaatcgaattgctgcagatttctgagatgatttttacagttgttcaatctgcctttactttctcccttttgtgtttttagatgcatcatcccattcagatgaaacctgcagatagtgaaaagtccaacggtaggtggtaaccaactgtcttgcttaataataatatctgctgctttaaattacaaagtcagttgggggcgggagaagccggcccagctgcttttctctctagaggacagagagcgctgctcctggaatcttctctgtggcctgtgtgtctggagtaatgcactcgccactctcctctctcctgtcctgttgatgatctctggcgtaaagatgtatgaggctgttacaagcagtggctttctgtgtccttctctttgggacttgccctgtatagggaccctgtggcatttggttcctgtctcctccaacaaagcaatacagggacatctcatggggatccagaggacgtctgcaggaaaggaattgcccatgaagaattaggctttctgtgggtgggggaggggcgttggtttttgtttttttaccttttgcatgtgtttcttttggacttggagactgccttattgtactcttctctaaattgctccaatgcatttgcatcagaattcagagttcagtctgctgattaaataagcgtacacttggtgcaaaaatctgcatttgatgaggtccataaacaattgggttttgcctattcgagacatgagagagttgatagccacatttccctcttttaagtttttgttccctttcagcgaaccttctgtcccttttttgtacttttaatttactgaaatgtatgttaaaagaatcttctaccatcctagactggagagctgctctgtcccataagactgacataatcagtactgtttccttccagcaggcagttttgcacctcattaattagtaatcagggcagaagccatgcacttagagatctacgtatctgcaaatgtaaattatgattgggctctaaatctctccacaaggtattttttgctaattgtagtgcattccattttctggcttctccacagaatagaaagttttgaagaaaattccaagtcatagcatggtgctgccagcacccgacttgtcagagctttcttctctcagctttcagcagaaggcagcggcccatacctgtagttgaagctgctcaggaggccaaggcaggaggatcccttgagcccaggagttcaaggccagcctgggcaacatagatatataaataaagaaaataaaaaaatagcttttctctctctaggaggagactttggtgctttaaccactgtcttctcctcagccctgcactttacttagggttaattcgtttttttctctactgctttatcacaaacatgacacttagcaccagaagttgtcaaatccgctgctgctctgtggccctgtgagtgagccacgccactcctgtagtcaccagttgttcatcagttaccgtgtgccacgcatgttgctaggagctggggctgcagcactgaatagaaaaaggaagaagaaaagaccccaagagactgtgtctctgaccttgtagaactgacattcagtctactgatttaagtatccagaagtcacttaaacattgaacttggatttctgcagttgtaaaatggaattgatggtaactgtctcacctaagttgccttcccctgagcccaagactcaaataaggtgtttgtaacagtctctgtaatgatagaatgcctctatgaaatgttgattactgtttgcacccagaggtggtctcctggcctctgcaggctctccatggagcgtgctggcctgggaagaagaccacttcacccaggcgggctcctttcagcccttgtgctccagaggtgcgtgcttgcagtctgatgacttccttggtgggagacacgagggatgactcttgtattttgggatgaatcctgttggtacaagtcatctcagagtgtgtggccaccaagaaatgttccctgcctttggctccatgatactctaaactgtatttagagtattcaggacaaggaccatgaagtgaaagtctatggaaaagggtttgtctcacttctgaacctttggttgtagatatagaaacatgacaaattagccaaattgaaaacatttgacctgaaatatcccagtactgaaacacaaagggatttttttttttttttttttttttttttttgcattttctgctgtgcaggtattcatttgcctcagagaaccctttctacaggcagctgccaggagtttgcagagtgttttgttgttctttctgtccagtgtccactgtggtccctgagaatcacatttgctttgggtctagaatcacagcacataataaaactgtcatgggcacacccaatgttgcatgatcacagaagccaaggaggaccgggcaccgttatttctaggataagacggttacctgaaaatgctgtttttcaagcagcagcctggggtagcagttatgaactatttggagaagcctggatttgacccgactccacgcttgttggttttgtccttgggcaagttatttaaccttactcagcatcagtgtctcttcagctgtgagagggggctacagtggtgtcatctgaacacttgttgtaatgcccgtcttacaaggttatttgaggtttacataagttaacgtctataaagagctcagcataatacccggcacgtggcaagtatccagtgtgctaagttctgctaagttaacactgttattccactcaccgaggcagccttttcagtgcactctgagcagcagaggccggcctgtccaggcctgggctgtttataccgaagcatagctctgtatgtacaaatcaaaacccccaagtcttctagttgggccagtgctccttttgctttgcggattgaccttcattttctgaattttcagtaagaaaagtccaaaaatataaatgagcggaaggctgcttttaaatggcttttctttccagaggcccaaatggaacctcaccttgcacagacatgaacagcttcgaggttctctttggacctgatggaggaatcaggaggaatatgtagttttctaaagcgagtgataaaagccacaagccttttctaatttcacatggcatttttgacaggtaagcatagtttcaaaagctcaaagagcacaaagatttctttggctcagttgctctaaatagctcctgtagttttgaaagaagtataacgagctctaattgcacttttattgagtttgctgacatttatggatagcacaaaggactcatcacagttagacagttactgtcttcattatcactgtgttcagatttctaaaactttgtatgtgctgagccagaaagagctgctaatcatggattaattcatgatggacaggtgaactccagaaaagcagtcacccttggcagctttcgtccatcgagcgattctgagagagggaacctctggggtgagccccgaaacgttaggttgcgctcagatcagccctgcactttgggatgtcactgagcagacttcccgagtctccatggcttcctgtaacctgccctttccattggctctgatttaagctgcagcctctggcacaccgatggaagctcgcggcatcgtgttttccatccacgtgctcccacagagccaggttgtccaaaaggaaaataatcccactctggagaagcaaaaactgctggggctgctaagaggagcacactgagtaaaccacccaccttccaacagaatccgccttttttgttatttttccattgcagaaagacgaatggcgggacaggcagggcttttgaggaggtgtggatttcatcctccatcataaacgagcagaaacatacttaaccctctttcatcctctatgccatccagcttttaatcctctattgctgtgcccaacgaggtaccagctgtgcagtactgaaagtcacaagcagttgctgaagttaggctggcagtgagtgatacaaacagaagctgcttcggttctgggtctggtctcagaggctggagctgtgctcactctgatgtctttgcctcttgccgcaagggaagttgcttgttgtttttactctatatacagagcgtaaatccatccatcctgctttaaccctccaacctcacaatttgctgggggtctttaacgcctagaacccagaaatgtcacttaagcctgctgtgtgtgtctctctcaaggcctccaaaacctccagtgtccaggtgtcaagttcagagctagcagcagtcaagataactaaatatcatcagcagagggtgcagacctgcaaagcctccattaaaaataggaatcatggggtggctccatccagtcactttctgattcacgggaagatgaagaaataattttgaaattcaaagtggagagacttacagatttggaggcagtaattaaatgccatatgttagcactaacacattgaaaagttgttaattaattcaggcagccccaaatccaggtgtgactttgacagattgtacacgcgggtgttagcgcagacttacaattagagattttttttttaaatgaagtttctattcccctaacttaaaaaagtcaccccgtgtatttaaagtattaacccattctcatcatatcatggaaggtagacttcaaatggctgctggtgtggaaccccttttgattctgtggtcgtcgttactaatcacgggggaccccatctgtgcagcacttcatgtgtaaaagcatttccctgcccttattcagtgtccgtcatggaaaatgacttttacccttcaagtgtttttttgttttgttttgttttggttttgtttttttaattccttaaagcacctagcagaatactgtgaacacagtgcgtttcatttaaactgactttcctgtaggttgaaaaaataagtgagatacttagtgcccgtgaatactcaggaaaaactcaccaagacggtcatcaaaagttgataaaaaagttaagtgaactcaaaataactgtgttcttgtagaatgtttacaaagctgttagggaccctcagaatgggaatttgggggatgaattgtatgactaacttgtcactggaaaaccaaaaaaactcagaagaaagccgggtgtgttcagtattccccatattgcctttaaagcaaacacagcccaactgttgaaaccacggagcaactttggctagtaagagattcccaaagcccagcacttctgtgcacacgcacaggtgcgctcacacgccacacacacagatggaagttaacattttgataacgtggatgatggaggtttccattttttttcttggctaatacttgatatttttaaaagtgcgagttatctttcttcttgttgcctggctgagttgaccttgagtgatggctaggaagtcagcatttcttcatgagtagtttccattttcttcatgttcgtcttaggaaaaaaatcatttttaagcttacccaggagctgcatggttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacataacaggaattttatttttactctcataaaaatgccagccatagtttgctgggggtaggagtctcggagacgagagggaaggaggagtcctgctgatttttctcccttttctaccccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactcgttgcccagggtatctggtgtctctctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtcctaaaaaaaaaaaaaaaaaaggcacctctcctaaaaaggactccaaacgctgtcctgagatcagttttaacctcgtctttcgggccgaaagtagttcacatttcccgagcacaagcatggagattttgaggaaaatctcccgggccctgtgaagtacaacgtgtcttatcttccccaatgtcaggtgcccaggttagaatttgcgtgtcgtcctcatgatccccaaatgcacttttattccccgagaatcttgcctcccggtggctagtacagtattgtttccttcttgatcatttgtgaagggctggaagctcggggccatccagggtgtttctccagcagcagccgccctgttctcctctctagaatcggcttcctgttgagcggtaactaacctggctgcttagaaccaggtgcgggacctggttagcactgcatcaccagtgtcacgggaaagaggtactttcctagctccccagagacgtaagaatctctctgatctcttattcttgtctagatcagcagggatgaagctatttgaaacagaaaaatgttttcttccctcgaatactctgtgaaaagtttcattcgctgtttcgctccatctgcccccatcgtctttcctctcctgacctttctctgtccctgtcattcaggttaaaagaccatctacaaaaaaaaaaaaaaaaaaaacagaataaaatctgtatccaaaaatatccccagagaatggtagtgttgaacagttatacaagtactttggaattttagtcagcgcattactgttagtttctgaataggagaaaagaacttaacagcattacatgtcatattaaaacattttattagtaagcacaagcacacggggagatgggttcaggaagcaccaggtgggagggagtggcagggtggggcgcatggagggaggaggacagctggacgtctgcagagttggccttgggacacgtgcttggtctcacatggctggggcctggtttgatggggtaatgaagcattgattacaagaaaaaaagatgaaatggcctttgctcattcgttatttttatctcctagctgtggaagacagaaaattgttcataggaatggtttcgaagaaatgtaatgagaacgacatcagggtgatgttctctccatttggccagatagaagaatgccggatcctccggggacctgatgggctgagtcgaggtgagtgtgctgtctggaaagcctctccccttcagtgctaattggagctctgtgtcacagtcgagacagatgtaggcaccgcacacggcaagaggtcaccctgtaatacatcccatgtgataaagttatccaacctgaacttttcaccatagctgaaatcatcaccttttatttctccagttcagaaggccttggtgccaccatattagctcaagttatcactgtcaggtgtgaagccaacaggctgccctactgctaggcatccttttcaatctcatattgaaatggatttggtggggggaggtgcaagaaggagaagtagaaaatgagaaaggatatttgttgttttcatcttagtcctcgggcttcctgcctgtgcctgaaagaaatgttaagagtatgttaagagtacagtgacacaaactgggaaaaaagcgtcaatgttcacatgtagtgcagagcagatagggatgtagggtaactgggcctgtattggggtattagagttttatttcaaagagcaaaactcctggagtcctgagccaggggaactcgttaagtgacagaaaagcgactttaccctgaagaagattgtaggcacttctttgccaccatgatagaagcagaagctgtagctcagagccttgacgataagctggtgtttacagaatagttggaaatcactgttgttttccctgtttgcctctcccttgacaatgccacacacctccttcctggaaccactcataaaggctgacgctggaggttgacactcgtctgactgcacttccctgagtcagtccaaggtggaaatgtatatataaaatgtgtttttcacttctttttgctctgtcgccaggccagagtgcagtggcgcgatctcagctcactgcagcctccacctcccaggttcaagcaattcccctgcctcagcctcccgaggagctgggacgacaggtgcacgctaccacgcctggctaacttttgtattttagtagacatggggtttcaccacgttggccacgatggtctccatctcctgacctcgtgatccacccgcctcagcctcccaaagtgctgggattacaggcgtgagccaccgcacccagcctgtgtttttcacttcttacaggaaatccatattcttagcaacatggagaggttttcattctcttattactgcagttaccagtgcaatttctttggggcaaatgaggaacttggtttccttctcaatctctggctctgggccagcactggcaccccaaaccacatgttgaaagaaaagattggatcatgaggatgaaagcactcgtcttcacccttctcactagtttgacctgacttcagcaccatgtgaggaagaacatttgctcttttgattcttaaacataaagcttaaagatgtcagctgctagaatggaaggccgagagaacaaaagttcccacctacaaccacctccagagccccagcatgaaggtagtctacaggagaactaggaggcggtggaaccacgccaagcttttgattcctgtgttttcttcggaaggtggtttaaaaaaaaaaaaaaaaaggcggcatggaaatcagtttatgcattctctaacaattctgaaattttgttatataacactcacttaaaagatgtaattctctaaaagctgaacaagtcactgtattgagtgtgatcctggaatagcagatccagtatccggggctcctctgcggtttttcacctgtgccatcgtcaggggcaagcaaagccatccatcgctgtggcagactgcaccacctctggctcccaaacagcctcaccagccaagggatactagcatgccttcctaggggctcaaaccagcagaccttctaatcacacctggtggtccaattcttcatcatatatatgtccacttaagcagacaagccaggagggagaataccatgggaaaagacagtgtggctaaattaagaataaaatatgtagaaagatgtgatcatatttttgtgattccttttctggtgccaatttagtagttagaatccctgttatctcctgttgttattctcagtcacacttcagtgttaccgtagtaattttcattctccaaggtatggagaaacggcacaaggagagcccttaaattactcatagcgaaatctataatggcttaggggccagtgaccccaagttccagacccacaacttctactgaaatgaaatagaactttagtcattttattttcttacctctgtcctgagctttccccatttgtaaatgacagccgtaactatatctgccctgcttctcttgcagggagtcattcacggctggtgtgctagcttttcgtctgagcataccctctgcatgtgttagcggagagaccccgggcgggcagtatgtgtgcttgatttctgctccccgtctgctggcctggctgatctaggcagtgactctctggcacattttctctgtctgtccagtggggacagtaatgaacaggattgccgcctgcagcgttcagagctccttgagcatacatcagttatttctgcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctgttgcaaaaaaagaaaaataagaaagaaagaaaatactcatttataaccatttatcctgagaactgaagacagacagtggtacttttttcaattcgcaggacccagggactcctggctacaggggcctgctcctgaatcagtgtatttgttaaaagcacaattctctttcatgctaccattttgctttcattaaagaattgcagttttgaatcaaatattaatgtgtctcccattagtggcactgcagataaagggcattcagcatttctgttctcagcgtctattgctggctcagctgtttaaaaataaataaaaattaagtgaaacaaaagcatggctgctctgcacagtaccttgtaacacaaaaccagggtataccctcttccgtgagaaagttttaaaatcaaactcttggattatggtgagggagagggtgcagctgagcggttcacttttctttttctgcttttgcccagttcacctaggaggatgaagacaaaggaggcaactagtctagctggctcctgcggatttctaatgtcatttcttccctgccacatcagtagtttcaggtcctccctaagaggggttacactgaggtttcaccaggctagttgacccagtacccccactgtgtcagagaggtacactgccctgacccacagctgtacccatcaagtcgtgctatactttcagtcggaatcactgccttttttttttttttgtaagtcgtgatctaccttttggcaagaaaagaaagtatttttaaaatcccatcttactcagcggccccagcccatgttccagggcagacaccctcaggaaattgtcacgactctacgtggaaagcacctaacacctgccaagcacctggagcctctcgaagatccaaggactcttcctggcttgaggcagcgtagccatatctcagtatgcgtttctccctttggggaagtaacccattctgccatcttctctaatttggaaaacactgagatgctttcaagcaactttgggatgctcagcaccttctgcagcagctgctcagcctctccaggcctgctgtagaagccttcatggagaaaaggagcaggatgccatgggcccacatgtggcaattcacatgaggtgtttgctctcagaagcagagcctgaagtttctaagccaaatgtgcttgatcgacagcatcaccctagcatgttgatttcctaaaatacacacactctcacttacccacaatcccacagtcagcctgggctatttaggtacagggttttctgcaccgtggcagttgaatatctgtaacccagagacagtaaaggagtttaatttttttccccccacaaactgtaggcaaatcttcactgccatttaaggtaactttctgcttgtttaagaatattccagctgtgtttatggtgttccaacattcccctgccaaaacccttgacaaatgaattggcaatattttcagggatgttggcaagtacagactggatttagctattaaatcctcattggtttttgtcatatctgatcagaatacaggaatgggcttttgactattaaaacatgtacacagtgcttgggaggctgatgcaggaggaccacttgagcctgggagttcaagaccagcctgggcaaacacagcgagatgctgtctcaaaacaacaacaacaagcatgtacacagaaatgaatcagttttcacacatttcagctctgcccacacagtacctaaacattcagatgtgtgggaactttggcgacatgcccccttgactccttactgcatttgccatcttgttccaaatacagacttccaatcttatctcagtgatgagattttgccagctattaagtaggtcctagtctgtacccagcctcgcatgccataaatgagtgatgtgtctgtgccagttttaaataaagtaactcagcatcagggatggcccatcagagtattaattcttatgccccaatattatattgatagcgtatgtttaacgttgctactgcttaaaagatacaaggaagattgactgcattaagatatttctttggctgactaggaacttataaacaagttttccataggttaaaatctcctttgtcctacacaagttatacttctttcacttgaagtatagtgggtactacacctttttcaaagaagtaacaaagaaaagcaagaggccctggcattgttcatgcttttaaaagtggctttacttttttttttttttttttttttttttttggtgcagagcaagaattcatctagttctcagttctcttgcagctaagaaaaaaggtggaacacctgagttaagatatcctttcaattgaaatgacaagtgtaataggtgtgttccaaaatcttctctgtgacagggctacgtgctttccttagatcttgtctgtaggaggaaattactttcagaaacctttccccagtcaatcatttatctgttttagcagcaagaaggtaacctcactgaaatgagaggaatgcagctcctttcatttctgttagcaattcgtaacattctgaaagtagggataataaataattgcaaaggtaaattgcaggttggccaaatttacagttggatttttttttgctgctatatatgtggaggttttcagagagtaatatacatgttgtcttaccaaaactccctccccaccaaaaaagaaagaagtatggcttcattattttgatacctgtatattttccccccagccttgtttctccggcatttgggtcagtagccaaattgctgattgctgagacctgacattcaacagtctagaatagttaagggctgaccctacaggatcagagcagttgtcctgtaaagacccagtgaacaccaccgcacccagaagctcatttttagtagaaaggggacagttacaacccaggttatttctgtccaatggaaagccttctggttggcttgagagaaaaagccagcagccagtcttaacggtagggacttacatgatcctgtgttagtataaagccatacattggaggcctaatcctaaagccacccatgtgttttcagtggtgttgaaacaaaaactaaaaatctatccataggacttaccgtgacctcctgttttagagaaattacagtggttaacaagctaccattgcaagaaacagttgactctgaagttgcttgacttcatcccgagtgacacagagagtgacatttttcaacatgcactcccactttataaatgacactgtaatttttttctcaagtaattgaacacagcacacaatgcagaacttgacagaaacccctaaggagacagcttctgtcttactgcaccactgccaatagaattaaaaggttaaagaagtcctcagatgtgtcagatcatttttttgggtggggtaaggattatataattacaagcatcagtcatgtttttaattgcacggttgttagaggaaagggcaatgatttgagtttatagaaacagaattttattgttctattggtaatacttctcttctgaggcctgataattgctgtatctttctcactaagttactttaaaaagttctgcatatatgaaattgtggcaaatgcataaactgtgccttattgatttttgttgacattttacatgtttcttacgcatttttaccctccatttggaaactgtcagcttggcacatggtgctggataataagagcaaatgaagtgaatacagcaatcttcttgactattaaaaacagaattagcccaggctccgcttggtttcaaatctatctccaatagatgatttgccttttcctcccttgtagtttcaagataagaagtggaaaaataaaaatctcttagtgttatttcctctgttaataatgccagggatgatgaaaatgcttctgaagagatgttacttggaaacagatggtaaatttggactggatcacctcagagctcagcatcagtatggaagccagtggaggtcctgtcctctgtcccacacttacatcatctagctgcctcagagaaggccactaaattgctgttattgatgacaaaagctacagtcagtcttagtacaggtagcgtgttcagatagtaagcttcatcagctgccatgctgtcagagaaccacatgagacagctcagcattcaccgtgagctgaacttcattcaggcttcttcaagccagcttagccaggaggcgaatgtgagatgagtttctcatgtactgagagtttttgtgtgttaaaaattatagcatgatgcaaacaaaaaatgcattgacttattttcatgactggatgtcgttgtgctttgagggtaatgggcaggcattgctttctcttattgctgttggattaaaaggtgcggctacagtattgacttgataatctcaccaggtattcgtgcagagcaaaagaagaaaatatattttatggctcacaaattgatttacataaaccaaacaatctgctggttgtttgaatgcagaatattctattttgcttattggccacaggggcaacaatctcacatcgttgatgccagaattctgcttttcatgcattcactctgaaatgacaatagacgtcagcctctcagtgtttagatctgcttcatttggaaatcttttaagtagtaataataatgttttgaggaaattgagtggaacactaaattattctctgatacctaagttcaaactgtgcaaggctaaagaagctgaaaatcaatgcacttttaaagtcattagagatcataagtgaaataagtctgtgttgctttagctaaccttttagtgtgctgtggttttattataatatcagcctgaatctgcattaatttcacagtctttttctctaagaagcccaagggtgcatgatgaataaaatgtaaatttgagaaggcagtgtttttattagtgaaaagggcaatgagccatgtagttggagcagtgacctgcatggtggccaacgctggtgcaggaagcaggagcaggcactacagagtctagttattttacagcacaagaaaaaacaggcacggaaagtttcactggtctcccagcagatattcacagaagtgtacattgtcttgtgtatgttagaactaaggtcaaatctttgatacgtttcagaaattgacaagtctcaaaagtcttgaagattttatgcaaataaatgacaatgcacgttttttacattttatagcagtattgaatattctcggagtaatggagcatttgtttttattaaaattaaaaattgctaaatagtttgcaacagacttggtatatttgtatttgcatagcaacaatttatgtttatacatacatatatattttttaactacctggaagggatttagatacatttgtttgctgacattttgagctcttgaaatttatttgctcatttgcccttggtgtgaggattttcttatttgcccctttaaaaatcaatgataaaatttgaaatacaaagccctgatgtgtgaatgccctcagtaaagatcatcagtcaaggagaaaatggaaaatagcaactttttattttagaaaatgcaaactagatcttgctgatttcaaacccggtggctaaaaacagtacccaacttcctcccctagtttccatttaaaaaataaactaataaataaataaatctttctgctttggtcagattagcaagtcagcactgtgaataaaaagcaaaataagataaaaccagagagagaagttgttttatttttatgtactactgagaacagtgtcgtcttgtggcagttctcgtagactgtgttggtttaacaagcgtccaacccttttgtcttgttgttttttgtctttcctgctccctgtccccttgtttcccacaggctgtgcgtttgtcacattttctacaagggcaatggcacagaatgcaatcaaagccatgcatcagtctcagaccatggaggtactgtatcatctgccctttctttgttttctttgtgcaaatgatggggaatggtaaagcaattctctcctgtgtggattgttcacatgacaatcacagatgtaaactttcaccatctcagttttcattcattcattctcattctctccttctctctctctctctttctctatgcatttttcccctaatgacttgaaatgcatttaggaaaaccttccacttgctctccagttatttatttgagccttttattgcagtggcacgggtcctgtgatgtaaagtcgtgagcactttaagcaaagtgtcattctggacctaaagaatcaaatacattccccacaccggggtcggtgcggatgaaacagtaacagcctcccaccccaaattactgcttgccctgtgctaagtcccagggttctttcgtttgtacagggtcaagttatcttccatctagtcaaacagcattgtgtttttacatcaagaatgttggagaaagttaatatttctcccactgcatttaacattgaaagtgcaaatttggaaaataggatttgtctccttccttaaaaagatgagcaataacaaagaaacataataaaggctcaaatgtggtctcctaatgagagatcatggctttaggggaaggtaaacaccctggtgtggatgcacacccacgaacctagatagatggctctgtacttttagtctgtgatttgggtcatggcctttcagaattttgcacaaaagcattccaagagtgatatgccgttacttcttctgtattgtctgatagaatcatttgggagtgcatgttctgctgtattatgtatactgtatctttgtgtatgggtgatcttttccggaggtggccttgtggtgttatctgaagctgtgttttcatattttgaaaaaagatattttcaattttatttaatatgcaaaaaacttttttcttgattgagcttctgttttccccccattttgttggggttttatttttttgtttgtttgtttttgtttgttttttgcaatgctgcatctcccaaagcatgctgggagctaagtgatcattatgcgtcatgttttgtgggcaactttttttatagtgaatcaaaaggtgggtgcaaaggggggaaggagtgtgcatggcattgtcattcagtgtttactgtacttttctgacttgtgataccagcattgcaaagcctattgtctttttcgaacattgatcttgactttgatattcctaacatatcttatataatcactgtgttttcctttcagtgcaatgcatttttaagacactcacaaccccctacctgaaggcaagctcaggtgaaaatcgggcatgataggcgataatgagcaggatttggaatgtctaggaagctaatcttgtctgacacgcagttacacgtgtgatggcgttttgcttccctctttctcttactgaggccgctccattcctgtggattagcctgatttccagccacattttaatcttcaattcagtttgaagattaaaatgaaactgctgttaggggcaaaaaaataaaaaagaaaactctttacttgtattatcttccatatacgcgtttcattcttatttttatttcttgtaatttagtgatgtgtacccaaattggtctcacctgagataattttgaacctcaattcttcagtgtttctgttagaaacattacgatccccattccttcccttggagcccccccagtaatgctcagagagccacggacaacccacgggagaccatgttcccctgtgttcctgtagaaggaggactctggatcataaagcagaactgggcatgaaccaggctgagaaacagtaggttcccatcatgtaaagagttggtttgaccactggggcatatttattcctaagcctttgatcctttattattaatatctctgttatttgaaaaccaaatttggtgtttaaaactggacattcatgcttacacagaggggtcctctgacacttaaatttcttgtttggtttttttttaattggcatttaaataggaggttatatattatgcagtcacattataattgtttgactaacgttgtttatttttaactaattatattatttccaggactctggcatacatctttaaccaagatgtattacctaattcacaatgatgtgaatgttgaaagaacaaggtcttaaaaacaattaattttatatcgtgccttctgtttctccacttgccttcactctatccctgccctgtgtttcatggtttaaaaaatcatttttaagctataatcattggcctaattttctgcttttatatcatttttactatttaaggaagaaaaaaatagatgttctgttaggagagatgctataatttgttatggaacaaatttgatggaacaatgacaacccttttccatgcaaaaccccctctctacataatcttcaaagtatgttgctctcttttaagtgaagtactgaaacatggaacagatacagaaaaaaatgaattacagatttttttaaatgatggaaatactatttttgtgcaatttactgacatttaacattctgtaccatgactctgtctaccagagctgaagaccagtaggctggaagtttaacactgaaatattcatctcatttttctcacttttttttattaacagacatgatatcctcatgtattcagaactgcatccccagtaactacccaaggtgataaggaaaaaaatgcgtttgttttccagaaaagagaaacatgacccaaagggaatggaacagagaatcacatttaaataggaatataacatttctgagaggagagagagagaggtctattatcatgctgagtttcaataaaagtttttattttaatcacttgggtagaattacttctttatgcctcagcaaaattgaacagctttaattgtgatgaaacgtgtaggcaagccacacgaaggaggagaagaggctggggaaggagggggagacttctgctgagttacttaccaagtggcaaatgttgcaaaggtgctttggaaaggaggtcttcgtgcttggggtgttaggcccttattatccctgatgattttatctagctcagtagtgaattctgtgacctttagccatttctttctcactacccctactccttgccttttaaaggaaattaaaactgaaagaagctgctagaatggtgagattcattagggaaagaagccaagtggactcctccgtctgctgttcacggtctatcttctttggctagaatgtgcttctgttttttgggtttgcaccagctccagggatggcgggtagcacaggtgtgctgagggaagaggcctctctgaaaacgtgaacggttactttggagaatgcctgtgttccctgaatatcttctgccctcatcctcaaaactaaaatgaagcccttttccctatgattgctgggccgataggattgtcacaatcccaaagttcacagatacataactgaaaacgggaaagagtaaaagataaatgaatgagagacatggccattcccgttacagattctcccctttgtcctctgtccacctgtggacacgggcagacacacaaagccaagtctgtctttaagacgagcagcctgagaagctcaattaaagaaccttggtaaggtctgttgtctgtaaggaggtcctgcaaggttgaaggaagacacaggaagagaaggagaggcagttactaatcagagcaagaaagcaagtgacttcaccgaccaccagatcccccaaagaaaccactggcagtgtctggaattttctgttgatggtactattcagagaagaaggaatatcaaaccgttttaaaccatttcagcccattccatgtgctccaggctagtgcagaaaggtagctccggtgctgagtgtcgtgagcggattccgccagcctgtaaccccctctccactttccaatgtgtctgaccacagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcggtaagtgctgggcaatgccggcgtggtcttcacccgctgaaactctgcaaactgacttttcccctccctacgctgaggcatttgttttcagtacattttcaatctcggggaattattgaaatcagcatttatgcaggatatttttccaagttagattgattctgttaagaacaggactaattgaattcctgcctgatgtaggaggggcaaagtcccacaggttaaacttctaactcgtctttgaaaggcaccccaaggccctgagttagaagacatgcagctgatgatgtaacgagagggaggccgctgggctggctcatccctgtcaggtcagggtctgcgccagcaggacctcaggtgaaatctcccagaacttccattccatgatcctggctcttcgcagtggaaccagattgatgaaatcaagtgtttcttacttcatctatttgaaaccaacaaaattctattctatttcaagccccagcagacccagttctctcagccattccttacatctcttggtgtctgaacttgagctttctggttgtttactcatgctctccatttcactttgtgtctttattgaaacacagtgaccagaatttaagacagtcccccgagcgagatctgaacaggacggagtagtaacctctagtgtggacttgagggcatctgaatggagcttgagagcggcgtttgtagtaaccatggcagatgcgggctggaaggcagccagtactccagagattttatttttactcgaattactgctaaattgtgctcttctaccctatttttccactttggaacataagtgctggacttcacatttattaatataatttcatattgtgagtttgggccttttattccagcctcagagagggtgtctctgtgtgtgtgtgtgtgtaccccatgtgtattgggtcttcattctgtcattttacattttaactatccctcttgtgatcctgtcacccattggctttactttgtagcagaagttgtgcttttgtgtcaaatgatcctccctattccaccttggaaggtgagatgatcctgcttttcggacatatgaggaaagggagactcaaagaggttacgtaacgttacccagaatcaaccagccgctagtggttgatgggacttgagccctgcgtgtcccaccggctggccatactgcctctttgaggactccgggtgctgctgtgggtcaccttcatctttttagctgccccacccccagtgcccagtgcccagtggggtctggtatataatagctcttcagtacatatttgatgaatgaatgagaagcatccttttcctgtcttcctctgtgctgctagcaaaagcattggctcaggttcccatcactttctgtccatttctctaccttgtccacgaagataccatgagagattttgtcagctgtcttgctaaaatctatatttgctctgctattattttcttgactaatcagtctaaaaattgctttaaaagagaaatgagtctagcttgactatgatttgtttttcacaaatgtgtgctgttcagatgctcacagtcgattggtttaattctgtgtaccagaatttttgtctgaggctgacatcacgctcaccttcctgtactttctaagagtccggcttcccccatccaccatttctgaaaactgagacacgtgtccactctgtcttctagcacgtctcctgtgcccccacggctcacagaaatctccggcacatgtttctgggaccacatctgcaaattgtttgtgtaggtgaaggagaggaaatctcatcctgatttatagaaacatgtttttagaagttctcactacgtttccctctgccatgggtgattctttcttggccatgtttgtcctactccctttcagctgaaaagccctttctctgaaagagcccttagctgccttgagtgatagattctgaccctggctcaccagaggttggttatccgtggcaataatcctgggtggtggtttaatgacactccaggtatttccacttacctcagtaggtgctattaactcctctaaacatcttcaaggctagcttaatttttaaaatttaaaaacattgaatatgaggaggaagttgcagttgataagcgcaagagaatgagaaacccagcaaatcaaaccgaaataaggccttgctattacagtgggcagtccctagctttcccaccccctcttccccgctctcttcctctttctgtgtgcgtgagagtatgtgtgtgggcagggaatggagagggatgactgaacacagacttttcttggttttagtataacctgatagtgtgaagtcccataatatcgtcgtacctgaggcttgggtttcagtcagccaagggtccccaacccctgggctgggtaccagtaccggtccatggcttgttaggaaccggaccgcccagcaggagaggagcggcaggcgagagagcgttactgcctgagccccacctcccgtcagatcagcggcagcctcggaatctcctaggagcacgaacctggtctaaactgcacatgctgaagggtctaggttgcgtgctccttatgagaatctaattcccgatgagctgaggtggagcagtttcatctcaaaaccttcccctcaacccctggtctggtgggaaaattgtcttccacgaaacttctttccccggtgccaaaaaggttggggactgctggaatcagccactgatagttccacactgcttggcgctgttacctcaattgagatccattttcgagtcatatccatgtgtagggtttatcatatcaaactggaaagacctggacttccccagaggaacggtgttctggattgtttcacgagccccaaataaattctgaaagttttgtttttttgtttttttgttttttttgagacagagtcttgctctgttgcccaggttggagtgctgtggcaccatctctgctcactgcagcctccatctcccaggctcaagcaattctcatgcctcagcctcctaagaagctgagattacaggcatgtgccaccacacccggctaatttttgtaatttaactagagatgggggttttgccatgttggccaggctggtctcgaactcctaacctcaagtgatccccaccccccccccaccttggcctcccaaagtcctgggattacagatgtgagccactgcacctggctctgaaagctgtttttaaaatagtgaattaatcttgttcctcctgagcacacaatgtgacaatatttcagtaataaaataaatgtggtaaatctgtgtttctggtatccatgtacatttgaatataggagaaaactatctgcttgcccacactgctaactgcatctgtactggtctcccttaccaaaaagaagatccataagttcagcccaacactcagtctttcacctaagttaagctgcggttcagctgagttggacaagtccagcagcaccccaggggctccatgcctttatcttgtggcacccactcattctgcatggcaggaaaaatgcagccctgaaagcactagtggaaaatgcagactttctcataggtatattaatgtttttgaagattgacatttacaacgcgtgacttcgatgtacataccaccagatagttgtgagttttgacaagctgtatgtttcactctgcagtgaggacttttaaaatggctgcccatttgcttggtcatgtagtggtggctgcagctgtacgcctgtgaatagatgcattcatgtttgtagttaccatgatgatctttatgttggcaccagagtcagtgaaccaatgtgcttctgatgaaagatgaagaaagctgaacggtgctggaaagtagaagagagggagggaatggaccctgattgacagagatgagttacggtaactgctagactacagagagagataattagtcacgctatgttggtttcaatagatctaacacctggttgttaaaaagagtaaattgattaattgttttaaggcagcagtgttagtttccccagtgtttatgtttcttaatagagattggacatgaatatggatttacagccccagctctggggaccttcagtccatcagtaggcagtagcaaccaaccctggaaatgcagagtaaactgaatttgtccccagtttaatgagggagttactttgctctcaccatctccactttgcccttgtgtgttcatccgcagctcctgcagcaggccacctcctccagcaacctgggtgcgttcagcggcattcaacaaatggcaggtaagtcaggaagcacgcctctccttttgaccgtgctattgtcagaatttggggttggttccgagggcaaagacaagaagcaggggaagagaaccaagaatgatgatcagacttgttagctttctgtctttggtgttaacgttggaaccgcctgctctgaagtgtctctgttacttcttaggttacctacccaccttcgctgtgcatgaccgctatagaatgaaggggctgagaaatcctgattggcatctatatcaacaaatgattatatcaacgactctctagtcatttgttgtttttataaataagattgattactgggggctttccatccagattcctatatctagggcagccaaatgattgacagccctctaaaattttaataatagacagtcaataaaaatgttctgacctccgtaatgaaagccaggattgcaggcctatctttgatgcagtttgcagccccttgataacgacagacaattaacagggtgcctttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtgcagaatgaagcgttttttctttgtcatcatgaaaactcctttttttctacctttctgtttctttttttaaatatgtatccttggggtttgtttattttttttttcttgtttcacttcaaatgaatctggaaaaactttccagggggcttctccctgggtgtggtgtgtgatcggcagccccgccgttgtggcccgaggctcctggaagctcatcagctgatggtcttccttggcctgtagtaaaaatactgctgaattcctcgttgggctttaaatccattggcactgccacctggttccattgtaacatagcttttggattattagaaataggaataacttgatagttaaatcattcagcagcatctttacgaatatggtttgggaagctggccttggagctaagaatcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgccctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccaaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaagaaagagaaattttagacgactggatcctaagtagttgcatgtataaaattgaatgagacgtcagctatacttcctttcccaaaaaatcttaccattttcccttcaaactaaaaataacttcaagtgtgctttatggtttttatccaagagaacctttatgaaatatggaatttagaagcagaaaatggattaggaacatacctttataaattgacggcttttatatctactttttgtgcctccttggagttggttggtttttattttccctcttaaaacttctaatgaaaacttgtccatttctctctcagcggtgatatttgttcagtgaatttcagaaatctcagaaacttggggtctgagtttgggctgagagctgggatttttcttgaaagagaaagggagtaagagaaagtgtcttctctgcctttaatttgtttataacaactatcaactcagaagatcatataacagaaaaacaaggggtagtgttttaccattttgtttttgacaaagctccttttaaaaatcatgcagctgtcctcatagcaagctaaggacgtgactaccactttgttactacattacggttggaaaaagggaagatgaaaaggttcagtgagtaatgtgagaccacagcactagtcaatgacctaacaaggattagggtatagaattcccaaatatcacaacaacctgatgaagtagggactctaagttagcccaccgcatggccgggcaactgaggcttagagagatgagcagacttgtccaaaggcactaagctagtaggtggcaggaccaagcttcaggtccggctcactgatgcaaacccaggctggcaaaccgtgctctgtgtctcagccccttgaggtgtgtttcacggcccccacactgttaggaagcacttcagaggtggtaacaggaaagctgcctcccttcatcctggaaaacatctcaagtttatcatgagtgagtttttctttttaggggggatttttttctaggataaagaattgttactaaaccagttccagaggttctgaagctgcggcggaagtgtcttttgatgaacgggaggaaactgcttcgtttcaattctgattctgagtaaagcaagtagtaattcccttccagaatatctggtctaagttttgaaggtaacaataacattatggagtgcaaatatttgcttaaaaccatgaagcagctcttcatttatcaacttgagatctgttctcttagaagactgtcttggtgtctagcacgagtggagaggagggagacatttgcaaaaacagtgtatcggaggtctgagaatgtcgaattggaggcgctcccggagtggtgaagtgtgcttggtacatccacaaagactcacgcagaacttggttcctccccaagctgagtctccagcagtccacactgcaggccttatgagaacgttctataaccacccatctgtcactttttaacagacctgattggcaagcacttgtaacaactgacatctgttcatgcttattgatatgcagatttatggtaattgctatgaacaataagacacaaaattacctaaggtgaacattaaattaaattttcatgcccttctccttataaataattttttttaaatcttaagtttcaagtaggcatattgcgcatctgtttggtacataatttcttcgttttgagaaggatatttttccccaagtattgaatgaaagttgaatccctgtattctcaactttctttgccatcttcttagcccatcgttgagttcctaaaacttactgaaatgttttgcatgttcagtcacccagtttattgcccctggttcgagaggtgcccatctgagcagagtgcttcatgaagtcaaatgcagtttttcttctcggaaaggaaccgtttgccaagcacgcgcccttgcctctcggtctggtgccctttcaggatgagcgtgtgggataaagtgtgacttggggtgcagactgaggaggcgcctgggagaggggctgagatggggaaaggacggggcacccacatacctcagaaaagagagagcgacagaggggaaccagaaagaggacttccggatgagcggaagtgaagcccgctgttagttctggggaggaataaggggagttgcaggagaggccccgcgccccatccaggagcaggcctgcgcctgacacctgtgcccgagaagcctagtccggctaagaagggagagggaacctctgtcctcacccagatgccctggctggtgtccgcacatcaggccagtgcctttccccaaaaccgtttctcccccgcataggaggggaaggcaggcaggtgcgatgtccacgttccgggtgatggcgctgtggctgtggatccatctgtggtgggaggagccaagacatcagccaccagggacgtgcatcgttgccagggaagggcccaggaacactggggccaagacagtccccacgctcttctcgccccgggttattactgtggtgtgacagagcatgagatggtcagtagcacctagaagatcggtaggtgcagggatgtccatggggcaggatggacagaggacacatgggccacggcctctgcctggctgagtggacagaggccgctctgggtgggggaaacggtgccctcactgccctccagcctcagtcctggttggagtgagatgcccaagaggcaggggaggtcctagggctctgaagggctgctctctagggcttcctggcgccagcctccactgggtccttccccattgacacctgtgcccaggaaggtagctaagaatggaggagctcgggctcgcctggctgcttctgatgctggcgtgcgtgtgcatgcctgtgtgcgtgtgtgtgtgtgtgtgtgtgtgtgtgtgtgttcagaatgggaggaggcactgtcttcatcctccctcttctccgtgtcctcactcctcagctctcgtttcttcctgatggcccaagtcactgccccacccccaggctgtcatgcagtgattttccactaccacttgtatctctttcagattgtcaaaagaggtcagaagttcttcagctttttaggagctgtcaccaaacacattttgcatgcacatcacacacatactttttcataaaatgtcagagtttgtggagaccctgaaccctgtcagggacctctgcctcagaagcaccaagttcaggggactgacgtggggtagatgaagaacacgacgaagagcactgaggcagcggcggacgagggtctgtctggtcactgaagcagctagagccagtggtttgtggtatctgggattctggggatggatgcagaaggaaatcacgttaagaaactaggccaggtgtggcggctcacacttgtagtcccagcactttgggaggcagaagcaggcaaggatcacttgagccccggagttcccgaccagcctgagcaacacagcaaaacccctttcctacaaaagttagctgggtgtggtggcgagcgcctgtagtcccagctactcaggaggctgaggtaggaggatcgcttgagcctgggagatgatggctgcagtgagccataatttcactccagcccggtgacggagcaagaccctgtctcaaaaaatatatatgtatgttaattgccaaattgattgagagagcaaaacgtagtacatagttaagtagttagtggttaactggttaacctagttcttagttacaaatgaagacacgatcacaagttcattcccagacctctggcattcaggcgagttgcacaaaattcgtactggccccaatgttcttggaccctggggcagggagcggcacttcatggtgaagcagcgctagactggaatccgccccagctctcacatctgttcatactgttgtggtggggcgagcaaggccactcccagtggatatggggacctggggggtagagttaacttctgggcccctgtcacattgcctttcgaaaccctatgctggaccagccctttccttcctcttcctcccctccatccgtccctccctatccctccctccctatcccttctaaacttctctcagatgcaaagtttaaggaaggaaatggataccaatgcacaggaggagaaggaagaggtcagaacagctccagatggggaccgagagggcagagggcagcccgtgggtaggccaggctggcagggagaggacaggcacccagggaaggggcggggctctctcagggagtggcccttggagaatggctcatggtgttttcacctcttcatgcccgtttcctctgtaacatgtaggagagtcacaatgcccacaccacgtggatgtgttaggaaccctagtagcagagcacgggtaaggcactgaggagcttgcctggcacgcgctttgttcttgcttctgctgtcattgtcgtttaggacagtattattgcagttattagtctgagagcttcttttttgagcttaactctgcactaggcattgtttgagctttctatgtgttgacccatttaatctcttaatcctcaagaggtgagttctacttcagtcgcactttacacttgaaaaccccaaggtgcaaacaggtaacgagcttgctccaggtaacaggctgccagtaagtgaggcagagccagctttcagcccgggtcatgtgagagcaggacctgagctcttgctgaccagcctgcgctgccttcgggaggtggtggtgattgctgctgttatccctggtgtcaccagtggagcttgtgttccaagaaacgtgaggccctgcctcacctctggtgtacaagcacttaacttcttttctctttaagacatggggtctcactctgttgcccaggctggacttgaactcctgggcccaagcgatcctttagcctcagcctcctgagtagctggaactataggcacacgctaccacacctggcttatgagcacgcacttctgaaaataagagttgggaggaccatgaaagcctcatgggtcagcacacaaggactaggagagggacaggctggaagggatgacatctcttgcagcttctcagctgggctgtgctttgctttcctgtgcttctctaccatccccatcgaatcaaagacttcagggaggatttcattctgaatctgggcctatttcaagaaactgatgaactggtgggatttcttccccactccctgacatctccctgctctgatatccagcaatctgctcgggtacacagactatcatgttttctactttatcctcagtgtgttgcacagggtctagcccatcatggccactcagtaattactggatggttggatggatggatgatgggtagatagatggatgggtgagtagatgatgggtgagtgagtgggtggataatggatggatgggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgagtggatgagggactgagtgtgtgggtgggtgggatgatggatggacgggcgtgggccggatgagtgggcatggactgtcgtgcgtcaggtggctatgatggtatcgcagtgtcgtgcgctgggtcgcatgaatggtgaatgcacgtgtgtggtgcgcgctggatgcaccgcgactgaactgtgctggtcgaggtggattgatgggactgagtcgtgtgcgtggggtgcgattgagtggcagtgaggtttgcttcgtggacgtggatgaggggatgagtcggtgttgtgttggggtggattgcaatgcgcaatcggtcacggagtgtggtggatgtactcggatgtaactgtcgtggctaggttggaatgatgagtagtgaggctgtgctggtgggctggattgtagggaatgaggtgcgtggtggtgtggactgagggcatgtatgtgccccgctgtggtgggtgcagcggatgagcgtgctgcgtgggtggatgacaggaatgtagtgtgtggtggcatggaaggaggtgaatgacatgtgtgtggcgtggatgagggatgagtgtgtggtgggtggatgagggatgagctgtgtggtgggtggatgagggatgagtgtgtggtgggtggatgagggatgagtgggagcatgatggacggaggggtgggtggatgatggatggatggtgggtgaatgatggatagatagatggatgggtgggaggatccataccacaatgagggatggatgggtgtgctgatgaaggatgtgtgagtgtgtggatgatggatgagtggatgatggatggatgggtgagaggataatggatggatgggtgggtggatggatagatagttgggtagatatgtgggtggatggatggatggtggatggatggtgggcggatgatggatggatgggtgggagaataatggatggatgggtggatgataggtgagtggatggatggatagttgggtagatgtgtgggtggatgggtggatggttggatggtggttagatgatggatagatgggtgggagcatctattccacaatgagggatggatgagtgtgtggatgagagatggatgtgtggatgacggatgggtgggaggatagtggatctgtggatggataattaagtggatggatggatagttgggtggttacgcggaatgatggatggatggatgggtgggtgggtggatgggcggatgatggatatatggatggatggttggatggatggatgggcagatagatggacgagcaaatatggatccgcctccttgattggttctgactaactcttcttctctccttttgtcctcacatccctcagatgctggggatcacagtgtcctctcctttccactcttcatctcagcttccttgactcatagtttttcctttccttgcagtctggctgttgagcagtgttagctatgcccccgtgtggtgcctcagagactcagccactccccctggactttccaggcggcagcagggaaaggcttaggagaatgtcagaaactgttggatggtaaagtgtgtggaggagaaatgaagaggaggacacccaggcccttagccctggatcctaaaggagcgggcagtggagagaacctgagtgctgtcagctcagttccaggacctttagtgaatgtcagtgggtgagagaaggactaaacatgggccctagtaagtatctgtacagtggattagttaatgattgagaggaaacagccaatatttgatgctgttgtaaataccaaagaactaataaataatggggaaaactaaaaccttggctagctctgtacagacaatactcttcagagcaatttatgtaaatgtcaaacttgtctgttaccctgtttgtttgtcttacatagatttgctcatcacctactatatatattggtgtgtgtgtgtgtgtgtgtgtgtgtgtgtgtgtgtgtgtgtgtttttacatggacttgaaaatgagtaagacataatttttgtcctaaaggaacttggtatctggttgggagggcaagaaatacatataaataatgtcaacatagggtatgatgagagccacgaaagagttataaacaaacagataaagaaatttgcagctaacagagaaagcgtgtgcattaaatgtaaaccctgtctccttaggaggaggctatgggatggggcagaaggctctgccaaggcccaggagggtctcctccatggctgtgaggccttggccagggacctcatatctctgacccaagtgggccagctgagccaggccatcaacacagctccatcactgaggctcctacctgggagggtcatatatgtcctggagggggacccgctggcctaagcctagaatggtggctctgcctgtcattaatcggtgccatatgcatattgtaggctttgattttggtgctaagccctgttcttgtgtgctcagccatatgttggtggtgtggtctggtcatggttcacgttagaggaagcacacatcatgagagagcccagagggcatggacagacctgcgtgaatgtacctcattccttgcaagacctcgcacagccttggtgctccctcacactcaagtcaaacatgcattcatgtgtttgtaggaaacagccccttgctggggccatgttggtctgcagtagggccaggcaatttgcatatttcctccattttcctaaagtaaaactgaaaaatgagaccagggcctctcaacacccacgttctcatgaatatggcactgtgtgacccttgacgagagaaaaccagagagtgctttcttttgattatgttcacttgatgaagcaaggttgccggaagtctgcccttttcttgcagaaattcacaggattacacaatacttctgtcccactttcaagcatccctgtgaaataagtaggttttgaaaagcaggtgcttggctttcaacctaagccaaaaggtctggatgactcctggaagaagacagagtatcactttggacaaaatgcaaatccatttagcaaccaagacaggaggaacttttttctaagtggaaatgcaccctggttgaggaggccagggcagaagagtgctgtctagagcactcagcagccaggcactgagctgcgcccgtggctgggggcttacacatgtatgttgctagaacattctctcatccctccaccagcgcccctacacacacattacggaagcagctctcagggcactctccctaaagaagactgaatttgctccgtagatattgattaagtatctggacttaagaccagagaagaaggtaaaatgaagctgaagtccaccatctttctatcttcagttcctctgtgtagggagagaaccattgtttcatgcttctcacatgtgcagtcttctggtaaagtgaatcatagaaacataatttgaccattcagagaacctttggactgagagatggaagcgggctacagggagaaaagatagttaaactaactatccggtgtagacaccagggctgagcccacccctagattgttgccccaaatctctcagctaatcccactcttatcttcatgctaattttcatttctatttttttcataattttcatgagtcacacatttattctagttaaagtccctcttttaaaatataaatcgctttaaaaggtaaatacaaatattttacaaataaaactattaaggtgcagccatttctattcagtcattcttgtgttcatcaaatatgaaatttgaactccctatggacacatttgagggttcacacttgaatccagagagagaagttcaatggcaatagcaataacaaaaataaaaggtgacattcattgagctcttaacgttgtgccaaagtaatttgctttcatcatcttatttaatctgcacaacaacccttcaaggtggggttcagttaatgctgccattcactgtcaagaaatagattaacaggcttagaacccataccagttcagcttccagtaaaatgtagtttcttctgaaatacctcgttttgagggactgagtttaccttgaagcccttcctccagctgctgccacatctcaccatgtcttggcagctatgtcatagaagctgccagtccacaaggccctactgtggccagtcagcactgaaatctctcctcttttccacttacctctacagcatggcaggaaggccttgggctgagaatactggttagcgagggagaagcgcaggctctgccagggagaactacggggtgggattcaggctcctttctgggtatgtggtctctaggaagagcaactgcatcagagagaactgaaggagaggtggccttggaggagagggctggagagcccagctcccacccaggcaggtgaccttgcacagggtcgtctgctctcatcatgtgtcctgacgatttgatgagcctgctcttgtttggaaactgtagaagtgtgaggcctgttgctgaaagtaactttctcttccctccacaggcatgaatgctttacagttgcagaacctggcgacgctggctgctgctgcagctgcggcccagacctcagccaccagcaccaatgcaaaccctctctctaccacgagcagcgccctgggagccctcacgagtcccggtgagtgtggggggtgctcttcccttgcaggtgatgcagcaggagtggcaggtaggtttccgtgcctccaggtgcgagggtgaggctagacgtgtccaggatggagccgggatactatactgggctgctttatgtcattgggttattttatttttaaaaatggtcaaagttcgaatttgtcttttattttccatggataatatgcaaaaaagttttcagtgagaatccactgtgcaagccgttctcacacattcactctgttttaaacactagtccattcaacactagttaagttgttaccactgtgaagagcctccgtctcttagtctttctttgtcctgcccttttccaaaaaataagacaatgtaagaattctgtttcaaaattcctagtcattcccatgtcacatttcacagcaactccatccatcacatttgattttaaaatccacggtccagtaaggaacatgtttgctcatttctggtcaggctctggggtgtgtcatttaaagtctttttttcttcacaaattttgttgccttgttgttcaaaagcagatgccagttgtcttttcatacaagccagatagaatgtggttgcttagataccgtgatttgaggttttgttttgtttttttttaatttaaaaaagtcgaacgtttcactggctttccatctctgagttttccagacctcaatagatggtctcacctccttttctgttacatgaaggagatggcctggacagtttccaagcttccttctaactttcaaaatcccatgaccccctatcagctgcgccccaaggattagctaagtgttggaaaaacgttaatgaaaaaatagcttcaggaaacacacatcgaaaactacagcccactccacgctggctgttttagggcttttgacttgagggaggaatgaggcaggttcctagagctggcagttctcaaaagagcagttgccctttgtctctgcataaaacattgtgtatctaagacatttcacctgggggattgtttcgagggagaagtctgagagatgtttaggagaagctggtggatttccctgtaatgtgctgagatcgcatggcaggtgtattgacttcactgtgtacagtgtcttcaaaaacataccgttactgtatgagggccttatctaatataataaacactattcctgaaaaatcaactttgtcacccttaatttcaggaagttaagtgatagcttcagtgcaacacatcaacttacttaagtaaatcctgtaacgatcccttttgagaaataaacatttttaacatgatagatttccccttcataaaaataagtcatttttttaaaaacatgaaaattagaccctcccaacttagatttcacaaatcagattaaaatgtattttcttaagagggattttttttctcccctgtgagcactttgattaccccaaaatagcactgagtattgtgaatgcattttggagcatcttcagtccaaaggaggcttgacagtttaagaagccaaatgcagaagcagctgtcggctgattggtgtagctaagataactcaaaaatcatatcccaaaagcgctttgtggtgtgagcaggacagatgtgctgcctaccttcgggagtccttcagtccttcagggacttggacaagaagcaaagcaatgagtgtcagatctgtgacagaatcccactgaacaaggggaaaggggactggaggaggtgacccctctctcaaaaggtgacctttgagcagagacctgagttccgtgacggaagccatggcgcgtgttgaggcagaggacagagccagtgggtgggggagagcggagtgggggctctgtggtggaccgcgtccgttccagcccacgttgggaggagtgtgagcttgttgcaaccttcttaaaatgtgggctactggagatcatgccactgcactccagcctgggcgacgagcgagactccgtctaaaaaaaaaaaaaaaatgtgggccactcagacggtctagggcgacggcctaggtgttagtcggaaaggaattttaaatgtatgtgactattttcaatttcttcctgagactgcagtggaggaaaatgtgttgtgggatgagccttcctccctgctggagtcaaaaccacaccagcgcagcgtccttgccttgactgctctgtaagaggcttcttgcccttcagaacacgccgctcgcttaggtgtcactgagagcgatttttctcttctctactgaggaatgctttgcataataactgaaagtattttattagaatcctaaagtgtagcagcagcagtgattgaaatctacatttcaattatttttcttaagtgtaactaaaaaatctgatgtttaagtgaaagtaaattatttgtctaatttccatcagggactttttgaaagtcacagaaaatgtggttagtagaattcatgaatctccacttcatcaaggcagtttcctagaagataaaaggggttgaaagccattcccaaggccattgccattatttactttttaaataataataaactgggcatactatttggaccatgagccagttcacttgccctgtgagttgaagggaagcctcatcccatctctcctccacaggcctggggtttaccctgtttttaagcgtgtctcttaagcttcagacaaattcatctggaaagcaaagggacaattcaatcccccaaactgttaatttttttaataattgtaaatttatcatttcaattttgcatacccaggaaaagtctccctacagcattattataaatgattttaaacagtcttggctttaaaacatgaaagattaagtcttaatttttgttaaaaaaaaatcccctcaggcaataaataggttcctttgtctcatggccttgaaataaaaattaaaatagtttaaattgcccatggttaaaataagtgtttcgtgcaattatcagatggtagtgaataaaattagaaattaaatcatgaaagaataaaatccaggtaagtgcatattatgccttttatgagtttctcacgggtcttttgaagcctaatttaatcatgtttcttgtcttttattttgatatgatcattttacctgtgtttaccccagtctcctatttagttaattaattcttgggtcatttattgttacccagtttttaacctgtttttgacgactgtgtctctgtttatgcaagaggcaaattgtctagaaggggtgtagctaggtattaaagaagataatgtttgtcttccattcagcttgcaaatgagttagttttgtctggtaattttgagcgcttgaagagactgttactgttaccacacatgaatattttttggtattttttggtctaaaatgtattgcattcacgtaccatgttattccactgaacttcttctgtcttcttctttaaagaaaaggatgctttaaaattctccaaatgcttctgtaagtgcagacttgaccaagtacacatccaggatcatagactggttcttcccatggtacaaggcattctaaaatgctaggaagcattttttcattcccaccattgacccttcaaagagttatcactttgaattctgggtggtattttccccatcttcaaggtatccccagcttccttgaaggctgtgacaaacaccaagcttcaaggaaatggtgacacttcctctttgactatctgagggtaacagagattggagtgtttggacgttgttcaggcattccctgctcgcctcacatagtcatgaccgatagacggtgactgttgttcttgcacacctgtgtcaccaaagcagctgaatgagcagtgggaaatgagaattcacccttgaagttatcctgtggcctttccattgacagggggctttgtcgccaccttcaatagatgtctgcatttgcatcagaggagaacttgcattaggcaaagaggtgtgatgcataagctggtttaacccacatttctgagccttctagttcatgcagggcaaatacataaaaatgagttggggcctgcactgccccctccaagtggtgacatgcacgaggcagtatcaccagatgggaaagagtggggcaggagagagggacagacaggtggacaaagaggctgtctccccaagactactgcagtggtcccacagcctcagagtcgagaattaaacttgccccacagacctgcccttcccgctgcctgccccaccctgctaaatggattgtcccaatggctggtgtgacttggtcgctgatctttgcagctggcccctggctcagctgcgtgcctcatcagcccctcagttctccctgtgaagcatcatttccctcccaggcaacaggagcctggaagagacccttgtcttctctctccttgtactactggaacagcctccaacttggccccttccctctgtctgtcttacacactgttggcaactgcggtctagactggagtgaaacaaactcctgagtgtggcattcagggtccacctggaccacctccgcccttccatccagaatccagccagcacacactcgcccatatcaggccaccccccgtagcccagccacgccgtcggcctttacgccattattcttgcaagcttctctacctagaacatctcccccatttcctcccacaaaaatctaatacatcactaatacttgttgcagtgctcattcttgagaatagtgtgggtgggtataaaagcgtttctaatgcacattataaaaagtatagtttatgctgcttctgtaatttacactataagaagatttttggcggtaattagtaaaaactgttttcagtaacctactacttatatgaatcaatgcaaatgccacctctaccatgaagccttctagttaggattgatcacttccacatcgtattgctgagtaagttcctagctcattctagacctggggcagtgcagaggttcctgaggagctgtcgggctgcttgaggccaggggcagagagggctggagtgtcagtgctggccaggcgttctgcagacgtcacccctctcctgtgctcccagggcacactcggcctcccttcactaacactgaccctgttgtctgcaggacggtgatgtgggcactcactttgtgtcttgccctctagccagtgagttattttaaagtagggaaggtgtgttatttactcataattcccccttgcatctggagcagcacatcagacacaggccctcaagtgttgtttgttttttttttaattcagtggaatagcgaagcaaaaattgtcaaagacaaatgtttaagggccatctgttcagtctagtttagcgcacacgtctctaaggaggcagctaaatccctcacagtgacgttggcagggtcagcgtacccacccagttcacctgtaaggcgtgcctctgcctggatccctcaagaaccaaacctgcaatttggtttcaccttacaggtgaatactcaggtccaacaggtttctgaagaataaatcagtactaacttacaccaaaacaatcatatgaagcagtctttttattacaggggcagcttattttacaaatagtggctttcaaaatgttctgatgtcacgatatagaataagtacgagtctggtatcagagaagggcatttcaccttcagaagaaccacctactctaatgtgtgcttttgaaacataacatcatggcagatcatccccagaaagtgcccattagctctgtgtgcactgctaagtccacgtagtcttccggtgcctgcccacactgcttacataagcaaggtcccatttagctttttagagtattttttacttataccacacttataaaatacagggcattttataagtgcaggggaccagttattcctgggaagatgggcttagcctttaccgtcctctttttcttcttacacccatcttttgtcattgtttattcttaagagaaagaaggaaatctcaaggtagaccattcttccctccactagcggctaagtgtctcagtcaggcagagtcaagccagttggtaaaatgggctgttcatgtgtgggtttcaatctgtcacacggccaggcgcagtggctcacgcctgtaatcccaacactttgggaggccgaggcgggtggatcacgaggtcaggagttcaagaccagcctgggcaagatggtgaaacccagtctcgactaaaactacagaaattagccaggcgcagtggcaggtgccagtaatcccagctactcgggaggctgaggcaggagaatcacttgaatccaggcggcagaggctgcagtgaccaagatcacaccactgcactccagcctgggcaacagagtgaggctctttctcaacaacaacaacaacaaatctgtcaaacgtcttttcattttttattttagctttcctatggtgctgacagtcaaacttgtttacactcattgctgcagtagaaagagcactgacctcccggtctttgctcatttcctgcaagtttcaacattttacactgcttttctgaaaattgtcttctttgctcgtgacattatggggctcactttattttcattaatgttaatggagtcacacattacataacatgttctgtaaataaaatgactctgtagtgactgtcacctcttgatagattttttttttcattcattcaacaaatatgtatcaagcatctgtgtgcctggaactgttccagcactggagacacatcagtagacaaagctgatgaagattcctacctgcatgtcctttctcttctagcatcagcttttaagaaaagcgtcattttactgaattcacaccatggtaaaaacaatttgaatagcctttaagtataaattgtaacttctacactcttaaaacgtcataaccaatattttgtatatcttacgttaaattttgtgaatgagaccaagagtgggagagggaagctctcttctctcctttcttcctctcctttgagctgtaccatctttctgtgtgtttggtgcagcagagagctgggagtagggccccccttaaggtagaactgcaagtggccaaaccagaaagcgagagggtttagcccttggccctgctgctcgggctgctctgtggcttctccacagaagcatgacacacaaaccaggtggtttgaaagttcttcggcatgtaagactgatactgttggggagaacagtagttggaaacagtgtgtctgcctagtaaatgtcctttatttggcattgatcatcctgcttctaaaggaggagagagcatgcaaacccctcccacccagaggggttttgagggccccttgtgtggagggagtttgggtgtgcaatgaacttctgcctagtgagtggatggatactccaggcagttggtgcaatgccccaacctggagcaggctggagtctcttaatagtctgtaaccaatttaaagcttaataaagctgcgcagctttgggggtagagatatttacggttcaccacagagcccacgctgggatttatgcaagtagattccacctgtgccctgagctctccttggcgggtgccttcatccccgggatggacagatcctcgcgtgcatcttagggctgccactcaccaagcgcattgttccttgttttgagtgggctttttaacatgtgcagacattgactctaattcttcacgtatttgctttttgctgttggtggcgctggactctgtgctaagtgtgatttgtttttaaatattgctttgcagactcttctgtattgtggcaaatccacatcagatccccttgtgatgtttatatgagctcaggctgtgttttctgtccagccacttaatgagattttttattctcactaaatcacagaaatttttatttctgtgatcttgtatgatacaaacatgttatcaccactagcactggtgaaaagcatgtgttgcttaattgtgttatattaggtgggaaaatcagcaaagctttattctagtcacaacttcccagaagcgtatactgtaagttccatttcttcagacttgaaagcaataaaatggaaatttttagttcagatgtggtttaatcccgagaacccgtcaccatcaactagatgcattggccacctacaaacacaagcaaaatgtaccgacctgtacagcacagacagcaggaaggcaggtaaggtacaggggtcagtgacaggagagattctgccccaaggaagtaagggaaattttagtagaagagttgacatttgagccaaaatgttcagggtgggtaggatgtttaaaagtagaagcagaatggaagatacatcaaatgtgggaaaatgcagaaatagcatttaatcagcaaatggaagttcatctcacttttcacaagcatggacatatggaaaaggatgcccaccggggaccctgagagccggggctcaggagctgggacttttcctgtcagcagtgaagagctattcaggactttaggcccaagaatgatagacttcctgtgtgactggactgaggcacccatttgatgtgagggagaacaaaaggaaaggaggaaaaatgatatggtgtgttgggcctgggtggccagtggagcattgctctcagttgtgaggggagttgaggaggaagctgtcatataaaatgatcggacgtggcacatggagagctcaagtgcacatgaacggacattccgtgaaatgtgtccagcagcagttggatgtgtgaccatcaggctgaccagagccgggagctgcagagtggattgagactgacctgcagaggccaggcgggctgccctaagcccggggaggggtgaggtcatcaggccaaaatcaccagcaaggcaaggcggggaccaggtgcagaaagccttggggtctgtgcttgtggaacagagggaccaggggatggaaagggagctttctgggtagcacagtgtcaggggagccaagcaggatggggctggaggaggaaaaggcagaaagagctgactgaagtttgagttggggagtgggttctccccagactggctgcttcactgcagtggttgacagttttgcaggcagtgagagaggacacaattctatatgacatgttcatgaaatgtgaatatttttaaaaatctgtaatggggccagtcatggcagttcacacctgtaatcccagcactttgggaggctgaggcaggagttccttgaggaactccctgaggccaggagtttgagaccagcctggccaacatggtgaaaccctgtctatactaaaaatacaaaaattagccgggtatggtggtgcacacctgtggttcccagctactcgggaggctgaggcaggaaaatgacttgaacccaggaggcagaggttgcagtgagccgagatcacgtcactgcactccagcccaggtgacaagagcaaggctctatcttaaaaaacaaaagaacatgaaaaatctgtaaaagtactggggtcactaggggaagaagtttttatgtttttgttttaagatggagaaacaaaacatatttgtagaccaaagagaagagccagaacaaagggaaacaggaataggccaatgagagctgaaagctggactagagttggagggctggctggagggatgagctcagcctccagcgtgtccctctcctgtggcgagggggatgctgccttctgagggtcgggtcacatgtcatctccccctgggaggagcccccacagcagcaccctggccttgtggtgccatctcgacctggtactagcacacaagccaacaggcacaaatctgaatcagggctgagtcagcaggtggtgcagcctgagggagggaacactgacctctgtcaggattggggaggatgccaagaatttaggacagaagggtacttatatcacatatgggccaagaattgatatatctggggctagaaacaaaaactcatgccggggcagaggtttaagaaaaagtcaacctacagaatgtaacagaggatttctaattatatttgtctttctagagtatgtagacatcttgatcaagagtcattggagcaagtaatgtaatcttaattattttctcagttgtgaaatagaattaattgctaatactcacttttcttgtggaaacattgaggtttatatatacacacatatttatatttatgtaaatgtatactggtgcttttttaaaaaaacgatgtttaagtatcatatatgggaaagatcgaatcattattttggagtgatacgaaataccacagctctggagaacagaagactaggttaaaactagaatgagggctgatgatgtttaggttaaaactagaataaggtccgatgatgtttaactgggttaaaactagaataaggtccaatgatatttttctctgaatctcttgcctttggaaaacaagtatctccccacctttcctttaaaaattaggatgtaaatacagggagaagacagtttcctcactcctttctgcttttgtgttctgctgttcaagggaacggggaactttctacctaccacaaatgccacttgagctcctagaaccaacatcccctccttaccaaatacaaaatggtaagactgggttaaacagagcaagactgctgtgtccaggcaggatttctgcactaagggtcaggcctgaggcccctggggagttgttggtttgtatctcgggccacacggcgggcggtgcgtgctctgcaccgggcccttgcaggggcagcagtcctactgagtccacgcggcgccccagcgagcctgcagccctgctgtgacgtccctgggctgcgccaggtgacctcttgccccctgctaccattggggtcatgttgcccagaggaaaatctgcctcccagaaatgatgttctctccatctggacaagctgccccccaaccccccccaggaaggccagacttcagacaggctgtcagtgacatggtgacatgggcctgctttcctgagaagcccctgtccttgccctttctcttcagaggcccgagcccggtcccatcattaaatgctacagctgctgttatgtatccaactgcctcttttgtgatccacgtgaggaaaacagaggcctgcaagggtcagtggtttgcccgggatgttagtgacaggtgaaatgacagcgccaccgcaccacgagacagtccatattctaagcaggaactcctgggatcccagaaccgtatttctgggtttcgccaattacacattgtcccccttgtaaggagatcatcaacatttttttttttcggtccttctccgggccatctgtaaaaacaaacatctggggccagctaaaggggaagtatatacttttgtttcagtaaatcataagcaaaatatcattggcagggaaaagaggtttgatttttccctctcatttgccccgctcgtaggagatccctgtgtactgcctgtatgaatggactcttccaaactcatggccccacactgcctttatgagtgcccgtcttcacgggactggggaagatgctaaaaattaggccgggtagggaggcaccctggtttattgacaacccatgaagtagatttcttagatccactagacagagcttccacaagcctttgggaatgaacattaaaggagtggaaacaggacagctgctttggacgtgaggagcaggtgctggcccctcacttccccgccttccacatgtgtgccaccgtacaataaagcctcagcagtcgttctgagtccagacccggccctctagactgaattttcctcttcccagtcttcctgagaaccagtagtgatgactcttgcccagcactgcaccaagccaggtggcatcagcttccttgggaagcagaactggcagcagaagagaggggcaccaatgtctctggggaaggtaccctcttccaggctgggagtgtgaggtcacacctcaccactgcagcgcccagtgtcactttccaaccctacctcctcttcctcagtcaccccgcccctccctgcccaaactatcttcgagggactaaattaaaatgaaaggtgtggttattgtggaataattaggcctcacggggggagaggtgtagtatattaatgccccagggttgtgattggctagtaatgctagtgcctgtgtcatggcttaattatcctacttcctcacaatcttttcctgcgcagttggaattccgcatccaagctcgtttgaggcaaaacggcgaccgcgggctccagtgtcctgagtatgtttggtcaatgcaggcgattttctccgtgtttacaatgattttatttcctaaaccacaaagccactgtgttttcactatctaattgttctgtggaaagtgtttaacgagggcaccgaaggcaaattcttgctgtcttctgttaatgttgttttgttgcagctttaaaaaaaagtattttgctatccaggaagagtggggagtagggttaatatgagaacattaatgcatttgttcctagaaagcaagccagtttctgggacagacttaacgctagacatgccctgcagatacactgagaccaagacaagggcgaaggggaaaattcatatgggaattatattttaaataaagaactggcaaatgtgagagatggataagcccctcattgctgtttttctccctttcgtcgtggatctggaatctttagaaggatggaggaatacccaagttcctccgcaggcagcctcaccccaaatcaagagtcttgttcaccatcccaccttctacacagaataagaagcccactggagcccctatgcgggccctgctcccgctccccaccccgcttcccccccacttgcgacctgcgactccgccccagaggcacgggctgcgcagacaggcaggcgcacacgagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtggtgaagactcccacagcacccccccaccccgctcccgctgcccccggccccgactcccgttccagtgaggggaggtgggcttctccaggacgggcttggactgggcctcagctcccacctgtgcagagtggcggcctgggagctgagcgtggccctcggcagccctgcttctgagctgcatcagaggaacggaggggttctctggccctggcccggtggcaccacggcagcaactggctttacccactctgtttctgaagctcttcctattttctctggcacataagcagaagggaatggtttgatgagggtcctgggtggggccacaggctcagccatgtcgtgaggagccccagttaggccgcgggaggtggagtgcgaggcccttgtccagcgcactagggcctgcatgtgggcctcatgtggagagagccagacagggtgcccaggtcagccgcctccgccttcgctggaaccgcctgcccctcctccgctcagcagatgccagctcagtgcccgctgcaccagtgattctcatagtttctagggaaacggacaagcaaatccctgctcttcaaccggctgtcttctggtggggtttcttttcctctggaagaacagaaccgtaacttaccactctcacctagtttttgactctgggttccttggtgcccagtgactgttgccctttcctgtcacaaaccaaaccttcccactccctgcagcctctcaccttctcatgcctcagaatcaagttttcacccagtcgtgatggaatttgacagcaccgcatcggatagtcctgacacacgtggttctctaatgtttgcatgcaaaagcagcgccgagggctggttcaactcagatgcccaagccccacaaccagagcgtctgactcagcgggagtgaggggagccccaggtggtgccgatgcgggcgaggctgtaactttacagtaacgatcttctccattaaatgtgtctgtggctacagtgcccccaaaggacaggattgggcccgcctcccccagacaagaactctgaccaaatggcctgcagagcatccgcagcccagggccctgggccaaagggacttgacaccacacaactgtggtctttttcttggtgactttctctgtgatctggtcatttaggatcgagttgggtgtacttggtgtggcagctgctgtgtataggtttccccgggagagaaagtaaaagctgtttccattttaagcttaatggggcttgtatttatgtcgatcctttgttctcgggtctctaaattgacatgagattttcacattgttccgctgtgctgcggacagtggaagttggagccttcaccagagttctgcctggaagcattagaatcctgccttcccggagtcctctctttctctgccaggagatgaagccagcgtgtgtttggcacaacaataagagcttttcaatagttggctttttggaccttgtggccatcaagcctagcctcagggtctacagaaacccccttgatacatgtcggaggcatctgctttctcaccccacaaacagggactcgagtgcctcagaggtggcccagcggaaacttcttccctagccggctctcctctgtatcgaactaaaatctgcctctgaacagcttccacccactgatcctaattttgatctcttgagctgcaaagaatatctttctcacgtcaagacctaagactgtttcttgccttagtcccttgcctctctaggctcaattttactcttatcagctcactctctttcaactcaactttcatgtctggtcacccttctcgggacgctctcaaaactatacacacagactgaccttcccaatgactggactaatgagaaaggctgcaaaatcagtcatccatccagtcgccactctggggaagaagatgttgaatcttcattgcaagtgctgtaaaatgaagtgtaaagatgcagttcctcttttgaggacagaatacccagattctcctccttcagatacagactgaacacacgtttattgatcacccgctgtgcatcagacatcagtgccgccttcttggattgccacgcccatccgcagaggcagtgtgtgttactcccgtttcgtgaataaacactaagcctcagctgaatggagcagatggcctaaggtcttacagactggaaggaacagagccaaaaaattaaaggcaaatctgagtgagtgcaagtttactgcttccataagtaagtctctgcagtagccactagatagacataagaggggaaatagaatcttgacttccacatcaacataatgctgactttgcagccagacccctgggtttaaattctggctctgccactgagagttgtgtgaccttccgcacgcgacttcacttcacaggataactgtaaaggacttaataggctaaggcatgtgacgtgcttttggcaatgagcagcacgtggcaagcactcacaccttagctgtgctcactgttagctttattcccagtacggtggagctgcagaatgttagtttcctgttgctgagatgacaagttaccaccaacctcatggcttaaaacaacacatttattatgttgcagttctgtagatgaggaacccagcagactcactgggctagggtcaaggtgtcagcagggtgtgttccttctggaggctctcggggtaaatccatttcctttcccggcttctgcaggccaccagctttacttggctcatggccccttcctccatcttcagagccagcaagtcctcatgctgccatctctgattttttctcttttgattccttcttccatttacaaaaacccacccagaccatccacaataacctcccccatctcaagttctgctgatcagcaactttcctagtccattttctgtggcttataacagagtacctgaaagtaatttattttaaagaggaattatttcttacagctctggagactgagaagtccaaggtcaaggcagtgcatctggtgagggccttcttgctggtggggactctgcagtcctgaggcagtgcggggcatcacatggccggggctgagtgtgctaacatgcttgctcaggacgctcttcctctacgtataaagccctacttccactcctgttacataacccatgaattccttaacccactaattcatgaacggattaatccattaatgagggcagagccttcatgatccaatcacctcttaaaggccctgccacattggggataaagtttccaacatatggaatttggggaacacacattgaaaccatagcacattccatctacaattttctctttgccatgtaacctaacatatttacaggttccaggacttaggacatggatgtctcgggttggctggggggtgaacagagaacataatagtaatttttagttccctctccaaacatagcccttaggccccaaataagcttcatttacctatccaggaatggcgctgtttgaacagagagagaagagagaacgggaatgcctttgtcaaacacgcatcggcatcttctggttcaactcggtgccccctcctccagccctggcccagtggatacaggtccttcccagttctaccagtctgatagtcacccctcctcccacaggaaatccaaggctggtgaggggctagggggaggtggtccaggttatccacatagcagagaaaagaacttttttctggaaagtggagctcaggtccttgcctctctggaaatttatttgagttggtttgagagagcttccaaacagcccttcctccacaactgctgtatccctaagtggcaaaggccattggcctccttgtggagtcctcatgcccacacctgggtgccggcgcccatcctgcatccctcacgggtacaccggggccagtcccttcaacactctgggcctctgcttcctcatctttcaagcgcaggaaagactccagtctagttcacagtttgcctgggaggatcccacctgcagtaaaatatccgtctgaaagatgtcctattacctgttattgtcagtgggattaggaagagaaggaaggttggggggttcagctctcagctctgttggagatattatacgggagttattccaggtgatgatctagcacctaatgacctaggcactcggtctctgacctacagtgttaacctaagacaagaatctcttctgggtgtagtgttcatcccagacctagcacagctctaaggagaaggaacccatcccgtcccctcagttgggattagtgtttgggattactcaatttgtagttttccaacagtgagcttatctgggcaaacaagcaaagaacttctgtggccaggccaaggtgggcatatcctcaccatcagggtctctggaccacctcgcttttcctgttctccacaccccaccctgccccacaaacagttttcacaaaaggccacagactttgtctgcacatgagctgataaaaccatggccatccttgcctgctcaaccattctctttcctggcacgccagctggcctgaacgtccgtcgcctgattgataggttttaaccagtggtacaacaggcttaaaatgtgacgtatccaagttattgcagccactgtgcgagcaaggtgaggtgcactttgcagcctccgtctgggatcctcttggctttgttctgcctcctcctgcttggatggtgcagcctctgcttgaagaggtgttctgggagattatgaaccaacatttatagaccgcacctctcctgagatgctcctttggcattttgtaaaacttttaagtgagaaagcgtagggtacagttctcagcacagactgaaggaatctgaggtgggaagaatgcagatggttgtccgaggcagcatcttgccagcctgccagcacagaaatggagagtctgggtgttggtggcaccgcatgtgtctctgtctaagacctctttctcaattgtgcatctgctgaacggtcagtctttaggtacttgatcaaggttggctgtgtgacaaattggagtttttcttatgctttaaattatttgttaacattcagaaggttcttaaaggtggctaaatgtacaataaaactaccctcttacaactgagatgccagttggggtgaattttcaaagtattgtctgatgatgtagagtgcacagggagtctttccactttaaggcaagtcatctagttaacttttcttagtctcatgcttgattcttctccctccttttcttcaccgtctccccaactttctactgggaccgtctaagaacagcgtagtaagaagtgagaaattatgtccagttcactatagccagcctcccagtttttaaataggaagccagggtgtaaagagacctaatttgcatattgattcattgtcatcaataacaaaaggggcccagggagtttctaggccgcctccacctctcctatggccccctgagctaggctgccccatgctcataggctatgcgcgtatctgtgcctaaggagttctctgtccaactcactgtttgccatcaccattgggagtcagccacatgagagcagtgtgtggcatcaacacacctgtttgcagacccaccttggagacttggaggatttgagaagtcttccctaagcacaagatcagccaggcctggtgtcctccagcgcctcttctcccttgccccagggcgaagcactctctagaagcgcgctctgacgggcactactctggaggcacctggatgggggcgcagcaggcagcatctctgggccagcagttcacagtgtggacatcataggaagagaaaggttacagcctggcatacagggccctcctgtgatttcctgcaaggtgggagaaggtcctccagcagaagccagatcagtggctgtgcagtcatcaacagttggagatgtttagatgaaagtggggaaaagtgttacctgctttcattgtttcataaaatagatcctatatcattttgtctgttctgttcagcctctacctaataactgatgatgatctaaaaatggtgccaaatacagtgccaaattcattacatagattatttaatctttacaataacccggtgaattcagtgcccttcttcttcctccgtttaaatacaatgaaacagaaggttggggagatgagggaacaaggcaggcttaatgaaaccccattttgcctccagttgttttgtgttttgtttttaagattccactgaaaagagctgatgaaactatagagttgtgttctttattaagagctatagtttcatttttcagtagcaatggggctgggccaggaccctttttcctgcctttctcagtgatgccccatgccagccaacctccatgatccttcccctgctcaccacagaggcaggcaggtgaccatccccacttacagtgcaaaaaggtggggagactggtgaggtctgtgctgtaagatgacgttctgcacagtgcaagctgcagagactaagagcaacagcctgtcttgtgttttgtgtcttgtgttttgctagatataagattctgagttaataggttttttctttttagcactttgaatatgtcatcttactaacttctcatccattgtttctgctgagaagtcagctgttaatcttactgggatccatgatgaatcatttttctcttgctccattcaagattttctcttaaactttcaacatatttctgtcatgtgccagggtatagatttctttccatttatcctacttggagtttgtttattttcttgcatgtgtggattattgtctttcatcagatttgggaaattatcagccattatctcttgaaattttttttctggtctttagtgcatgcattacacactttacatgtgtgtgagtgtgcttaatggtgtaccatatttctgtgaggctctgttcatttctccattcttttttctttccatcctttagattgtaaaatctctatcagtatatcttcaagttcactcattcttctgccaactcaaaccaactgtggagccctatggtgaatttttcattttggtttttacttttcagccccagaatttccatttttttaaatcaggacacaagtaaattacatatagcctattaaaacttgtcagttcaattcaggtcacatttatttattaattaaagttgtgtaggtattttgcagattatttcactggacttaccctcatttaaaattgtttttgtatggtgaactgtctaggctaatttttatttccatcactttcctactgaaagttaaattttaaaatgctgccgtttgccatttgcctggtagatgtctatcacatgctaggcagtatgattttcttagaattgcaagtgtcctctgtcctacttacttgcatgtactgtgttgatttatgaatgttgaaagaaatagatttactttgtaaaatgcaaaaaagaatttccaattttttctttttataatttcagcctttttattggcattctttatttgatgaaacattgtaattacacttataatcctttaggcatgattttttagattgttatcatatttataatagctgctttcatgtctttgtccaccaagtctaacatctgggccctcttacgcacagtttctgttgtctgctgtctgctttttcctgtgtacggattgcatgttcttgttcccttgcatatatcatagctttctattaacaacaggacattgtagatgttacagcacttctgggtgctaatcctccttacccactgcacatcaccccttccccactggcttctcatttgtgtttatttccttactgatttagcaagaataattcagtgaagtctattcccctgcactgtgcctctgctgtcactcctcagaggccacagccttgagctatgagtgacattcctatttttcctttgttaaattacaaaattcttccagacagctccctttcactgcctctttgcctgatctctgttaagtttctggctgctgtatctctgttgttttcacttccagctgttagcctccactaatcttcagttgtttgcgctattatttttggcccaggagcataaattgtccccacagtctgctctgattgtccccacagtctgctctgactgtggctgggccctttcgtaggggtgctctttcggccagtccttgaggcctgctctgatcccaggaggactctttctggctgtccctttccctgccctctctgctaagctttcagctggtctactttgccatcatggagctactgcctactcttaattgctcaccaacaaaatttatcttgtttctgacagtgcctgaggtttgaactttcctatactctgttccaaataattagttatccttaggggaagttacagagccctttgttcttgtgacctgtctctccctgctctggaggtggtgcaggggcagtggcctgcttttctgtgaatgacacctctggtctacaggaagggtactgtgtgagcataggagcaactggtcttctctccttgcctctcccagcataagacctccacccagtgagtgagatggagtgaatgggacccagtactcagaatgctatgcctagcgtagagcttcccctccatgagtaaaggctggactgaggtagggacccctctgcttcttggtctagaatagagcttctgccacagagttggcaggggtgggagctgtgaattgtcaatgttggtagtctccccctccctgggagaaaccataaccctgtgtatttggagctgtgggaagaggtagccccatcttcttggccatacctgcccagggtagagcttcctttatgctgagcttcagaggaggggatttgtaccagggaagggagcaggttgtgggttgtgggtcacatgccacagattcttgctgctcttactgagatttgataaatcttcttgagaaaaatatttcttcatctatacacttaggacaatttccagagactttaagtggttggtttttattatttttatctgttgtagttgtttcactggaaggagggcccaaggatatccttattttagaagtacttccctggtgtaccctaaaattgtgtgaaaatgttcaggccttttttgctggtttagaattcaaacatgtgcgagggatagtttttaacacgctacttactagcgcagcaatctggcaaggactattacatgtagactggcatcggatgcagtccctagaaaataccccaaataggagagacttctatttctggcagttaggcagactagattactggaaagaccctcccaccgggaaaaaccctaaaatgtatagtaagattttttaaaatatttttaatgacatcaataactactcaattagcaaagaatactcataaatcaatgattaagtgaaagaggaaactcagagaaggggtagcatattgaaggtggctttccccttaaggatatttggtgaaccgaataaattctaataactgttcgcacagctttcccaaccataaggaatacaaggaagtccaaggctcctgtgcagtatctaataggagaccctccccatacgagcctgaaacctcaaaaggctaaactctcagtgtaaagatgaacaaaaaatactccccactagaaaactacaaggaaaactgactatctcaaaacatagtgctgggtagggccaggggaatttccctctgagaattcataacaataaaccatccctcacgtgagtttacaacccagtttgattgtatctgagtggccaaaaatcctaagccatgaagttaaagtatccccagcttgtagtttcctccagcaccttgtagaatcaaatgtaagtcatcttgaaagaacccatcttcaacccaggcctcaaattattcctagaaataaagttccaagatatttaagctcacaaccaaaaaaaaccccacaaaatatacaagtaaaccaagcaccaagagtgagaaatagcagggacattattagacaccaccattattagacctcagatattagcattattagcatacaacagaaaggaaatacagctaatatgtttacatattaaaagaatttgaaaagcgaaaaagccactgattatgaaaaatgaccaatcatgttgataacattctagaaatgaaaaaatataatcaaattgtaaaatttggagatgtaagtttagcggaacattacatacaattgaaagagaatgtggtgagctggaacacagattttggagatgatgcccaaccgagaaacagaatatgagaggtgaagtgacatggaatagatctaacttaggtctagctaaattcctagtggaaaggagaaagagaatgggggaaagtcaatataagagcagctaataaccaagaacttttcagaactgataaaaggtagaaacaaaaatccacatattcagggatccagatgaattccaagcagtgaaaataaaaatcaatctaaacttggaagcaccatagtgataaatgcagaacaccaaagacaaggagaagatctttaaaacagagagaaaaaccactgtccaagaaacacaaacatctcagtacctgacctctcaacagtaataatggaaatcagaaggccataaaatgtgcttggaaaaacctctcagtctcgaatacccaggaaagaaatatttcatgaactaggataaagatgtaattttcatacaaaccaaagctaaaagactttttcaccaatagaccctcacaaaataaagctgtattggatataacttcaaactaaaggataaataacccaggtgaaagaagaatgaataataagcaaaggaagtggtaaatatgtgggcaaatcaaaatacgtggtatgaagaataataatgaagtgctgaataaaaactgaaaaccaagctacaagtaaaatacatgactacatgaatatcccacatctgggttcagagggggctcttctgccttaaagtattctcagatccttgaattgttctggcaaagagcaaagataagtaactttgattttcataagttaaagatgacttaaagtttttatgaccatatatgaaagagtaggaatactatgcatgacttccaaagtagtagagaggggaaatggaattgaaagacaaacctggctggcttggaggctcacacctgtaatcccagcactttgggaggccgaggcgggcggatcacgaggtcaacagattgaggccatcctggccaacatggtgaaaccccgtctctaataaaaatacaaaaattagccagtcatggtggcaggcgcctgtagtgccagttactcaggaggctgaggcaggagaatcacttgaacctgggaggcaggggttgcagtgggccaagatcatgccactgcactccagtctgggcgacagagcgagcctctgtctcaaaggacagcaagaaaggagagaaaaaaatgtaatattagcagaacaaataggacaaaatctaaatacccctagtaaaagacttaaattatcaggctgtgttgtttttaaacctgtctgtgtattagagatgtagccaaaatacaaacagataagtaaaaagatggcaaaagatatccaatgcaaaaacccaaaacagccggctttcttacaccaaacatcatacaaaacagacttcaaggaaaaattagaaacaaaaaggttgccccaaaaaggtttatttcaccagaagataggataatttccaaatctatgcaagtagtaacctcttgcatagaaatataccttcaagatacatttccaaaaataagcatgtttacatggagttggaatgacagacgttcacatgcttcttccagtaactgacagatcaggcaggccaagaaatgtcttacatttaaatgttttccattttagaagtttattgaagatattatgaataactttataccaatatagagttgaaaacaaaatacagcaatttctagaaagcagcaacttagtaaaacggattcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgaggttagcaaaaccttggtagcaaaactaaagacagtacaagaaggaaaaataaaggcccatcttactcatgcccataggcttaaaaaaaaaaaaaaagaactaagcaagatattatccaataatgaagccaaagaatgattgtcaacttcattatgtctaaacctggcagggcaggcctcccattcgcagatttccccaccatccagcagtgagtgtgtttgcagtattggtaaaacagtgctgtgaagatttttttaatcaccaaatctgtcaaaattgccacaagtacaatcccacatgtccttcacccaaagccacaagcacagctcctcagctccgtccactgagatgatgacagaaggatttccagtctcggctctcactcacctcgtgtcttctctccccttgtctctgttttccttttgtttttcagtggctgcttcaacccccaactccactgctggtgcagccatgaactccttgacctctctcgggactctgcaaggactggctggagccactgttggactgaataatattaatgcactagcaggtaccatcaacagtgagtatttgctgctctggtggacagccttcccccaaattctccacagaaagtggtcagccagaaatgacccgaaaaaggatatgccacggggagaactaaaacttgggatggaggagcacatgctttgataggcaaaagctgtctacactcgttttgcctcagaaaatccccaaccactctccacccccagattctcttcagtgtgtagcacagcgcgtgtgctcatccatggggttctgtggctggcagctcttttcaggtttccaggagtttggtttggtttggtttcggtcggttctgtcctgcgaggcagggtgttacggtgggaaaagttaatggactggaaggctggaagcctgaacccagctctgctgccaggcagctgtgggaagtcaggcagatgctgctccctctctgggcttgggagtctccatttgagaatggaaagttctgggtcagatgattcttaaaggtagcctccagctccaaagtctaaagattcatgacaattaaataggggagaaaattaggccttggaaagaaggaaatgaaactgaggggagaggagccactgctggcagtgacatgatcagaatctttattaagcacccacaggtatgggtcactctacatcagtgaccatccagagggacatcatttagctgtggcaggttgaaataggctggaggcaaatcacttagaaaattgtacttggttccgaaacatatggatggactcaccagagaactgcaggttctgtcctccacagcccacccgctcctgtcattctcggttgatgggggagcagtgtgccggccagaggataagtcgtgttttagattcatgctcggtgtgggttcctgtactgaggaaactgatcctcagcccacagcggggacatgtaatttccctgtccctccgtttcagatcccctggttgcctgagagtagccaagcccagcagatccacgacagctaacagagctgctgatacgggagcccagttagctaccatgcagcccaggcaccccggcacctgcccattctcatttttaataaaggagtccgtgacagttgttgccctattttaagccatggttcaataagtggactgtttttaaagggtgaccaggcagtatacttttttaaagcaaaataatcccagtaatttcatactgtaaaggctcggaataccttgcactggacttggtagaaaatgaacctaaaatttatccaaataaaaattaacttgtataatcctgataaatcattttcagaattaggacatttttcaggttttagtacatctttgtatttagtacatcttttggggaaaagcgaaaacgtggaccgagctttagctgaccatacctcccaaatgggacggctcgtgattagcgtggagcccgtgaagtggtagctgtgccgcggcctcattgttttattccagttagaaccgcctccagctttgacttttccagcagccaagtaggagcctcactgccttgacccccatttccggtacagctcctcgctctgaccttgtccttcacctaggtcgaggacgcgtgtgctcgcacacatcccctcatgctgcttctcttgccccaggacctagttcccctaaaacaaggactttgatttgaccgcctgcctgtccttggtctgcagagtaacaggccagtgggaatggttgtcctcctcagcacgtgctcatgactggtgtgtgtgtgtcctctcgtctgcgtcccgccctgtccacgctgctctgctctgcattgctgagattttcccatcgttctcgtcagggactggagaggggctgtgttgaatggcagagaaaccatgagtagttcttgtgtggggtcttgtgtgatacacattttgcttctggcaaggacaacaggcttaaattgttttgctttttaaaattctttgccaatgggttaatataagtctgtatagttcatagaaaacgaagaaagaatgtttgtcatttcaaataacccctgctagatagtatgaaccaagaaaatatttaattaaacccaaaaccagacaccaatgaaaatacattccttgtgattggaaagtgttactaatgcagagccgttttacaatctccagcattgacctcgagctaatatttgctgcttgtctctaaatatcaacagaaaaccttccaagatagagtatcttctttcagaccattccttctcaacagagatgattatgctaccagttccactggataattcctaaagaaattcgtcaagcagtggttacctggacagagtcagcttctcaaatagttgacggcagcttccatagcactgctatgaatcccaccccactgcagcagccattatctgtttccatatggagagtattcaggttttctgaatagagccaactcttacccaccgacacagcggtcagcaagaaagcaggtagatgactcaccagagccaacattttaccctctttcctgcccaagagcccagcacctctcccaaaaaacgaagtttttggtcagtagacaagtagctcaattaaactgtttgagtttgatatcctttttattccctgatacattaatgagtcaaagggctaaaaaacagtacagcgccctaaaaatgtaagaatcatccagatcagaagaaggaacacatgtgattgaccatcagagtgttcacctctggattttttcagggttccctgagcatgttttatatgttaacatctgaactaagttgaagaacatactttttccacccaagagtctgtatctgattttatgtgtttcagtgtatgtcaagtggcatcttatttttccttgttttaatgcataattcgaatggcttccaaatggcttaccatatagtgcttaaaattatgattgtttaaaaaaaaaaacagctgcagatgcctggtgaaaagtgtctatggaaatattttctgtgaagtagagaaaagagaagatgctccaggcatattttcgtggcttggcactacttgcattgtgaaattactgttttaatctgtattcctaatatctatagtttacacagccccacacaacctttgtgcccttaataacacaggcagatatataagtgacacccagtgcacatatagacatcttcatctaccttagttctagatattttatacttagcttctcatttatcagcttgcagcttagaaggataatccgtcatctatacaaaggaaaacttaccccagtgaagtggttacaaatctgtgagaatattaagacattctccctttttctttgatttgggataaagcctagcagggcagcttgcagggaatgtggtctgcttatggcacttggcttgtgattctccttttcagtgtcatctccttagtcccccaacaaaagacattcacgctcatgtttatgggttagtccttctgtgtcatgttaacagattcagtcatctcccagctcctgggtctctattgtaagttgagggcctctggagaggaatgaggcagaagaaactcagtagtcaggctgcgtgccggccctactgacgggccaggtgcagaggccttgctgcgcactgccgcacctgtcacttgcttccagccttccttgtctaaatagcatgcatgggaatggagatgataataataataaatgagaggaaatggtcgatccagtggaccatttcaaggaaaagccctattcttttaagtggaagcattttattcaacttgactttcttcacagctctgcttctgttatccagagcttttagaggaaatcaagtgcctgcagctgggttgaccaacactgtctttgatagaattaatctagaacaacatcaggtgactcacaggaactgttctcagaagtggaaggccgcctctgattgttcttcaaaccctaccaggttttcagctacttttccaccctggacctaggaaccaccctcccagattttccacgatagttgtggtttaaaatattctcagtgtgctggtacttgttagaacttttttgttcacatggatgtttataccatggaggtggcgagcccctggctggagaggccaaaccctccccgtgtcccctgactggtcccccttgagcatctgcatcccttgctcatggtaccgcctctgccacctccccagggaaacagggctggccacagctgtctcctacatgcacagcaccagcagaagtaaacacgacccttccagaaagcagattagctctgaggtgtagtccagagacacagccagcctctgtgaagtggagccaggagagaaggatgtggctggaatgtcactggctggagctccaagcctcacaataccctctgaaacatccatccagtatttcaagagcaggagctgtgttctgcttctgcattgtaagagagaaacatttttggcaaaaaggagaaagagttcaaagtaggaagataatttttctgacctggaaattaaaaaaacagctgtgtacagagaagggagttgggtcccagtgaccactgccataaaatgccacctgtgtatctggcactctggagaagccgagtcgtggaggctgcacatcgcaggaaggatcccccgtgggtctcacatgacagggcctgaaaactcccacccgcagcagacaaggcatcatggtggtgcgatgctgcccacccctccatgggaacttggaggcgtccactggagacgagctgctgtcttcagcccgtcctcgtctggcagcaaggccccacatggctctgcaggctgcgaggcacacccagaacctcatgccttgagatccaagcagagcggcgagtcgccgctcctctcccgccagaatttcctccacacgggcatctgcatttccagaggactgtgcccagagtgcgatcatctgtaatccacagcacccgttaacagcctggccaaagtgagaccaacagaatttatcagcagcgtccagcccttcccgagttattgtacatacccctctcacctatctcaaaaaacacggaagttcctttgcatcacacaaatagtgggaggtgaggatgaagtaagatcactggaggaatagagaaatgactctccagccctctggtggccatagtaacagggacagaggggaagcacagcggcagggaggtggccgcgatttgctggtgtccgagggatcatttagggtaattaggacagtctgcatccaagctctttggacagcacttacttgcatgacccaaagaaaacattaatgaaaatctcaatgattttcattaatagatagaccccttcataatgagaaacaaaagcagacacagcagggcctcagctggcaacacctctgaactgagcctgcactcaggaggctgccactccattctcacgccattcacactcgtctcgccacccctgcttggtgtctgttctgagaagcacaggaatacccgaggtgaggcacaatgacagtcctccactgttaagctatagcctaattcatatcttacatgtgtccttttaattgaagaggcgaagttggccaaatagaagcacaagtggagtaaacagaacattccccacctgctctgttagggcagtagcgttgctgggcgtgtggaggtcactctgctgccggattctctggtgtttccaggcagccttaccttagctgtcctccattctcattagacttcttacctattttttcagttagccatccttgctgttttcatatctccaatcaatagccctactttcattgagattttcattaatgttttcaataagctcttctcagaaacatcttttcttaaagaactgtgatcataaagggacccagaggcaattgtgatgtcacctcttccgtttcctgagttgatatgaaagttagcactctataaagtgttgcttgctttgactccgtattcagggaaaatgtgacagtcagccaccccagtagagccaaagagcagtcaggatacaaggggagaaatcgagtctactggccaccatcccgttcccatcaggtgatagccaaggtccagcccatagacacacctctgtctccagctgactgaaaaacatgacctggagctctttcagtggccgaaaccccagttgccacttgggcatgtgtgcatgcgtgcacgcacagaataactatttgctgctgaaaactgcaccactttgataccgaacgagtagcttcagctctctgcgactgtgggaagggtccacatggcttctgtgcctcaattcttcatcagccaggctatttattcctaaggtcctagtccctgacatcatcattcagctgtttagaaagtccgttttcccacactgtaactcctcaaactgcaggtccactggttccgagagtacagaacttgtcctctccaccatttcctcatcacacggcctaagggaaaaaagttttatttcatcctttcctcctcagccctgcaagctatcccatagttcctcaaagagcccagtaaatggatttcagtgtacagatgttacaggcctctgctactaaggttttttttttttttttacatgctcctaagctcccagaagcaaaaggcttttacttccaaaagataacaacggtacttgccagtagcacgctgcatggcattgagctgtctcgtctaactcgtgccacagtgcatttgaatcactggcctagggagtgagggttctcatggcttaggtcattttcccccattatcacgatttatttcttcatggtttcatttttagtttcctgtcagtgtaattgtgtgctagctgcatgtacttgctgttgtactgtgtttaaatgattctctaacttcctttggaaagcactaatgaataagtgctgtttctcttctctattgttgggttttttgtaaagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtaggtgccgcccttggccccaggcagggcccagcccaacaggcagcactggcctctagagcacggttagaaggtatcaaattgaactgaacccatgtcataacagaaagcagttgttttgttattcatgtttaaaaaaaaaaaaaactgaaagctgggcatggtggcatacacctgtagtcgcagttacttggcaggttgagatgggaggatcgcttgagcccaggagctgaggctgcagtgagccatggtcatgcctgtgactagccactgcactccattcggggaacacagacatacccctctctctcaaacaaaagcaaaaacctatttatttcagtctttctcacttggtcttatagttaccttctaatttaatttttcatcgatctcttcagatgaagttcttgtccattgtatatttatataccactctggctttgttgataaataaatggtttcaattatttcccccagctacatcttctgaagggttatggcatctctgcagatctaagtccaggaaagttgatcacctttcttgcaatccccaaatatcctctcactgctcaccccctgccataattaagttctataaactattaatttcccataaactacttcatagctgctgactgtaaataattcccagggacctccctctcccaagtcagcacagaccatcaccttttccccttacacagaaactacttgttgggggaaggggatggatggccacaggcttctgtgggtgaaacgctctctgtcctgtgtttgccagggttttggagtccacacatcctatgagtgtgtggccggctctcagtaggtgatggttttcaggtgaatgatgaaatccatggttaggattgccttggtctttgtttaattgggggtcttcagggaaagcaagtaagtgatcgattgccttgcttctctgccagtaaagcaaaataaactccaggaagttaatgctaagaataaattaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttttgaagtttctttcccttctcttttaccctcaccccatagctccaaactgctttgtctgaagtgggttttaagagaacacagcttaaaagatactcatggtttttttttttttttaaaggaaggaaaaggttttttctttgtataaataacatggatatcacttttaaaatgaaaaatatatgaaagtctaagttacttttcattatttcaactttctctttgactattatggtaggcttttgaaacatgcacaggtgttcagacaactggttccccaggcttgtgaaagagaccctacatcataaacatcacttgtcttcccaaagaaaggcctgtgtgtgttccttttctctgtggtctgagtaccatggtgacaaatgagggcagagagcagggccctgtaggacaatgatatcatcacacagaggccagaaggccagttccccacatggtggtcacctctccactacagagcagggccttccagtaaactctagagcagtttagggatgaagtctgggccctgaaacaacatgtttcgaaacaacatgtttctgaggtttcatctgagcccactgccctcaacttactcgcctggagttttaggggttactgcttagtgcagtaattccccttctgagattaagataaaattgcccaaaataaccattgcccactcctgatttaagagtgcgggttttcagtagcatgcttttgggtttttgatttgttcagtttttctttggaatcatctcccaccttgtcataactctcttctgatccctttctcacccagttaatatgtgctcaagaaatttaaaccatcttcttattagtttaagtaaaacataattttaaaagcaaatgatgccaggcagagcaaaaataataataataataataataataataataataataataatgaattccagattttctactccacagttcagtccgaggttgcgagacctggtgtgttttttccccagacaggaagtgagcctctgatggcccgcctctgtccattacctgcaggaggcgagtcccatgaggaatggggacgctggtggactcttacagctttgttcctacaaacgtccccagttctttatgccagatcaagtgccctgtgagagagataaaacatgaacaccccaacagccaggaccagtagtgagtgtaacagagaatctaacaagtgacagtaacgtgcactgggagaaatctgatgaaagggtgacttgtgaacaggtgtttcccatttctagaggaagagagatgacacacaggtagaatcccatttttaaaaaaggtattttgttttttcctcttcatctcagccaccttagttgcatacaagggaggttttccatatgaaatctttttttttttttcattttaatattaaaaactcgggggatatacaaaaccaaactgtttcttggtgatggaaaaattgggggatctatgtcaagagatggtgctgacatttttttcttgggaatatcaggagcaaaaggacaaaacctacttgtgtgcgtttactggtctctctgtttccttggtctctgttgggcatagacaaattcagcatgagcaacattctagaaagctaggattactcaggcatacccagtcatctgtcatgtgcattgaaactgtattttctccccggcttcaggaggtgagatgtacttcacagttcaaactggggcccaataactctcatttgtgcatttggatcttttgtgcagtagcaacatgaaagctggtagcaccaaatctgaccatcagacataccacccaggatgtgcacacacagcagtgctcagaacatccctttccagtgtttcaggttttgcatcttttcatgttaaattttgattcccttaaaaccagaaaacatctggggaccaaaggcccccctgcaattgtgtccctttaaaatagactccttcccatgccctagaatacggatatatcccaggaaattggcagcaatatggaaagttacagtagtcattaagacacacttttaaatgagaaaggaagagttcactctgtggcttccatagtttgcctcaagaagttttctttgtgaaaagtcccaatcattaggatactttcttgtgatgtattttgtggaggcaggggaagaagcttggtttgacatttttacaaagttctttttatccccattttacttttcttcatgccacacagacacccttcccacatctagggaccccagtgcagctatcccctggggttgcctagttgggcaggcaggcctgttcctctcctgtgaaggccagttgaggattcctgacccgctgcagaagtcgcctcaccagttctgtgagcgcccctcctcggaagactccatgcctggaacgcccaagaaacagccagccctcatctccctcagctcatatttatgcccttttgtgccgcttttaactttcacatggtgctcatatgggtgggggagagtcaggagaggaaaagcgagggcagcttaggagcacgcacctctccagccagcagggccaagatctccatcctgcccttgctgcctgtgtttactgggaaaggataggtggacgggcagagcttggcttcctcggtctttgcccagcttctacatccactgcattcatctccaaggctaacgcccaggagagtcattcctctcaaagtcatgagactcaggctaccttctttccttgccttgactcactgccagtcatttctaataaagatgattattagactgtgtgttaagagatttggcaaatcaaaactggctggaaaactaggcaaatgatagagaaatcggagcagcattactgctacatccattattgtcaattgttacaattttttagaatgcacagagcacccttttttccttctcacagcctgtccgtacctgagaaaatacggccacccaagaaaaacccatgccaagattatctgtccccattctgcccactgtcaccttcagccccatgaaaaggtgactgaaatgcatatgccaaggggcagtggcacctgtgactcacagaagactgtcagtggaaaggaagccattcgtaaccagcatctttggaaatcaggaaaatctgaaggatgattgctttcctgaaaggcactccagcacttgacatttatccatctgtttgtttgttcaactaaatgcttagcctacctgttgttaaagtattcctaagaagggactttggaaactaagactcaagggataccttactctgactttttttttcctccttaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggtatgcaaaagaaactaagctagtatattgcagtaggttcccaagtgaagagtcgtgggaaggaaaatgtgagacagtttcagccaggatagggccttccccacattgtgttgggctctgattttctggatccttgtaagcagatttgggcaaagaaaggaaggctctgggaaattaaagtcaacgcccatacattaggtaatcttctatactacactattaaggaatctaaccacaatttagctcatcttccccactaattccttagccctccaggtttagtacaattcagacaccgtggttgtgggcaacaccatattgggggcttattggccttgacatacacgcacacaaagacactttcacagacagacacccattcatcagcaccaacacatccatgtgttcaggctgcttgcgtgatcgcagctccacgtgcccgggatgagcagttgacagatctcacggttacatagcacgctgcatgatgagatctgaagggccaccatcggggagtgggaatgaatgcggagtccaggggcgtgcagctgttatcagagactcagctgccatgccccctttcctcaagcagcctggactctgcctcttgtgggtgtttttcgctcccttagggaggaagggatgctcacagaatggactgatgttttacaccaggacaatagcattcattaaatatattccttgtttcatttttcaaaacctattggcccccaaagcagtttacaggccaggatgttcagagtatatattacttggcaagctcagggcccagtttgagttagagtatttgctttaatcactcctgcaatttaataattcatgctggtgggaaatagtaacagcataaaacccaggtagttaggtaagggctggaggaaacacacagaattctgtgctgtaaaggaaagtagcaaagggagggtggttctcaaacttaactctggctggtaatgagtaatcaggccaaagagaatgttttggcttctaaaactctaatcctaaggtctaatttgtgctatcacccaggaaggtctgaaggcatggttaaaggactccgcatgtcagccacttacagtcaccacgttaccctagcagcaaggctgtcagtcgggacccattcggcggctgctgtggcaactgtataaacccgtgtgacagttcagtagagagggatatgcaaattaaatcattatggggggcgggggggtgtgtctgagcaggagcctactttagggaggcttccctacatgatttacaaggctttgaggctgacttttgtgtttttcgtagctaaacaatattctagatttggaagggaattctgcttcatgatttgatttgagaaaatacttccttgaaaacagattgtttatcagcctacagcctccttaaccatgtgctcatactgatgtaaaccatagctgttagtgtcagcagacaattcttgagcatgatggactggtttccatttttgtggaacgctatagcacccagtttgcttggtgagccagccgcatttcttagggctgccagtcataaggtagtgccccgttccttcctagttcttagccaggttttgttatccatctcacctttgtccatttccattctgtaactatcttgctgttccttgataaagacccagagggaaaggaaagtcagagcaaaaatcttggatcccagatcacatttattgggaatgagacttaataaaaatgtaaacagccacttctttgcaatccagcctacctctgaaaagctgcccagcgttatgccgcatgcccatttttatcagccgagaactgggcagaaaagtcatgtcctcttcttcctcctctagtttgtaaaggaattttctctttagctttaatagcagatggatagaggtgcttagtatagaaccttccgaacagctgacgtttagacctaaatgtaaatcaggaccatagcttcctgtcaccactcggatcagcaccctttacagccttgctatacctctgctgctgcctcccccagtgctggaacagactctgggaccaagatcctcttgtcactgggtctttgcagttctttttcaaaagcttgccttccctgctgtttatggtggaggtcgttgctacagagtaagagatggggaattctcttcagatgattaagttctaagccgttgactatgtatcccccagactttgggagatgccagggagcaatttcctttctgctgaatttactggagctttggaaatggaaagtgagataaggagaaaggcccagcacttccctagtctccttggtattaactccaaatgggtaaaaatcaagtatgagtgagttattctagagtttattcgctaattgacccatcctccagctaaacaggtgtaggctctgtgtgacagacgatggagagctcgagtgacaggctggggcttggcagtatctgctgttctccagcccttcccttcccgagcctgcctgttggcctcacctggctgggacacgtgagcccctaggggcccccacagccctgaaatatttacaccactgcttgtatgagtagcatgtatggacctggggttcttttggagagatactaaaggacttgaaacacaatgatttgagcgagttcagtaagtggaactgaattcagccaaacaattgagtctgaggtttcagtgttgtggggaggggtgtgtgctccatgatgccacatttccagtccagccagctgctccacagctgctcagtgggcacgccccatcatccactcacggtggactcacgatcagttccgcagagctgtgctgggcccgtggggctggcacctcatgctggctcttcagccttccccagagctccagcccccttttctgttttctgctgggcttcctctccaggctgactccctctctcggtattttccaggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaat

SEQ ID NO: 12611 - DNA, 135476 bp, Human
  misc_feature (1)...(135476): n = A,T,C or G
caggggaaatctgattaacatatacaacaaagcctcaacggggaataaaaaggtcacaaaagggcagagaaggattcacagaaaaaggaagaggccttgccagttcttgactagttaattagggtcagaaccgtactggggatttcctataccctaagtttgttaagtgattacatcggtctggggaaaagggatctgctcagagtgattcagtcaactttcttagtatcgggtggtgaatcgcatttcctctctgctaccctgtatactgactaatgggtggcgtatggggggtctccaagaggtgtgtttactccaattcagaagctataggatttcagtaggccttggcctgttgggcaatgtgaggtttcaatctttctctctcaaatgagtggggctcttatcagttatgaagggacttcccttgggacttgtcacgacaccatacagcagagatggcaatttgagggcagtttcttgttctgctttgccatcttggggtggctctgaaaagctttctgaacctccgacaaaagaaaaatgttcacaggattgattactacacacaattcagtgaagacaactgggcaacctgaatcaaatgttgagatgaaagataggtgagctctgatgacacacgtttaaattctaggtctacaggtaaaactttgtaaagggccttgcctcagcgacatctgtactgggccctcctttgctgagagcttcttaccccaaccctagcactccaagtcccgagaactgctcaatttcatgggaaaaagtctctataattatatatatatgtatatatgtgtgtatatatgtatgtatatatatgtgtgcatatatatacacatacacatattacaacagactgattttcatgagttgtaactatccttgtagataaaaaacgaaaccattcgaatagcttaaaaaccatgcccacgtggctactggcatcaatattccacacaagattaaaattacttcccaagatgcacaccctgcactccaggtaatatttcaataacttgattaaaaatttctcagaagtctattagaatcagaaaacgctctgcggtgtgggtgaggattttaaatttttgcaacggaaacttttggctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgaggtgagtcaggctgtggggggtggggcgtgggggcggggagacagggagacagggagacagggccaggggaggcgaggggtccccgtcccgccgggggcggctgagccgcgacccccatggcttctttggccggagcgggcagaggccgaagggatcggggtgacggtggagggggcgggcggagcagtggcggcccctcccccgcggagccgccggccgctcggggcccagattccgtcggcccccggggctctgcggcaccggtcgcttctagccgctctcagcccgtccggccccgccaggctccgcgagccgccggccccggcctcccgggctcggggatggccccagactgggccccgcgctggggccaccgcgatcggggcgccgcgtcttctcttaccgggaccctcctccccagcaaagttgcccccaagcgggcggcgtggcctggagccggttctgagtgcagggtcaccattttcctccctttccagcttgtttttgcgccgtcgttccaccccctctccctccggcctagtccactccctccccatgttgggacagcccccctcgaccaggcgttcttcctttcctcgtcatcttcttgctggaaagggcccgatggaaagggcccgaattttcttttctttttttttctcttcccacctccgtggcattctaattacttctcccttctcctttacaaagatgggggtgccctctctggattggttttattcctctcctctcccaggaggaccagcccaggcacagacgctgtcctttgagaattttctctgcttttccgttcaagggctggttgcagggagggagctcaggcagagacttttcatttaagaactcttttggctaaggcctgcaggggattcccagcatctgaaatattagcactggagctgatccctactcaggtgaaattcctttactggacaccacaagaatgtgtcagaacaggttccctgtgcaaggggcttcaaaaccaaaatattcccactgcgctctttacgctttttaaaccaccgggagggggcaaaagacataactgggttgttaactattcatttcaccgtgtaaaaaaaaatgtaggtgtttcttctgcttttggtttgatgtatccatccatttgcttattccaccccctccaaaaaagggacttcaccttcctactagtgtatctaaattgtttaagtgaatcagagtgagatggtttactctgaaaggtgctggactttacagactgaccattgattttgtacacagagtcctacttagtaattgtagccactgtctgttgctccaatgactttagttggcagccaccatcctgtaggatgtttttcgggcaacattacctgaggtactttagaaatattgtagttttgaatgtcaaaaaaaaaagagacatatcaagagatgattcttagagcagggctaatgtgttagaattgagtgctaaaaatagccaagacattaacaccatttggggagtaatcatcagataattttccatgaaacatatactttatgaaaatctaagtttagcttcgagaccaatgtagagacaattcagcctcttttgcggggaatatattcacaaatatgggctttagcgcttaaaaatacactgcagttggccgggcgcagtggctcacgcctgtattcccagtactgtgggaggccgaggcagttggatcacctgaggtcgggagtttgagaccagcctgaccaatttggagaaaccccgtcaccccgtcactactaaaaatacaaaattagccgggcgtggtggtgcatgcctgtaatcccagctactcgggaggctgaggcacgagaaccacttgaatccgggaggcggaggttgcggtgagccgagatcgcaccattgcactccagcctgggcaaaaagaacgaaactccgtttcaaaatgtatgtgtgtatatatatatatgtgtgtgtgtgtgtgtgtgtgtgtgtgtgtatatatatatatatatacacacacacacattgcagttatataagagatgtatgctatccttggcatttttttcctcattcagcataaaaagtacctaatgctttttgtgtttttcagattctctgaagttacacccatcacagaattttcatagagctggactattggaaggtcagcaaagtaccattttaaagcatattgtgttagtatgcaaaggctttctctgaaatggagtttaaatgggaaagtatgaaactttgcaaactcacacaatgtagttttctcctaaagagtctgatccttcttttagagcagctgaatgtttcaatgggttttgttgctgcgtttgatgtgcttgttggctgttctatctgctttgagaaacattgaaaaaaaaatcattttaaattatgtgttgagtgttctactttagaattccagaccttcattttagctttttatacacaaaatagaatgtgaaaaggcccaaacattaacatgaatataaaagagtgacaccaaacacataattagtttgaaaattcagaatttagaacatttatatgctgagcatttcaaaatatgttaattatttattgcaaaagcattgatgccattgttattgcattatacttaagggtaaggaaagccaagtaatagcgatgatgattgagctatgcttagaagaaaggggtttagaaagttctggaaatgttaatagagtctgtagattagtttaaacagcttacacttactttagaaaacttttggctttgtgtgtgtgtgtgttttaacattttaagacataaaatagtcttgtgtttttgtagattttgaagtgatttcacatatatcatctttaaatctttataattttggaattggacagcaaaggtactaatttccccattgtagagaagagaaactaaggctgaaattaagaaaccaaaaaaaaaaaaaagtcccacagtagaagaaataatactttctgcgtttcagttagtgctctttatgcaaagcggccaccgtgaaatacacatgtaaccagtaacaaacattttatggtctactttaaaaaggccctaaatatttaagtttgacttgagaagatttttgcctcccttggaggtagtccgggatagtggggggcaagtgggttttgtagttgagcttaaatttgaataccaacttagctccttattagttctgtgacttcgggcaagtgattttacctctctaaactttaatattcttcctgttaaaatgtagctgtctcttaaatttagtgagctaatgtgtattaaattgcctagcatagcgtctagcttaataaatgttagttttttcctttagtatcagctaaatttttttaacagtataatttagagcatataaaatgttctcaaataaataattggttaaatttgttttgtacgtgtaagaagcccatagatatacattagtatgaaaatcaaatatttttaaaactacaatttgaagtgagaaatttttagcagtgtttcttagtgaagcagatttctggtttttattcatattcaatttgtgaccatgttgtagagacatatttgtctgtacaaacccatctcatttcctggacaacaaaccatagagtgtcataatcatagagatgatcagggaggagaaagacatgaagaaaaaaatgagtgttaattatttaagcaaatatttttagtgagctgatggaaatacagacaaccatttagcatgtttatttacatgtttatgcctaaatactttcgttaatttttcattttagttaaggggattctcatttaaagtaaggctacccttttagaaattatatataaaatataacatgtataagtatcaattctgtcatgccctttaaaatgttttgagacagggtgtcttaaaaaagttgtttgcttctgtaatgaagtgtctaatctgtgccacctcattgctatttcttttttattattgacattttaaagaatacataaaagtagagagaataaaataagccccatatacccatcaccacagtttaaccagtatctaatcttgcttcttttatcccttcttctctctcaagctggattattttaaaacaaatatcaaacatcagatcacttcatacataagtatttctgtattacagtgactttcttatattaattattattgatataatttaattgttaatataattattgtattaatttttaattactctgtatagtttataaactatttcttggaatattctagtttatttcagcaaagtctcttgtgactctcctgccctcttttcaagacagagtgctgcaggaggctaccgcttctagtatatagtatatcctataacctatgttgaaattgtaggccatgctgctagattggagttcatattgttgctctgacatttacttgtatggccttagcctaataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaaactaaatgctagctgtagagtgtttactgtgtgccaagaactttacaaataagaactcctgaggtgggcatatcacttgaggtcaggagtttgagaccagcctggctaacatggtgaaaccccatctctactaaaaaaaaaaaaaaaaaaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaaaaacaacaacaaacaaacaaacaaacaaaataagaactcagcgaattctcctgactaccctttgagatggttattattatcctactttagagatgagcaattgaaggcataactcacccagagtcacaagctagtaaattgtagaaccagaattccaacccaggtagtctcactttagcctagcctcttgactactgtgctgtactaactcccaatggtatatactatcaagttctgtctagtaatatttatgtatgcatgttttacatcagtagtctagattttcatctataaatagtatttaaaaacttggcccagagtgaggggaatttaagtaattggtgtgatataatttaatttttttatagaacgtacgttttccaaatttaaatttttttttttgggggaaacaaggttggaaaacctgcacttgggtattattattattatttattattattatttttttgagatggagtctttgctctgtcgcccaggttggagtgcagtggcacgatctcggctcactgcaagctccacctcctgggttcacgccattctcctgcctcagcctcctgagtagctgggactacaggcgactgccaccacgcccggctaattttttttggattttttagtagaaacagggtttcaccatattagccaggatggtctcgatctcctgatctcgtgatccgcctgcgtcagcctcccaaagtgctgggattacaggcgtgagccaccgcacctggcctgcgcttgggtattattaaactttagaagtagattcaaaatgtctactattcaactgagtttgcatttaaccttcctatcaaaacagtgctagtctttcttgcaacctctttttaaatttaatacgatgattgcctgacaatgggaaaagggtcctggctaattaattaatgttataatacatggccattaaatgatgtttctggtaaccccataattaacatgtgacactcttaataaaataagtaaataaaaattatgctgttacaattatattcaaagtaacttgtgttacaaaaatcctgaacaaaagtatacatcactgattttctatttttcaattctatttttgtattttccatctttaaagaacatggtttatatattttttttaaataaaattgtttgccattagtaagttcaaattcgaaggctaggattcctttttgaagtgcctgggaaaaaaattcagctgcagagaaaaggcaccatttgttgtacattctataatgaaaactattcattttggcaaatgaaaaactaagatagaaatgaaactgaatgaatcattctagaaatagagaaatataagattatagaaaaatcatagataaaacaggaaaaataagagtataaacaaattggaaaaatagataaatataaacaatagatttaacaattttaatgattttaaaagcatgagttaagagattatatatcaaatgaaagaactggttaaataagagctaaatgctgatctgatataatctttgttatttatttatttatttatttatttttgatacagagtctcactctgttgccaggctggagtgcagtggcatgatctcagctcactgcaacctctgcctcctgggtttaagtgattgtcctgcctcagcctcctgagtagctgggactacaggcgcgtgccaccacacccagctaatttttgtatttttagtagagacagggtttcaccatgttggccagggtggcctcgatcccttgacctcatgatccaccctccatggcttcccaaaagtgctaggattacgggcatgtgccaccgcatccggccacaatctttgtttaaattaaacatttaagaccggaagatttttaaaagaaaatgtgaaatatgacaatgagttaagagaaaataaactatgattttttttttactactgctaatctatttgatatggtaccatccagaattatacttcatagtgcaaaaatggaaaatcctaaacatagtagcaatgttttattgactttatagaatatttctgatttatatttcttcctagggcccttgttatatcatagatcataaatgcctataatattttatgtacaaagatacctttttggaaaggattttttgaaaacatttaacatgaaaaataatctattgaattcttttcttgtttagtatctaataatctctgtggatccatgtctagtaaactaaaagtattatggaaataatgaagttcaaacatgtcaaaagtcatacctagttcatcccagcttcttgtctttagatccatctctttctgattgcttaccacctgtttttgtgtcccttcctaaactctgctttcattattttcactcaatactggaattctattgcttatttaaaataaaaggatataaattcatattctaatccagtggttcttggcctgattttaatttactcttgactctgattattccaggagtcccctaaaatttcaaagtggtagtacagaaaaacatttcccagtgtgattagtattatatataaaaaacagccactttttttttttttttttttttgagatagagtttcgctcttgttgcccaggctggagtgcaatggtgcaatctcagctcaccgcaacttcacctccaggttcaagcgatttccctgcctcagcctcccaagtagctgggattacaagggcgcaccaccacacctggctaatactgtatttttattagagatagggtttctccatgttggtcaggttggtctcgaactcgtgacctcaggtgatccacccacctcggccccccaaagtgctgggattacaggcgtgagccactgcgcccggccaaaacagacactttttatatgaaaaagttgactcctcagagtatattttatattaagagtaacaggtaactagaaaaaaataaagattattcagtggcataggatatagaccttttaactttagagaggtaaaagacatttttcaatagaaatgttgcttattaatttgtattattgtcttttcttgctgttgctaagattttatttcaagttacgcaaagaaggttgctgtgtcttctgtttgcttttgtgttaataaaagtcaagtttaaataaactaacagagtataagaccaatgataattatgtacttgagtgaaaaggtagagatttcctctatgagttaactacagataatggatctagctttcagaataaataaacttgatgtaataaaggatatatatatttaatcatttgaactaaacatttgttacatgagagttcagttacttttatttgttcttaatagcttttgaaaaatatatacttttctcttttttttttttggtttttgaaacggagtcgtgctctgtcacccaggctggagtgcagtggcacaatcttggcttattgcaacctctgtcacccaggttcaagcaattctcccaccagagcctcccaagtagctgggattacaggcacgcaccaccatgtccagctaattttttgtatttttttagtagagatggggtttcaccatgttggccaggatggtctcgaactcctgacctcgggtgatctgcctccctcagcctcccaaactgctgggattacaggcatgagccaccgtgcccagcccattctcttttatttttaacatttatgtggtaaataggtaatgatcattattgcttcccacccatgaatgtttatcacttctttttcattcaggaaacactgtgattagtcttttactgaatttggtatttagttttgaagatgagagaagaacagaaaagtttctaatagtgagctaagttgttgattatgcttatttatttatttatttatttagagacggagtctctctgttgcttaggctagagtgcagtggtgcgatctgggctcagtgcaacctccgtctcttgggttcaagcaattctcctgcctcagcctcatgagtagctgggactacaggtgcacaccaccatgcccagctaatttttgtgtttttagtagagacagggtttcaccttattggtcaggctggtcttgaattcctgacctcaggtgatccgcccgcctcagcctcccaaagtgctgggattacaggtgtgagccattgggcctggctgattatgcttatctttataaaattagttttacaggaggctgaggtgggaggatcatctgagcccaggacgtcaaggctgcattgagcctgcatgatcatgggatcatgccactgcactccagcctgggcaacagagcaagaccctgtcttaaaaaataataataataaaataaataaataaagcaagagaagaaaaaaatttagttttaataaaaaaaactgtacctgaggcaatctttgtaggacatgctagtcaaaagaataaattcagtgttagtaataattgaaaaccttttttgagcaatttatatgtcaagcagtttatgtttaacaccattttacatatatttttcacatttaactcttagaaaaatcctgcgatgtagtaccagtatccctatttcgtaaatgaacaaactgaggtacagagggatctactaattttcccaagggcacatatctcgtggatgaggctggaatttgaacttcaccagttttaccccagagctgtgagattatattgactgtcttaacagtcagtaagaacatttgaggccgggctcggtggctcacgcctgtaatcccagcactttgggaggccgaggtgggcggatcacgaggtcaggagatcgagatcatcctggccaacatggtgaaaccccgtctctactaaaaaaatacaaaaaaattagctgggcgtggtgggcgggcacctgtagtcccctgaggcaggagaatggcttgaacccggaaggtggagctttcagggagcggagatggcgcctctgcactccagcctgggcgacagagtgagactcggtctcaaaaaaaaaaaaaaaaaaaagaacgtttgaaattggcatttatactttgggccctaataagattacaccattgttcagatggtataaaaagaatagtttgtgtaggattctttactaagcagcttccataaagtaatgagacaaattttataaactacatacaaaaattcataaagaatatgattatgactcttttggggaagattttaatactcaaaattagcaaatcattgcctggctttggtgagtgtctttaacatttagaggaagtgatggctgatcaaaacacctatgttggcctagctcagtggctcacgcctgtaatcccagcactttgggaggctgaggtgggcggatcgcttgaactcaggagttcgagatcagcctgggcaacgtagcaaaaccccctctctaccaaaattagccagggatggtgttacgcacctgtagtcccagctacttgggaggcaggctgaggtgagaggatcacatgagcccaggaggtcaagaaatacctctctcctggctgatgatgggactcagaagtgaaaagtaggagaaggctaagcagaagccaccacctaaggggaattactttagaaatgaaggtgccgtggggctcttgatttctttggcagtagttttatggaagcatggatgccattgttccctatttctgctagtatgtttcagagacaaagtaaattcaagaagagatgagcaacagaagaaatagtactaatgtgagctatgtgaatagtggtattttgcatagagcctttattaatttactttggttctttctgctttgtcttttttaatctgcccctttcaccccgtgtatccgttttctcacggtagtctatacattttgttgttctgctatggcatcttgtatcctttctctatttcccttcttctgaaaacaaacgtctataaaggaggtttgctattgtaaattgtagtttagaagttaaccctccccctgtggtttagtctcttctaataagctataagcaacatgggccagaacctatgtgtaaattcatcttgagtgaatgaataaataacactattatggctaagtaacctatacttgcacatatacatgaaaaatatatggttggctatattatggaataatataggaatctataaaagaacaaaaaatttattacctttatacccagttttaaaaatactgtgttcccttttagaaggttgtggtgcttgaacgacaacaaaaaggtaaagagtacgcactgtatagacccatttatgtgaagttctttaaaagacaaacctatggtaagaaaaagcagatcagtagttgcctggggctggagtgggcaggattaactacaaaggaccaaaagtagctttacggaatgattgaaatgttctctgtcttgaccatgtgattacacaaacatacatactttttaaaaaaactcatagaacatttaaaatgggtgcatttctatacttctataaaggacacgggttatatatattctgccactgcactccagcctgggcaacagaagaaacagtattaatgtaagctatatgaatagtgatattttgctattttgggaagctgaggtgggaggatcacttgaacccaggaggtagaggatgcagtgagcagagatcgtgccactgccctccagcctgggtgacagtgagaccctgtgtcaaaaaaaaatttttttttttacctgtactgaacatgtacagacttctttttcttgttgttattccctaagtgatgcagtgtaacagctatttatgtagcacttacattgtattaggtataagtaatctagagatgatttaaagtatataggaggatgtgcataggttatatgcaaatacaaaaccattttatattagggacttgagcatctggaaattttgcgggaagtcctgcaacccatctccaacagataccaagggacgactgtactccgatatatagtttctatagttaagcataaaggtgaaaacagaatatgagtttttggtcccttacaagtgagtactatcttgtgcttaactatgtatcataaatactaattttgagtaaaattcagatgtgcccatagtcatatatatactgtattctgatagctagtttgagatattaggcattaaaatgcttttattagcaattcaatagaacacttaaaatttgttggtagaagactgattacataactcaaattatttgtttgaattaaagttttcattacagtcatctaagtcaataaaactcgtgtttaagtgtgtcttatgacagtgaccataagccaaacacagacttaagccaacaaatagctatcctttacaatggagttgtgaatttgttaatgtttttcttttctccagtttataagtagcaacttgttggattgtcattctgaaacactgaaacaaagattttacttgaaaaaaaatactatggtaaaatggaatgaataataaattaattttcccaaatgtcaatattcaacttataaacaccttgataattgacatttgtaagaactttagaaacactataaaagttgcatctgaataagtttttttttttttttgagacggagtctggctctgtcacccaggctggagtgcagtggcgtaatctcggctcactgcaagctcctcctcccaggctcaagtgattctcctgcttcagcctcccaagtagctgggactacaggcctgcaccactacacctggctaactttttatatttttagtagagacggggtttcaccatattggccgggctggtctggaactcctgaccttgtgatccgcctgtctcagcctcccaaagtactgggattacaggcgccggccactgcgcctggccataagttttaataaaattatattgtgaactccaagacatttttctgtattcttttttgtgtctgttattaaattatattctctggaatattgggctaacgtagggtgaatggatgggaaaataaacacagatgtaattttataattatttttaaagaacttttcattttcttagtgaatttttgcctataatattgggtacaggatgagaatttatatgtaatatttgaattatagatactttggataaaatgacttcttaattccttaaaaaactaattattgcttttttttaaaactaggtaattaggtagttgaaagacagaatgtcattaagttaactaaattaccactgtattacagtaaatacaaacaacatacttacagtgtaaactatggtaaataaaaactaaaaaaacacttccttgaaagtattttttaaccaaacttcacaaggatggatagaattaacactataaattctgcacagaaaaaaaatagtgcatactaaattgagaacagatgcacagaagtgctatttttagaaattaaaaaatggtaaagatgataataggcagatcagaagtcccacatatttatcagggttgtaaataaaaacccagttcaaaaacatgcattactaactggctgtgtgatttttaggcaagttacttaacctttctgtgactgtttgttcttgtaaaataggaataatagacttatagaactgtaacgaggaatggatgagttaatatttctaaagcatttggaatagtgcttgacacatagtaagtgctatatgagtgcttcttaaataagcaaaataaaagtatgtacccagaggaaaattacttggcaaacatacttagaatgtagcaagaaaccaggattttattagcataagcttcagaacaactcaagtgttgctaaatttacattacattacatattaatgtaataactattttaatgtaatatgtattttaatatgtaatgtaattacatattaaatatgtatataattacttttaatatgtaatgtaatgtaactacattacatattaaaagtttagggctgggcatggtggctcctgcctgtattcccagcactttgggaggccaaggtgggtggatcacctgaggtcaggagttcaagaccagcctgggcaatacagtgaaactgcatctctactaaaaaatacaaaaaaattagccaggcttggtggcgtgtgcctgtagtcccagctactcaggaggctgaggaaggagaaatgcttgaacccaggaggtggaggttgtggtgagccaggctcttgccagtgcactctagcctgggcgacaagagcgaaactaaaaaaaaaaaaaaagtttaggcatttatagcactgtgttgcgcagggtttatcttcctaaaatacaaatccaaacttatcacttgcttaaataatcctttagtagtatccatgggttttaggatgaaatccaaattctttttatttttgagatggtgtctcgctctgtcacccaggctggtgtgcagtggcatgatctcggctcgctgcaagctctgcctcccaggttcacgccattctccggcctcagcctcccgagtagctgggactacaggtgcccgccaccacgcctggctaattttctgtgtttttagtagagacagggtttcaccatgttagccaggatggtctcgatctcctgaactcttgatccgcccacctcggcctcccggagagctgggattacaggcgtgagctgccgcacccggccgaaatccaaattcttaaaacctgggtcctcattatatttcttaaaaaaattgagaaaaaattcggttaacaaagttcattttgtttgtttgtttgttttgtttttgagacagggtctcactctatcacctaggctggaatgcagtggtgcgatcctggctcactgcaacctccgccttctgggttcaagtgattctcatgcctcaccacatgagtagctgggactacaggagtgtgccaccacgccaggctaattttttgtatttttagtagaggtggggttttgttatgttggccagggtggtctcgaactcccgagttcctttttattgcagaatagtattccattttatggatatatcacattttgtttatctattcattagttgatggatatttgtgtcatttccacattttgactgtcatgaacaatgctgctgtgaacattcatgtacaagtttttgtatagacagatgttttcatttctcttgggtctgtctatacataggagtggaattattgggtcatatggtaactctatatttaactttctaagaaactgccaaactgctttccatgatggctgcaccattttttcatttttaccagcagtgtatgaaggttcagattttttcaaatttttttgccagtacctatctgtctttttaataaagccatcctagtgggtatgaattggtatttcttgtgattttgagtaaatgtctctgatgactaatgacattgagcatcctttcatgtgattactagacagtagtattaatatatctttggagaaatgcctattcaaggcttttgtgaactttttatgatgaaaaaatcttaaaaattatatatttatcatgtacaacatgttgttttgaaatatgtatacattggctaatttgagcttattaatatatgcattaactttttttggtgagaacgcttaaaatctattttcttagtgattttcaagaatgtaatacattgttattaatttttctcactttaaaattgggttattaggccgggtgggcgcagtggctcatgcctgtaatcccagcactttgtgaggccgaggagggcggatcatttgaggtcaggagttcaggaccaggctgggcaacatggtgaaaccccgtctctgctaaaaatataaaaattagccaggtgtggtggtgcatgcttgtaatcccagctgctcaggaggctgaggcaggagaattgtttgaacctaggagggggatgttgcagtgagtcgagattgtgcatctgtactccagcctgagcaacagagtgagactctgtctcaaataaataagtaaataaataaaataaaataaaattgggttgtcgtcttattcttgaattgtaagggggtagtgtcatttgatgcacaaatattttaattttggtaaaagccaatttattttttctttgttgctcatgctttggtgtcatattttaaaaactattgcctagcccagggtcacagaggtatacctatgtttttttctaagaactttataatcttagctcttacatttaggtatttgatccattttgagctaaatttgtatattgtgtgaggtaagagcctaacagcttcattgttttgcatgtgcatatctagttgcctgagcactatttgttgaaaagacttgtttcccccattgaatggtcttggcactcttgtcaaaaattaattgggcatagatgtatggctttttttttttttcttctggactctcagttctattccatttatctgtatgtctatcctgtgtcaataccatattgtgttattactgtagctttgtagaagttttgaaattaggaagcgtgagccttccaactttttttcttcttttgtaggattgtttcggctatttaatgtctcttgaatttttatataaattttaggaacagcttctcaatttctacaaagaagtcagctgtgattttagtaagaattatgttgaatctgtaggctaatctgaggagtattaccatcttaataatattaaatatttttgtccatgaacatgggatgtctttttattttttttagatctttatttcaacaattattttaaaaatttatttataagtattccattcttttttaatcattgttttttaagtgttaataaaattatggaaataatttgaagaaaggtttgtcaaaatttaggaaagctcttatttattaaatttctgttttatttatttaaatttatttattaaatttctgtttttaagggatggggtctcattctgtcaccctggctgctggagtgcagtggcatgagcatgaatcactgtagtcttgaactcctgggctaaagcaatcctcctgcctcagcctcctgagtagctgggactactcagtgtttacaggtgtataacaccatgcccagctaattaaaaaaaaaaaaaaattgtagggatggattcttctctgttgcccaggctgatcttgaactcttggcctcaagtgatcctcccatctcattcttccaaaatgctgggaatacaggtatgagcctcaaggcctagctgagcttttgtatttaaacacaagattatgcatgtgttaagggaaagaaacctagcatatgataaaatctgtaaaatattagaatcagtcatagatgtaaagctgcagtaaacaataaagaacatctagtgaagtccagttttgcttaaatagttatactggatggtaagcttcttaagggcattgactataccttgcatttttgtaacacctggcacaaatgctttgtatttgaaaggttcttgatatttattgaatgaaagagtaaatgaatgaatcctacatccagaaaagaaggaaggaagggttttggaagtttgaggattgtgctctagttatatgtaacctacaagtagcaagtttcagttggaataataataattgcattaaaataactgcaaatggggaactaggcctttaaagagttggggccagttgcggtggctcacacctgtaatcctagcactttggaaggctgaggtgggcagatcacttgaggtcaggagcttaagaccagcctggccaacatgatgaaacctcatctctactaaaaatacaaaaaattagctgggcatggtggtgcgcacctttaatgccagctactcgggaggttgaggcaggggaatcgtttgaaccctggaggtggaagttgcagggagctgagatcgtgccactgcactccagcctgggagatacagcaagactctgtctcaaaaacaaaataataataattggaactatttaatctgtaaagataagaatttagataaataagatgaaaattgaggtgtatttgttctgtgtctcttttttttttttttgacagagtgttactctgtcatctggactgcaatgcagtgagtagggtgcagtggtgccatctcggctcactgcagcctccgcctcccaggttcaaatgattttcatgcctcagcctcctgagcagctgggactacaggtgcatggcaccacacctggctaattttttgattttttagtagagacagggtttcaccatgttggccaggctggtctcgaattcctgaccttaagtaatccacctgcctcggcctccctcggtcttgctatatatagcaagacaccatctctacaaaaaataaaaaaattagctgggcatggtggcatgtgcctgttgtcccaattactcaggagcctcaggcggaggatcccctgaggccaggatgtcgaggctgagtgagctatgattgtaccactgcactccagtctgggtgacagagtaagaccctgtctcaaaaataaaatttattttggtggtggatgcacagctgtgactctgctgaaagccactgaattgtgtgctttaagtaggtaaattgtatgatatgtgaattatatctcaataaaatatgtatatatatacatgtatatatattcacaaatataaatgtattggaagggtttaaacagatggcaagtgctgtcaaaacagagtagaatttatgtttttattttttattttttgaggtggagtctcgctctgtcgccatgctggagtgcagtggcatgatctcagttcactgcaacctctgcctcccgggttgaagcgattctcctgcctcagcctccctagtagctgggactacaggcagatgccaccacgcccagctaattattattatttttttttgtatttttagtagagatggggtttcaccatgttggccaggatggtcttgatcccctgacctcatgatccacctgcctcggcctcccaaagtgctgggattactggtgtgagccacggcgcccagcccaatttttttttttttaattgtgtggggctgtctctcataaaagtagttttcttcatgcattgctggtggtaatgtaaaatggtgcagctgttgtgaaaaacaggtggttcccccaaaaaagttaaacatagaattatatgatccagcaatttcacttataggtatatacccccaagaattgaaagcagggactcaaacagatactaatgcactaatgttcctagcagcattatttacaatagccaaaagaagatggagacaacccaggtgtctttcaacagatgaatggataaattccaaaatgtggtatataagtacaagggaatattattcacccttaagaaggaatgaagttctgttacatgccacagtatgaatgacccttgaaaacatacgcaaagtgaaataagccagacagaaaaggacaaatattgtatgattccatttacatcaggtaaccagacacatgagatacttaaaataggcagagaaagaaagtagaatattgtctagaaagtagaatattggttaccaggagctgggggttggggaggaatgggaaactatagttaaatgggtacagagtttgtttggagtaatgaaaaagttctggaaatgaataatggtaatggttgcacaatgtcgtgcatagatttaatgccactgaattgtgcacttaaaaatagttaaaatggtaaattttatgtataatttactgcaattaaaaatgctttcaaaaaacaagaaatttttaagagtaagatgcactacttttttttgtaaagtttgtgagacataattgtgtggtatgtggaaaggagaatattttcatttttgcatttaaaagaatatagtgttttagttgtctgtcatttatggttttcttccttctgttttcagagagtgtgaatttctgactttctatgtgggacccaaaatctttagctttagatgtaagtgagatgacctaaataccactgactatgttacatctttgataatcaaaaactaaattttgataagccagactagactacagatgactttgtgaaaaattcatgaggcgtagacatattaaccttgtttagattggaatttttttttttctttttagacggaatctcactctgtcacccaggctggaatgcagtggtgcaatcttggctcactgtaacctccacctcccaggttcaagcaattctcctgcctcagcctcccgagtagctgggattacaggtgcccaccaccatgcctggctaatttttgtagttttagtagagacgaggttttgctgtgtttgccaggctggtcttgaactcctgacctcaggtgatctgcccacctcagcctcccgaagtgctgagattacaggcatgagccaccatgcccggcctcgactggaaaattttttgacttttaatatgcttggttgattcattttgttgatttctggaaagcaaatgtttgtatttaatagtagcaataggattgcagttttctaataaatatcacagaattatggcagtgagccaagaagaagaaaagctgtattagtgaaataagacatacttctatagctatggaaactgtaaaccctactaagtctgataaaggtattctctttgtatttgtattattagacattggtaggggttcatgaaaacccaagataactgctatattaaatctaggtatgattgtattcatcaaaaggcctggttaaaaggcactgttaggtagtttagtatttgttttgtgtgaatattaaagtgcttttttttctttttttttgagacaaagtctcgctctgtagcccaggctagagtgcagtggcgcgatctcggctcactgcaacctctgcctccaggttcaattgattcttctgcctcagcctcctgagtagctggaattaccgcctggctaattttttgtattttttttttttagtagagacggagtttcaccatgttggccaggctggtcttgaactcccaaccctcaggtaatccacccacttcggcctcccaaggtgctaggattacaggtgtgagccaccatgcccggcctatttttcttcaatttctcttctttttttttgagatggagtctggctctgtcgcccaggctgtagtgcagtggtgtgatctcggcttactgtaacctccgcccccctgtgttcaatcagttctcctaccttagcctcctaagtagctgggactacaggcgccgccactatgccgggctaatttttatatttttagtagagatagggttttgtcatgttggccaggctggtcttgaactcctgaccttaagtgatctgcccacctccggctcctaaagtgttgggattataggcatgagccactgtgcccagcctaatttcacttcttatggtcctcaactactaaagcattttctatttgaaagaataatattagattattgccacagctgacaatttatttgagaataaatgagagaataggaatatgactctgtttattaaagttaaattaatcttaaccagtacatttgtttactggtaaaatgcatattagctgtgcacaagtagattttatgaataaattattttaggtataaattaggcactttggtaatttatagtgctttcttttttttttttttttttttttttttgggacagagtctcactctattgcccaggctggagtgcagtggtatgattccggcttactgcaacctctgcctcccaggttcaagcgattctcctgcctcagccccctgggtagctggaattacaggtgcacaccactatgcctggcccgtttttgtgtttttagtagacacaggtttcaccatgttggccaggctggtctccagttgctgacctcgtgatccacctgcctcggcctcccaaagtgctggaattacaggcctgagcctctgcacctggccgcatgattagtgctttcaccaagtaataatttcctgatagataacctgactagcatattagcttaatatcttttctaattataaaaaccaactaactcctgagaatacttaagacaaggtctgtaatcagggttgcctgtatttggtgaaattaatgggctgtttggggtgccaagcttcaaaagagagatgattgctaatcctaaaatataaaggtaacctagagccagaaagatagctactgagtaattgtgttctcaccacacttatttgtgtgtaaatttaaaagtgcatttcctctcaaatttagatatgtcttgttctgctatttttctgtactagaaagtacttcttcagattgctaggctacttaccagaatcatcaactactaactagtaaagaaacaaactgtgttttgggatctcccatatcaaatatatttagaagtgaaatttagcaatcatttattttatgagtaaaatgaaacagaaaaagtgaactatgaggggtagactcctttggaaaaatcattttaggttggaacctataatattgcctagaagagagaacccatccatgttgaaatgccagattagagggaagtttataaagaaaagaccatgtagaatgatttgaatgtttaccactgtctagttttggaaagaaagaccagggcattacatgcagggtccttcttggtgttggaccctccctcctcttttcctacttctttttttttttttttttttttttttttttttgagatggagttttgcttttgttgcccaggctggagtgcaatggcacaatcttggctcaccacaacctccacgtcctgggtacaagtgattctcctgcctcagcctcccgagtagctgggattacaggcatgtgccaccacgcccggctaattttgtatttttagtagagacagggtttctccatgttggtcaggctggtcttgaactcccaacctcaggtgatccacccactgcagcctcccaaagtgctgggattacaggcgtgagccaccacgcccagcctcctacttcttttttagtagcccgttgtttgtctaacttgtctatcagttggatgtttcagagatcatggatttcagtaaacatagctctttgtaacagaactggatggtgtgtcctatgagaaaaataccgttttagcaatcgaaatgtggatgtgctatataataagacagataatctttaaatgacaataaaacctcaactcagaaactcaaaggataaaatttgataaaaataagagggcaaaaaaaattttagcagttaaaacagctgggaatagacagagtagaaagcagtagccctaagttttatatttgactaaggttgaatagaaacttcaggttgcagtgtctacctcaggatgattcaaatcactttgagtctttaagatatggctcttgaattctcaacccaagaattttaaaaaaagagaaatcctcatttttttgctaagaaacaggaagttatttttcttgaaatataagttatttataattttgtttctcattatttcttctctgtatcttttttcttccatcatagatgactcattgacaccccacgcatctaaaaagttcttaagctggccacagtggctgacatctgtgatcccagcactttgggaggccagggtgggaggattgcttgagtccaggagtttgagaccagtttgggcaacatagcaagaccaacccccctccccaactgtctctacaaaaactttaaaaaaactagccaagtctggtggcacatgcctgtagtcttagctacttaggagactgataaaggagaattgcatgaccccaggagttcaaggttacagtgaactatgatcgcacgactgcactccagcttgggcgacagaatgagaccctgtctcaaataataaaaaaataaataaagctctgcattttggcagttgtgggtcgtctgagtacagacgttgagtcctgagtatcaggtgactaaaaactctagtattgtaaatagatttgtaaattgacaaatcttgttttagacaattttgctatggtatgcaacaaagttatttccaaatacttttaggtttggatatttaaagtgctatttaaaaaactgtattagtcaaagttcaggattttttgcgtaaatgtgatttaaagtataaggcagttctagttctttctttgtatttgtattgttaaaataagactcagttgaatttcagtttgaaaatactggaaaattgttattcatagctactttgtctcaggctagatgattataaggagaaaattaattctaaagtggtttaaaccaaatcatgttttaaatttagtgttatataaatttcaggttgtgttctatatctttttttggctttcccctccctcagcctaacagtttagttgttcaggatagggagatttgtcccatgtaattatttttcagttttgctgaacatatttttaaaatggctacctttcttgggtacagtgtcatgggattccccgccccatctggggtagagtgttgtgggattagagtgagataagagacaaaggagaatctttcaggtcttctaactcaaatcactagaaatttaggcacgatctggaccttaatgtgtgagaggctgtatcattttatttcccaaattgtattttcttttttcttgagactgagtctcactctgtcgcccaggttggagtgcagtggcgtaatctcggctcactgcaaccttcgtctcctgggttcaagcaattctcctgcctcagcctccctagtagctgagattacaggtacatgccaccatgcctggctaatttttctatttttagtagagatggggttttgccatgttgaccaggctggtctcaaacgcctgacctcaggtgatatgcctgctttggcctcccaaagtgctgggattacaggcatgagccactgtgcctggccacaaattgtattttctctaacttctagttggtatgaaaaaagtattaaagagtcccctccccaccccgccccagttttcttactccgaggatgaagatgaagtggaaagctttagatagttggtttttcagcctggccaccatggaaaaattatttactgttttatgaaacatgcaattcagttaatttggaggaagctgtttagtaaggggaaaaggacaggatttctagttaggaaacataatcaagtatctgttttaaactttgctagttttatttcttttcctctttttatcctcatttcctttttatctagcaagattatcgtgaagcttctatgaataattttctacattatgctagtgcctttaaacagtgtttgaatatgaatctctaacttgctctgaatatgttgagaaaaaaagttgatttttcaggataagtaattctttttgggtgttcaagatatttttaacaaaaaatttttcagaaattgaaagttggcttggcacagtagctcacacctgtaatttcagcacttcatggggccaaggcagatgacttaaggccaggagttcaagaccagcatgggcaacatagcaagaccccttcctacacagcccaggagtttgaggctgcagtgacctgtgattgtgccactgcatttcagcctgggtgacagaatgagaccctgtcttgatttaaaaaaaaattacaaaaagtctttccaaagctataaaaactttaagctttattctttctctttttccatgatacttattggctcttttaggtttagtggtaactcctaccaataattcttaaaaggaaaatgataattactttttcttttttttttttttttttgagaaggaatctcactctgtcacccaggctggagtgcagtggtgtgatctcggctcactgcaacctctgcctcctgagttcaagcaattttcctgcctcaacctcccaagtagctgagattacgggcacccaccaacacgcctggataatttttgtatttttagtagagacggggtttcaccatgttggccaggctggtctcgaactcatgacctcaagtgatccacccaccttggcctcccagagtgctgggattacaggcgtgagcaccatgctcaatggtaactactttttagggatgatacatggtacttagttgtcactgatttttttttgttgttgttcaaaaattattatagtatctaaaatcttgtgaacatgggaacagattgtgaggagaaaaataaataaaagcttgtgattatttcaaattcttatgatctcaagtcttgactaaaatgtgtgctttacagggattaagattaaagtgaagctgtttttttccctcataatgtttctaacttaaatttttaaggggcattaatacttatgaaattgatagttttctcatcttttgattactcccctcaattcatgcttctgaaaaatgcattctagctaaaaatataagaatgcttattaatcataaaatatattggtacttgtttagtgtagaactaagggatttagatatatcctttaaaggcaaataatacatttgatcattaaatggaataaattgctttcagagtagagtagggtttattcttgggagtttgaagttgagcacagaggcatggatataagaatggattcacatctatttcctgtctgggtgctttaggaatttaatcctttttaaaactggaactattgggaattttattttttttgtgtgaggaatcatgaaaatcccatgtttaagtacatatttttctaattagattagttgcgttagtgtcaaaaatgaataaactagttttaggtttcctacgtgttttgaatattttatgtatatacatactcttactaactatgaatacataaattagccaacaaatgttagtcagaattttattttgattggtcaacttttaaaactgtgacttttactgagtttctgtctttatctttctagatgttatagtgaaatgtctaaggagggaaactgaaatgaagtggtgtctgccaaatgaataactttacttgtggtattgcagcacagttacttcttttttaaaaaaaaatttttttaattttaagacagggtctcactctgtcacccaggctgtagcctccacctcctgggctcaagcagtgctcccacctcagccttccaagttgctgggaccacaggtgtgcaccaccaggcccagctaattttttttttttttttaactagagacagtgtctccctaggttgcccaggcgtgtctcaaacttctgggctcaagtgatcctcctgcctcagcctcccaaaatgctgggattataggcaggagccaccatgcccggcctagttacatttctaacaaagtaattttgagaacacaggtaaaagggatgtgatctgaaaactgtttggtgtgtagaatggggagagaaaaaaggaagcaaattaaattgaaggaggaaatatggtaaatttaatttttgagtttattattggaagaaaacacgccattttgtgcagtataagaatataagcttatcagaatttttaaatattaaggtttgtattttaacccattttcatattagagccatttttttccagatcctgttttcagctgtatctattaatggggtgaatttactccaggctccctggttgttcattaacctagtagggcttgactactttaataggttcaggaaaatgtgcttgttagttgaaactgctcatagctggaattggaacttttctgcagtccttccttgtctgtggggaatatgtcctaagaccctctagtggatgcccaaaactgagcatagtaccaaacactatatatacagtcgtgtgtaactttatgatggggtatgttctgagaaatgcgtcattaggtagttcgatcatgcatacatcatagggtgtacttacacaaacctatgtggtatagcctgctacatatctaggctgtatgatttagcctgttgctcctaggctacaaatctgtacgacatgttactgaactaaatactgtagacaattgtaacacaatagtaagtatttgtgtatctgaacagacgaggtaacacgtggcatgacatcactaggagataggaatttttagtctgcattataattttatgggaccagtgttgtatattaattataatttataagtctttatgtatcttttatatggaaacccaaatgtcccagcaccattgctgaatattatccattttccctacttgatctacaatgtcagtattaagtggcatatagcaggtttctgtatattctgtattatgatcttatggcaccactgtcatatatgtgatccatccttgactgaaacatatgtggcacatgactgtactatgttttttcctatacatacatacctgtgataaagtttaatttataaataaggcacagtaggagattaataataataactattgtattgtcagggttctctagagggacagaactaataggatagatgtatatatctacaggggagcttattaaggagtattgactcacacaatcacaaggtgaggtcccacaataggtcatctgcaagctgaggagcagggaagccagtccaagtcccaaagctgaagaacttggagtctgacattcgagggcaggaaacatcgagcaagggagagagatgtaggctgagagactaagccagtttagtcttttcacgttcttctgcctgcttttattatggttgtgctggcagctgattagattgtacccactcagattgagggtaggtctgcctttcccagtccactgactcaaatgttaatctcctttggcaacatcctcacagatacacccaggaacaatactttgcatccttcaatcaagttgacactcagtattaaccatcacaactattaataaatagaacaatacagcaacatactataataaaagttatgtgaatgtggtctctcaaaatagcttactgttctgtattcacccttcttataatgatgtaagatgatacagtgccgatgtgatgatattaagtgaggtgcatcacgtaggcattgtgacacagcattaggctactgttgaccttctgtattcccgaatctgtgtcagtcattttaggggatcccttgttgctcatgggtttctggtgcaacatattgctgtcagtggagggaaagggggtagctatgaaagattcggtaaaccatgttttctgttcatgtctttcacctacaaatttaatgccttttaaatcttaactaagcacttatcttgctctggctgtaacttttgctgtttgaggtgtggcagcaaaactagcatgaataatttctttttcattctttcgcagttttacagatagaagactcattcttaccgtagatcttagcagcctcagcatacgattttttctttccttattaagaagtttcactttttcacttaaatgaagcacattaaaacttcactttggcatatccaaattgccaaatgtcactactcttccactttggggccattgttaagtaaaataagggttacttgaacacaaacactgtgatactttgacagttaatctgataatccatatggttactaagtgactaaagggtagatagtgtgtatagcatggatacactgggtaaagggatgattcatgtcctggatgggatggagctggactcgcaggtcaacagaaaatttcatcatgctacttagaatggtgttgtatttaaaatatataagttatttaaattggaatttttcatttaatattttctgaacttggttgaccatgggtaactgaaaccatggaaagcaaaaccatggataagggaggactactgtatttaccagatgagttgatttcattttgagaaaagttacttgtaactttagtaggctgacttaacatgttatgataacaggattatttagattataagagactgggcaggcagatattacactagtcttgtactttgctcataattttatagagcactttgatgtatatttatttcatttaatgtttttgacatctgagaggtatatattctcatagataataaaacccaaacgtcccagatgattaagagacttgctcaatttgacactgttagtcattagaagagctagtcttaaaaaaagaaaagaaggccgggtgcagtggctcacgcctgtaatcccagcactttgggaggctgaggcgggcagatcacgaggtcaggagttcaagactatgctggccaacatggtgaaaccccatctctactaaaaatacaaaaattagccgggcgtggtggcacgtgcctgtaattgcagctactcaggaggctgacgcaggagaatcgcttgaacccgggaggcagaggttgcagtgagccgagatcgcgccattgcactctagcctgggcgacagagcaagactctatcttaaaaaaaaaaaaaaaaaaaagtattctgacttcaatccattttttttctctaactgcaaccaagataatttatttactgagtattttcagctattatgataaaagacataaatgtgatttcttccctaattgagcttacttcatagtttgagagtcagactagtaaataattaattaaaaagagtatgttaggtgctctgaaagggaaagtatagtttgatgaggtgggaaacaaagaggagtccctgtgtgccaggggatcaggaagggcttttgatgggaggtgaacttgctatcaaaatcagtcctgaagtcataaaaattagtcatgtaaagattaaagggctatgttggaggaagaatgttccaggcagaggggagaataccatgttagaagttttggaggtaaatgagagcttggtgtattgaagaattgaaagaaattcagtatggctggattatagagctagagaagagggaaggagagggaaaggaggtagctatgaaagattcggtaaaccaaaagctggatatgataaggtcctaaattagtgacaactaggaagagaaaaagagtactgcaggtatcacaggctaaataaatgtgttagaaatattttagccaacaagtgatattttatacagttattttacatatatatatatctcttgcgatttccttgcacggtaaagggcacattatcctaaaagttgaaaataggttaacagtgcactgttcatcatggtgaactctggagatcagttttggctatcagattcttttgctatcattcctagcatgatttctttactctcgcttgttgaggttaattttgctctaaagaattctaaggtgggtcttggacctaatgttttctttttttttttttttgagacagagtctcgttctgtcacccaggctggagtgcagtggcgcgatctcagctcaccgcaagctctgcctcctgggttcacaccattctccttcctcagcctcctgagtagctgggactacaggcgcccaccaccgcgcctgactaattttttgtatttttttagtagagacagggtttcaccatgttagccaggatggtctcggtctcctgacctcgtgatccacctgcctcggcctcccaaagtgctgggattacaggcgtgagccaccacgcccagccggacctagtgtgaatagagggtagataactaagtgaggattacccttgctaggccttagtaactgttgtctagagaagaagatgttagggaaaagcaagggataaagtgggtatgaaggagtgtaaattatgacttgttgctatgatatttagttattggtttaatttttacatgtaagcttgtcattgatatactgaatattaaaatatttgggtgtggtggctcacacctgtaattccagcactttggaagcccgaggcgggaggatagcttgagcccaggagattgagaacagccttatgcaacataacgagaccctgtctataaataaaaaattagcctggcatggtggtgtgtgcctgcagtcacagctactcaggagcctgaagtaggtggatcacttgaggccaggaggttgaggctgcagtgagccatgattgcaccactgcacgccagcctgggtgacagagcgagaccctgtctctttaaaaaaaaaaaaaaaaaaaaaagatatttgggaaagtggccatttattcaatatacattttgtgcccagtgcttgaagtataaaaagactcaccattgttaatagggaagacgggcacacaatatcaacatagtaaaataattgtttcatgataaaaataaacagtagaagataataagttcagtttgggatatgttgaaattgagatgcttatgggatattgaacacctgctatgcaacaagcactaagctatatgctggggctacaaaaagtaaagaaaataaagtccttttcctcaccagttcatattctggtggttggaaacagacattaaagaaatgattataaaaatgtcagcgtaggccgggcacgatggctcacgcctgtaatcccagcactttgggaggctgaggtgggtgggtcacctgaagtcaggatttcgagatcagcctggccaacatgatgaaactaaaaatacaaaaattagccgggcgcgatggtgcgtgcctgtaattccagctactcaggagggtgaggcaggaaaatcacttgaacctgggaggtggaggttgcagtgagctgaaatggcgccactgtactccagtctgggctctgggcgacagagtgagactctgtctcaaaaaaaaaaaaaaaaaaaagtcagggtatgggattgacaagtccatagaaacagaaagtaaattagtggttgccagggattcaaggaatggaggttggagaatgactgctaatggggatggcttttcttttttgaggtgatgaaaatgttctggaattaggtagtagtaatgactacataactttgggcctatactaaaaacactgaatcatgcactttaaaagggtggaactttatgttgtgtgaattatatctcaaaaaatgttgggagttggccaggctcagtggctcacacctgcaatcccagcacttcgggaggccgaggagggaggatcacctgaggtcaggagtttgagaccagcctggccaatatggtgaaaccctgtctctcctaaaaatacaataattagctgggcatggtggcgcgtgcctgtaatcccagctgctcgggaggcaggagaattgcttgaacccaggaggcgaatgttgcagtgagccaagattgtgccactgcactccagcctgggtgacagagcgagagtcagtctcaaaaagaataaaataatgttgggagtgaaaaaaataaagcagggttaggagggataagaaaatggtgggggcactattttgtagagcatgatcatagtgatttttgagcctcatttgaacagacatctaaaggaatcgaaggagtaagcaatggagataaatgtggagttttccaggtggaggaaaggcaagtacaaagacatcaaggctgtgaaagtgcttggcatgttcaagaagtagcaataaaggcagtatacctggagcagagtggaaaagcaggagaattgtaggagagaaagggagagagatattaaggtgctagatcatgtaaggactttgggttttatgctgagatgggtgctgaggagtgatgtcatctgaattaggtttttaatgaattattctggctacagtgtagataataaagtgtaagagtaaaagagaaaatcaattaggaggtaattgaagtagttcaggtgagatgattagatcaggattgtagtattggaggttgttaagaagtggtggaattctcgattagaaaagtgagaaagaaaaagacaggattcatttctctgggaaaaaaaaaaaaacaagatatttcagggacatgaagagaggagtagactaaagagaaggcaacaaaggaagaaaataaacaggaattcctgaaagcaggagtattcaattgtgtcagaaattggaaataaatcaattaggagtttattgataaccaagcaatttgaatggggagtggttggaacagaagccaagtagtagttggttgagtaataaatgtgaatagaggaagtggaggcagctaggaagacaactgtagtactaagtaaggatggttgtgaggggaaggagagagtggaaactagaaaggcatatataagaataggaatcttgtggaatgagggagttgaaaggacaggaattattaatagaggaaagttttggaggagcagtgaagaaaaagggatctagtgcacatggttgcttcttttcttgagcccaaagaggtaaggataatttttacctgggaaaggaagtatgggaaatttatgtcctatacatttgctgtggagaaataaacagtcatttgccaagaatgatagatacaggatagtagccttaagagaatcatcatgaggaactggggagtaaagctgataaggaatactttgaaaaaaaaaaaaaaaaaaaaggctcctgagctactttgaggaagatcttgaattcatagtggtactggtccacaattttgatttttctctatcaaaacttagaagctgtggttcaggaatgttgaagatgagtgcttaggatcattcaggattgggtatgattaacaggatgaatatgatcaaaaaataatggggatggggtaaaggaattcttcaagacacaagctcaggcttcgtcttttccttgaaatggcccccattggtcttttctcttttaattttgtacttttctctgctattgctgccttatgtttagtccattagaatttacgcacacacacatacacacacacccttaagcacttaaacatttttttttaaatatggaaaacgacaaaacaagaacaaatcacatgcagtcctgccatatctagatatgaccactgttaatatgttggtgcttattctttcaggcgtctctatatatgtatacatatctacttatttatacatttctgcataagagggattatacatctgttttatttgcctactgatgttattaaatatagatacaatttgtgatagctgcaaagtattacgtggtaatttatttatttatttttgagacagagtctctctctgttgcccaggctggagtgcagtggcgcaatcacggctcactgtagcctcgacctcctgggctcaagtgattctccagcctaggcctttcaagtggctaggactataggtgtgcaccaccatgctcggctaatattttttaaaaatttttttgtagagacaggatctcgctatgttgccaaggccagtttcaaactcctgagttcaagtgatcctcctgccttggcctctcaaagttctaggattacaagtatgagctaccatgccaatcaatgtggtttaaataacaaaatttagttaattagccaatcctttggtgatggactattatttcattttattttttaactgttataagtcattgtaatgaacatagtacaaatgatttccccctgtactggtatgagtactgttctaagtacttaaatttgtcttttatttctaaatttcttctgctgtcatgtttcaaggtgaatccttcagacttgcattcttttagctttctcttgagaatggatccaaatgaataaggctacctgcatattattagataagaccacccccaaaccatcttgtaatctacagtgttgaggttaagtgcataggctttgaagtcagaacagatttggattcacatctttgctctgcttcttcatttagttgtatagctttaaacttcagttttccagtctattaaataaagaacgttgaaagcataaggctttttttttcattgggagaactctataactgagatgaaataatcattatttaaaaattttctagctaattaaaatcctttgtggtacagtttaatgttattttccttttctagattaagggaaagtagataaatcttggttattatcttttttttttttttttgaaatggagtttcactcttgttgcccaggctggagtgcaagggtgcgatctcggctcactgcaactgcctcctgggttcaaatgattctcctgcctcagcctccctagtagctgcgattacaggcatgtgccaccacgcctggctaattttttgtatttttagtagaaatgaggtttctccatattgctcaggctggtcttgaactcctgacctcaggtgatccgccacctcagcctcccaaagtgctgggattacaggtatgagccaccgtgcccagactttttctttctttctttctttttttttttttttgagacagactctcactctcaaaatctataagaaaagattttccagcctaggctggagtgcagtggcacaatcttggctcactgcagcctcaaccttctgggctcaagcaatcctcctacttcagcctcccaagtagttgggactacaggcgtgcaacaccatgctcagctaatttttttgtttttttttttggtagagataaggttttgccacattgcccaggttagtctcgaactcctgagctcaagcaatccacccacctcagcctcacaaagtgctgggattacaggcatgcaccactgctcctggccttggttatcttttttttaaccttcataaatgaaatcctatgttcctattataaatcatgtttatgtattaaatatgtatgattataaatcatgttacatgtattcaaagaatatttaatgatagaaaatattcatgattgtatgttacattttttaaagaaacatatcaaattatgatcctagttttattttttaaaaaaacaggcctatagaaaatagactaaaatgttagaatggtgatctgtgggacttgggatttgaagtgactttttattttccgtcttacacttttaaaaaatttctgaatttttatgatatatcacctttatatctcccttaaatcctttatacatcctttttgtctatcacttttataacctaaagtgtgcaaatattaaaataggaatcttcatgtagtagaacattataactgaaacttttatgattatcttaattttttctcatggattttaatttgcagtgtttatatttatggcagccctctaaatcttcttcaagtttttcatttatatgatgcattgttggagttaaaatagaacatatcagccaggcacggtggctcatgcctgtaatcccagcactttgggaggtgggcagatcacttaaactcaagagtttgagaccagcctgggcaataaagtaagacctcatctctaaaaaaaatacaaaaattagccgggcatggtgatgtgtacctatgatcccagctactcaggaggctgaggtgggaggatggcttgagcctgggaggcagaggttgcagtgagctgagattacaccactgcactctagcctgggtgacaagtcagaccctatctcaaaacaaacacagaacatatttctgtattaaggtctgattctgtgatgtgtgtataattctaggattatcatttcctttgtagatatactaaatagaaaaacttgagatttgaacaatttccttgccagtattatcacatgcagcagcttttgatggtggagagacttaacagttaaaaatttccaacaacattaatttttagctatattatacttaattatataattaattttagtagctaatatttgttttaattctttctaatagcctaggtcagtggattcttggattattgcatttaatcctcagaacaaccatataaagtctagatagtatcattactcctattttacagagaggaaaacagactaaaagtaacttgtccaggggcacatagaagcaagcagcagagctgggatttaaatggaggcaatttggtaccaggacaacgtgcacacacacactccgtacttcctactgtgataaatttctctcttggttgggtgagatttgctgaaataatgtatatttaaaggatctagcactgctcttggtaccttgtaggtgctcaattgaattttcttttataatgggcagagtgatctcattgaattaggtggcatattccacctggtagtcaaataaggaatttttatataggtaaactcggatttgaggtttgttgtacagatagattatttcatcaccaaggtactagacctagtattcaatagttattttttcctgaccctctccctcctacccttgacctccaagtaggccccagtgtctgttcctctctttgtgtccatgagtaggagttcttttttaaaaattttttattgcggtgaactgcacaataaatcaatcattttaaagaaaaccctgttgtgcaaccactacctctatctatctgtctggttcaaagccatttttatcattcccagaaggaaaatcctgtgtccatcttcaatctcccctgcccgccatgagcccaacttatggcatccaccaatctgtgttctattgctatggatttgcctattctggatttacatgtgacctcttatgtttggcttctttccctcagtataatatttttgaggtttatccaccttgtagcatgtacttcatttattcttgtgggggaatactgttccattctatggataccacaatttgtgttacctattcatccactgatggacattcaggttatttccaccttctggccattgtgaatagtgttgctgttcacatcctataatagcatatgtgtacatgtatttgtttgactaccaatttttaattcttttaagtataagaagttttcttttttaaaggaaaatggcctttattggatgtttaaaaattctataaaaatattaattaaaaaagaaagtggaggccgggtgtggtggctcacgcctgtaatcccagcactttgggaggccaaggcaggtggatcacttgagttcaggagttcgagatctgcctggccaacatggtgaaaccccatctctactaaaaatacaaaaattagccaggcatggtggtgggcgcctgtaattctagctacttgggaggctgaggtaggagaatcgcttgaacccaggaggcggaggttgcagtgagccaagattgtaccactgcaccctagccagggcaacagagcgacagtgtctcaaaaagaaaatagaaaagtagtatacagtaaagagtactactgtatacatttgtatcatagcatcttacagggagcatggcttggcgctgggcaaatgtttgttaaattgaacttttggtttttgagaaacttctttctaattctgattttgctatcaactatctgattttggagaaatcctcagtttctgtgccctagtttttatttctgtaaagaaatagactaaactctttaagagtcttttaagttctgtgaaagtctgttcccttttttcttttttttttttgagacggagtctcgttctgtcgcccaggcaggactgcggactgcagtggcgcaatctcggctcactgcaagctccgcttcccgggttcacgccattctcctgcctcagcctcccaagtagctgggactacaggcgcccgccaccgcacctggctaattttttgtatttttagtagagacggggtttcaccttgttagccaggatggtctcgatctcctgacctcatgatccacccgcctcggcctcccaaagtgctgggattacaggcatgagccaccgcgcccggcccccttttttcttttaataggaatgttttggtactgtatccttttaccctctggaagataggtacttaccagcccttggctattgtaggcagttctttctcattaaatttgcctctggaaagggctatatgatcaagaaagttgggaccactcactgttctcgtctttaacctcttgcaaggtttcttcaggaaagactcattttccatcctcccatcttccccttccatatcttgcaaaccctagtgtagagactgaagaactcaagtgcctatagggcacagacagcataatatcaattagagaaattggctgaacggtactttaggtaacttgagagtacactaaaggaggcagctccagttttccttgtggatttagtattgctggatcctgtgattcaagagaagccaaaggtctgagatttttatgtaaaatctgatttttaaatgttggcaattaattttaaatgtttttttaaactgtgcaggcgaaacagaacacttctgcagtccaagtacttactataggaagtacaagacctgtagaaaggaaaactgtggctgggtatggtggctcacgggtgtaatcccagcactttgggaggccgaggcaggtgggtcgcctgatgctaggagttcaaaaccagcctggccaacataatgaaacgtcatctccactaaaaatacacaaaattagctgggcgtggtggtacgcctgtaattccagttactcaggaggctgaggcatgagaattgcttgaactggggaggcagaggttgcagtgagctgagatggcgccattgcactccagcttgggtgatagagggagactgtctcagaacaacaacaacaacaaaaggaaagctgtgtattgtgaagtgaaatcagagtcaccttgaaatgggcatgaggtattcatcagattgcctttggaataaaagaaataatgtccgtggaatatctcagtaacacctcctcattgctaacccttttgagggcagaaattatagtttttatttatgttagtagctccaattaatatattaataatagttctaggtgtgttctacacattattgctagtgcttacaactctacaaggtagataggtattaccactgtattataaatgagacagccaaggcttgctgtgataagtaacttgtccaaggtcacacaaaaaataagtgatacatttatgatgaaacctcagttctgactacctttgttctttcattatgacatgctgcctacctcttatttattataaacaatattggtatactgacacaaggatcagatgctttgtataatggttgtagacttttccaaggaatcttgtgactttcttctttttactttatcccccttaatgcaaaaaaagagagattacaataaatacttgaaatgcgtcctaattatctgttacgtatagtcatgattgtgagtttctgatcaagccaaatgaaaatttatgtgcttttaacaatgatattgacaacctctaatactagaacctttatcccctgagtcttaaccccttaattcttccatattttgtaattggccctttaaagataaataggtgtagaaggatttcttacatacctcttaagcatctgcttctagagcatagccactggcaaatggaaacaactgaattctcttctagagcacatttgaatccatctcactaaagcttctcaacttgtgacttcttctgaaaaatttattttggtcttctcattttctattttctttttctctcatgtcagtggaagagattctcaatttcttttctaaggtactttcaatttcctgacttgattctgtgacatactttttctattttccactctctcttttcattactccctttcatgtgtttgttttcctcacaccagtagtagtcaaactgctgttaactatgatttctgaaaaggtacttctgcatttgatataatttcaaaagggccatggtgcttaaaaagaaattagaaaactaaatgcttatggtagtataatcatgtaacagtgtactagaaaaactactttattggccggtcacggtggctcacgcctgtaatcccagcactttgggaggccaaagtgggcagatcacttcaggtcaggagttcgagaccaggctggccaagatggcaaaaccccggtctctaccaaaaatataaaaaattagccgggtgttgtggcgtgcctgtaatctcaactcctcgagagaggctgaggcaggagaatcccttgagtagttccccacatgcatacatacaatgatcactactcaactagatactctaaggagatcctctatagatctccagcgttctctctgagtgtgtctctcctttccagtactctgcattgagaaccccggccatctgggcttccccagactcctagctctaccacttcaacttaagaagcttaagaagactgctgggtggccaggcgcggtggctcacgcctgtaatcccagcactttgggaggccgaggcgggcggatcacgaggtcaggagatcgagtccatcctggctaacacggtgaaatcctgtctctactaaaaataagtatattgaaaattatctaccaccatgtgaaatagtagttgtcattttagtcaggctgtggtacagtgcaatggcacaatttctgctcactgcaagctctgcctcctgggttcacgccattctcctgcctcagcctcccaagtagctgggactacaggtgcctgccaccacgcccggctaattttttgttatgtaaatataattgttttttcctctaggttgaagaatttaggtaatctggccaggtgtggtggctcacgcctgtaattccagcactttaggaggccaaggcgggcggatcacgaggtcaggagatcgagaccatcctggctaacacggtgaaaacccgtctgtactaaaaatacaaaaaattagccaggcgtggtggcaggcatctgtagtcgcagctactcgggaggctgaggcaggagaatagtgtgaacccaggaggcagagcttgcagtgagctaagatcatgccactgcactccagcctgggcaacagagtgagactccgcctcaaaaaaaaaaaaagtatttaggtaatctgcagaagaaggtggttcaggtctttggttgctgttctttcctagactcttcagaaaaaaatgaattaactagcaatgcttaaagaggtagtaaatacaagccaatccattttcattccagctgcatttcatgcttcagagtaatggctgttagccagaatcacttgtgaagctttatacacatatacattctgtgatcttattccctgtaaacccctattcagtagtcggtctgtgatgaaatcccaggcatcttcattcaggttaaaaaaaatatacatatgtctacatgaaattctggtattccctgttgaaaaccagtcttaagttagaggcattctgcagttgtacggaaagtaagggaaacaaagttaaaatggaaaaaattgaattaagaggcagaagtaatgaatttgatcatttgttcattgccactcattgtagacacttatttttgatctctgtaaacatcagcttatatctcaaagtatgaggtctgaatacttgcttgtgggtgatcatctttgtgtagaatagaaaagacaaagtaggaccaggtgcagtagctcacacctgtaataccggcacttcgagaggccaaggtggtagaattgcttgagcccaggaattcaagaccagcctggacaacatggtgagaccctgtctctactgaaaaaaaaaaaaaaaaaaaaaagaaaaaagaaaatattagctggacatggtggcatgagcctgtaggcccagcatacttgggacattgaagtgtgaggatcacttgagcctgggaggttgaggctgcaatgagcaatgattgtgccaccgcactccaatctggacaacagagtgagacaagaagagagagagagagagagacagatagagcgagtgtcttgttgagttcttcagtgttgggtcaaagaagggaaaaaaattgtgcgtataaatagaaaaaaagaaaactaactttttaaggctttaaaaataactgaaagtgaagaccctgagatatgaaaagtgatttttgttaatcagaaaattggtgatttaggtgataatggggtggaagttggaagataggacgtgaggggacagggtatttggattaaatataacatagaaagataacatttttagttcaggtagtaggatattctggtaatgacagaaaggaaaacaagatgggttttttttggtttttgtttgtctaatatttttgtttttcatctctaagattatggtataaaaacaggaatttatgttttagaattgtttgggtagaatcacttaaggtagatgatttgcttattcattcatttgtttatttattaagcacattattgaaatgcccattatgtgccaggcataataatatagtaagtaaaatagatggcattcctaacctcagtgttactctaattgcatagacaggaatgctggggaaagaatttatctttcagccagctattctcctgcctgggacccagctttagctagtcttggctctacaaaggaagttgtaacctaattggaacataatttcttctccgtaaaaactgagggttacaccaaatactttcaccacttctacctctaaaattcttgcttttaatgtgaattttagattaatttagattagattaatcccttaaaactacattcattacattcataccattcttgcatggccctctatatatttcttctctcctactaccttttttccctcatagctctggtgtcttgatacagttttgattggctatttatgtgctttcagtcaacctcactggactgaaagctttttgggagcagactcgggtttctgtgaacatgtgatttactgtgtgtgtacctatgcacacgaaatgaacaaatggtgacaaaattagttttttcttatttttgaaaatgctgttgatcttgtgaatttaatattagactgtctttcaagatcaacaacaaaataatatatgtaaaataatataaattgtaattctgcttgtttcttttcattgatagattattatgtatgtttacaaggacatgattagtttagaaaggaatgattattaaatatatggttatataatatggttagctgttaatagccatggaacagatctctattcagtattggttttataagcactcagcaaaattctgttttaagtatgtgttctaaattttaaaatgaatgtatgttgacatttttcattgcttacattccagaaatgagcttattttactggtaacaattaaatgtgagtttagtaagggtagaaaattggaggaaactggagtctccttttctctttagcagatgtcttagtctgtttgtcagctataacaaaatgccttaggcaaggtaatttataaacaatagaaatgtattgctgatagtctgcagtatggagtctggggagtccaggataaaggcaccaacagattatatgtctgctgagggtttgctctctgctttgaagatgatgctttcttattgtgtacccatgtggtgaaagggccaaggcagtgtccttcaatctcttttataagggcactcattccattttgggagggcagagccctcatgacttacttcctaaaaggccccacctcttaacactattacattggatgttaggttccaacatgaattttggcaggacactaacactcagactatagcaccagacaagcaagcagtcactgtaatttaagcccattagaatggaaggtccataaagacatatttttgtctgttttgttgttgatgtatccccagcctggtgtacatcaggcagtccataaatatttattgagtgaatgagtacatgaataaatgaatgagaatatttactgagctgtcgttcattttatagcaggtacaatgttgtttcttcaccactgatatattcatttattacctcttatttattagcagtgtttctgaaataatattaaaattagaagttttcttgaagcttgttttacaacttagaattattatccagtagctttccttaatatttttataacctcatcaacaaacagtgagtgtctcttgtaagtagcgtactgccgaaccttagtcagagaagacatgacatagttttggtccatgaagggttttcaacccatttggagaagtaggaaatagatacaaagatgatttgtaacaacctgaggggtgtcaaaaagatggtacatgtaggaaattaatgttatattcaagtgaaaatttgatattgtttatgtatattattcaacttttaaaaactttgcattaaagtatggaaaggaagcataagtataccattgttttaatggttatctttgatgagatcatgggcaagttgaatttttatttcttacgtgtatttttaaaagcaagcaataactctaaataaattaatctaggccaggtgcagtggttcatgcctataatcccagcactttgggagattgaggcaggaggaccacttgagcccaagaattggagaccagactggacaacaaaaggagaccctgtctctataaagcacatacacagagacacacacacacacacaccaaaaacctagctaggcatagtggcacacacctgtggtcccagctactcgggaggctgaggtaggaggatcagtttaggcccgggagcttgaggctgcagtgagctgtgatcgtgtcactgggtgacagggcgaaatcctgtctcaaaaaaaaaaaaagcaaaactgtagttctaggacagatttgatataaaaaacaaaagtaaagcaggctatttgtttagtaacatcaattgctagacctctctcctgtttatgtattcacttggaagtcccataggcatccaaattcatcatttaaaactgaattctctttccaggtttattcttaactcctatattctctatcacaggaaatggcaccactttttatcaattttcccaagccagagttctatgtgctacttggaactctcctttttttccctctcccttccccaccgtagccagtgatccaatttagttcatccatttaaacagctttaaattcgtagcctattgactatttcactgccactgccttggttcaggatttcattatttcttgcttaggctattattgtaaaaaccttcttactcatcgccatctctaggacctaatctattctctgtattcctggtaggatgatcttcctcaaatatatgtttgagtttatcatttctttgcttaaaaccctcaaaggctccctgtgtgctgagggataaaacccttactgcttagcatgatacacaagccctgtcataatctggcctcaccctgcctttagtagtttcatctcatgttactgcttgtaacttccgtgttctgagtaactgagttacctaataacctgagatgaaaatactctttttgttcaggtttgcttttatagtttctccttccttttccccagtctgtctgctaaatagccatttcaatattcaaggttgacttctggtgttacatcctctgtgctgccttctcagatcctccacagataacattaaaggttccctcttctccagttgtgtaacacttcatactttattaaagcacatactgcattattttaaacttgactcattttattatctctagactgtgaactgcttaataagggtgactttcttttgtattgtgtccctagatcagtgcaggtgctaaataaatgttgaatgaatgtttaattactgctttgtcaggttgaaggtgatagtgaagaggagctggcatagacaaaaatacttagcccctgtgactgtggcaaataagatgtcaaacaagtaattatatgaccaagagaagactcatggtatgtgttgtaaccaagattctgttgcctttttcaactaaaatatttggttttgtttgattttaaacagaaagtgtagcaaaagtgagagggagaacaaggtagattggtcttttctctcttttctttcttttcttctctttctctcttttttttttttcttttgagacaaggtcttgctctgtcacctagcctaggatgtagtggcacaatcacagctcactacagccttgacatcctgggatcaagcagtccttcagctctgcctcccaaaatgctgcgattacaggcacgagccaccacgctcggccctagattggtttttgattgccagatacctaaaaatgaagacatgaaataagtttgtttactctgatagattcatttctttgcaaattgagatcttataatatgaagctacagttacatagctgaattttttgaatccgtagtaattaataaattcctaatgaaatgtatgcctgaatgcactttttggaacaatcttgaacctacaaaagagttgtgaatatagtgcaaataatttattgctttttttctgaatcatttgagaataagttgctgacatgtttcctcattgcctcccaatactttggtatttccaacaaataagaatattcccttatgtaaccacaatatagctatcaaaataaaaattaacatcaatacatttttttcaccttgtccttagatcctatttgggttttgcaaattgtcccagtaatttcctgtatagcaaaaggatccagtttagaattatatgtccatttagttgtcatatctctttagtttctttgaatctgaaatcattccttggtgtttcctggacttttatggttttctttttcctttttttttttttttttgagacagaatcttgctctgttacccaggctggagtacagtggtacgatcttggctcactgcagcctcctcctcctgggttcaagcaattcttgtgcctcagcctcctgagcagctagggctataggcacccaccaccactcccagctaaatttttttttttttttttgagatggagtctcactgttgctcaggctggagtgcagtggcgcgacctcggctcactgcaacctcctcctcctgggttcaagagattcttctgcctcagcctcccaagtagctgggattacaggcacgtgccaccatgcctggctaatttttgtattttactagagacgacgttttgccatgttggccaggctgctctcgaacttgtgacctcaggtgatctgcctgccttggccttccaaagtgctggaattacaggcatgagccaccgcacccaacccatgctgtcttttgtgtccttttgatatgcccccgtaattctttgagtactttcttacctttagcaaaacaagacattccaggttcatcttgtattttgcctgtcccagccctgatactatttctctgaaaagccctggttacttttggggtgctgcttctcctaggacctttcagaggacagaagctagggaatatatgtatatttatatgtctgtacacacacacacaggtatatatacacatttatacctatatttttctatctgtacatattgactgatgagttcacatcagtacctcccgttgcaatgcaataccgtagggttccttcttcttttctctctctgtttgtaactcactgtttgacaaacttgatttcctttcatcttattgagaaacttgatttcctttcatcttactatgtttacttatttgatcaatctcctgttgtaaccaatctcccattgctactgcctcctgctttctgacacattaataccctaattacccaacttggcctctcatagcttgcctcctacatggatgctcttgacacctggggctgtcctcctgctctcctgtgaataccctccagtctacttggtttcttactccccactttgggcagccctactaggtagatagcctcctatcttgctcatcctgctaggattttgaatcctacctaaaactgccctttgcttctgctccctcaaccccgatagatgtcttccctaccccatttgaactccaacaccccatgccaggctgcctatctacggaaatgccctctttagtcagtcttctactttcccaccgtaggcaacccttctacacagatgccctccttattcagctcaggctccaaggcctcacatgccctcctcaccctgcttggattgtaactccccgtgctgggctccccctctcttgcccagtgaacacactatttatacctgccgggtaacctctgataaccaaccttaggcaatccttctatgtggacatcctcattactacttaggttatgataccctctgttggttgccccttgcatggataccctcctcacccttctctggctctggcattttatcctgggctctccctgctcactccacagagatccttctcattctattcatgcttttactccttgggctaggctgtccatccatatggagatttgcgttctgtttgggttcccacctcccaccctaggcagaccccctgtgcatcagccttctttcttgcgtggatgctgtcctcatcccacctcttgggcactaacatcccaacctgagccatcctcccctgcacagatattcatatattcttcaccctgcttaggctctgacaccacacactaggctgtcctatatagatactttcttcatgttgctcagactctgcatctagaatatctcttgcccctctcatccactcatttatgtcctcctcaccctgcttaagctctgaaatcccttcccaggcctccccctattctctataggtatccttccccctcccctctaggcttctgataccctcctttgagccctcttattcctcttggactccatctgagtccaaagttcttttttttttttttttttctttgagatggagtctggctctgtcacccaggctggagtaagtggcgcgatctcggctcactgcaagctccgcctcccgggttcacgccattctcctgcctcagcctcccgagtagctgggacaacaggcgcccaccatcacgcccggctaatttttctatttttagtagagatggagtttcaccgtgttagccaggatggtctcgatctcctgaccttgtgatccgcccgcctcggcctcccaaagtgctgggattacaggcgtgagccaccgtgcccagcctcaaagttcttaaagctctattgaaaaggtactcttgtaagatatctaaaaattataaataaaccataaatgttttactcagtggtgtatggattcttgataactagagagttttgttccttctaggatagactcaagaaatttcttcagaaaataacaaagaaatttaaaatataatcagaatagttaggtgactggtatattccattctgtctttcatgctaagaggttatttagagaacaattttcttttctttttttttttttgagacagggccttgctctgtcacccaggctggaacgcagtggcacaatcatggctcactgcagccttgacctcctgggctcaagcagtcctcctacctcagcctcccgagtagctggaactacaggcttgcaccacctcacctggctaatttttgtatttttttgtaaagacagggtcttgctgtgttgcctaggctggtctcaaaactcctgggctaaagtgatcctcccaacttggcctcccaaatgcctggattacaggcatgagccactttgcctggctgaacataattttaaagtttttgagtgaaaaataatacctagtagaaaaaagatatgttatactatattaaattgtctgtggaaggccgggcacggtggctcatgcctataatcccagcactttgggaggccaaggtgggcggatcacctgaggtcgggagttcgagaccactctgaccaacacatggagaaaacctgtctctactaaaaatacaaaattagctgggcgtggtggcgaatgcctgtaatcccagctatttgggaggctgaggcaagagaattgcttggaccggggaggtggaggttgcggtgagctgagatcgtgccattgcactccagcctgggcaacaacagcgaaactccatctcaaaaaaaaaaaaaaaaactctgtagaactcaagttagttttcttcttccccaaattgatataatttatactgctgtatattatttaaaattactttaaaacactagattgttttaggaaaacagtaattaaatacagcctggcagaagtgctatgaataagtaaatatgtggcagcagactagtaaattggcttaaacttagaaattgagaaaaatttgttaagacagagcattacctaccagttattcttggactgcatactcttttagaaactgaatatccagtggacctgcagccagtacattttttccagtagagatgccaagtatgatgactgtcaagcttgaagtgtttttaacaaaatgaatgctgtctctcttcaatgcagaacgatgttggcacattgtagatgccaggcattttgttttagaatatttaatgtgaaattataaccttggaatttaccagctgattgagatagttaatggagaggtggaagagtaaggcatttcattcccaaaccattttctgaaggttttttctaactctttcagattccaagagtagcttcacatttagaggttttttttaaagtaaaatctaatatttaaaaaaagattaaaatgtttagaaatggatttttcaggattataatgtttgcatttcatatcagagagcattcattgtttgagtaactaatatctgttgtgagcattagtttacttcttgttagatttttaaagcattcccaacacaaaggaacattcttttttaccacagatatttatttctctttagctgcttacttgacaacgaaacagaaacatcttatttacggagcttttttccccgtttttattatccacctctgtatagatgcaagtccatagtattagttgtacaactttattttactatttgaaagtaaataagacagtcttgagaaaagtcataaagtagatgggctctctctgactattttgatttttactctctgacccgaaagcagttgaacaccaaatgccagctcttaggtcaacaagggtgaggtagggaggtagggatgaaaattctaagaaagaataagaacttagacttcttttcaagagatcaacttatttaagccttgtagcatctctgtgaggctgtgctctatccgtgtatagccctaattttgttgtatatattttatttgattatatacttcagtaaaaagaacacctgtgaacccattgtgtagctcagcttatttctactcctcctgtctcccatcaaaggaagccgctgtcctaaactttatcatctttctcttatcacatgtgtttttctttttttactataatacagatatcacattctttattgataaaacctacctcataggattgattgttttgaggttaaatgagaaaaatacatatactgagcctggccctgcaaagtgctcaaaaaatagtagctgtaattatgttattaatgttgttattttgctgagtgagtacagcatgaaaagcatgtcttttcccagctgtttcctgtggcttatctccctgcactcttgaggtcttttcatctcttcctggaatgaccagtaacagtaaagcagtagagaaggggatttgggtgatcagctgtttggacatagagtgcccaactgagaagaaacaaacaaataaaaaattaagttgccctattaaattaccaatttttttcttctctctcactgtcctgtgcctcagaataggatttctgcctactttaaatttgacccactgtagtgaaattcttccaccctcttgtagacagtgttgaataataaaggattgaattaacccagaaataatcagtgacataaatggatctattatagtttacagaatgactaaacaagccaaccagtcagtgcatttttacattgttttcctttccacccaacattgggaagcattaatttattttcaatatctgaaaatgttgatttcattcttctatttcctttttccagttgccctgggctctatgagaatgcaccagcatgggacagattcttgatcttctgaacttgcttccctttctgcctatctacttttcttatacacatattaataatttatgttaatggagttattatatcgcacttgccctaattctactacatggatacttaagcagtgcacttaccgtggcattttggtcaactaaaatttttaatgaaatttaggtgagttgattacacattatcgcacaaattattagcagcattaatagaaaaaatatatcagaaaataatcaggtcaggcatggtggctcacgcctgtaattctagcactttggaaggccaaggcaggaggcttgcttgagcccaggagttcaggaccagcctggccaacatagcaagaccgcgtctctacaaaaaaattgaaaaggtaactgagcatgtctgagaaaaaataaataaaaagaaaataatcaccctagtcttggccgactgaagaaagagttccttagaacacaaaagtaaaatcacttctagattaaaaaagagagagagagagaaatagagtgagtacatgtaagtttattgcacaagagcagattttaccagctcttacattaatccttgttaagtttcatctccttcctttgggcagatattccagtctttcatgatctgtgatgaattatgacataagatttaatcccttttaagcctatgtcatttgaaaagtcatatctttgttcaagttgtgatataaccaccttcttccagattgaacctatacattttttgggtactgttgtttagaagtcatctattttattaagtctatatttcttcttcttgtttacaataacttataaagatttttatcacatattttactgaatttaggataactgcctgcagcattttcctgatcctctagtagaagagccttaaaagacaaattagtttgcagcttggccttctttatatatagaagctatgtgaagagagatggttttgtccatgaagtttattagagcactgttagataccctgcttgttcttgtctaattctttcttgtgcttcttctattactctcttcctttaaaaaaaaaaaaacagctttattgatatataatttacatactataaaggttacccatttagagggtacaattcagtggttattaatgtaaatacagagttgtgtaaccattgccatttttatcactccaaaaagaaaccttatctaatacccatatcccttctctctcactttctctcactctcttttctctctcatctaagtgattttgcttttgttttctaaggaagtctttcctcagaagctgcctttccattagggatttcccattctgtttcttcgtatcttgtgtttataaacctggaatttcattattctcttatatttctgaactgatttaaaagataacataagaaaaatagatactgtggcataacatgaagtagccggcacttatttaggactgtcattttcatagatttaaagtacatatgggccaggtgcagctcatgtctgtaatccaggcactttgggaggctgagacaggaggatcacttgagtccaagagtctgagaccagcctgggcaacagagggagactctgtctctacaaaaagtttttttaaaaaaattagccagtgtacatttgtggtcccagccactcgggaggctgcagcaggaggatctcttgagctcaggagttggaggctgcagtgaactttgattgtgtctgtatactccaacctggatgacacagtgagaccctgactcaaataaaataaaataaaataaaataaataaagtgcatatgctcttattcaggatttctttcattggctagtggagactgtaaaagcatttaatttagattgaatttagggttgaatagcagtattaatagcataatttatattcctttaatctttcggtatcccatgggaagcagatttaggagaaaggccagtggctgtgttcagattgtatggttatagtttagagggaatatctttggggtactggggtaaaagaagagtttaaatgatgatttaagtcttagagaagttatttaaagtagcagaaccaaaccagttatgtctgaaataaaatcctgtgctggtaatgactatatgaactgtagcttcccttggataggcatgataaacttctggcaggctgacttcttttatttccaaacacttgagtcagttaatcagaaaacatctttggtgaaggaatccatgcttcctataccttccacttgaccttgcattttacttgtttgttttgaggggcagactttggagaggggtggaatataacaagttctgcatttaatttctttccatgtactttttagtaacattactatcatacctctagtggagaggtatgatacctcaactttatacccttctttgggaaagttagagtgtttcagtccacaaagttttgctttgatttgattaatttattttaataattggagaaatggagataaaatcctgattagtaacatgctattagtgattgggctattactaggataaatttttttccatcacataaatcataaatgcatttgggtagatctttttctctttttatcgaatctgtttctttcaaatttcctttttgtttgggaaaaaaaaaaaaagaaaaaaatagactcgaggctgggtgtggtggctcacgcctgtaatcccagcactttgggaggccgaggtgggtggatcacctgaggctgggagttcaagaccagcctgaccaacatggagaaaccccgtctctattaaaaatacaaaattagccaggcatagtggtgtatgcctataatctcagcaacttgggaggctgaggcaggagaatcacttggacctgtgaggcggaggttgtggtgagccaagattgcaccattgcactccagcctgggcaacaagagagaaactacatctcaaagaaaaaaaatggacttgagtgtgtttctctcttatgtctaaggaactcttattttcaacctggaatgagaaagataattgtattacaatgaatatttggtgataatggcatttctgttttaattaggttctccctatctctactccctccatattgtttgaaagatggaagtaatttgctaaaggctttttttttttttttaacagtcttgctttgttggccaggctgaagtgcagtggcacgatctcgactcactgcaacctccgtctcctgggttcaagcagttttcctgcctcagccttccaagtagctgggattacaggtgtgtgtcaccacacccagctaattattattattattattgttatttttttttgagatggagtttcactcttattgcccaggctggagtgcaatggtgtgatcttggctcactgcagcctccgcctcccaggtttaagcggttctcctgcctcagcctcccaagtagctgtgattacaggcatgcaccaccatgtccggctaattttgtatttttagtagagacagggtttctccatgttggtcaggctggtctcgaactccctacctcaggtaatctgcccgcctcggcctcccaaggtgctgggattacaggcatgagccaccacacctggcctcaagtctttttttttcttttttttgcccaaacaaaaaggaaatttgaaaaaaaaaaaaaaaagaaacagattcaataaaaagagaagaagatctaccgaaatgcatttatgatttatgtgatggaaaaaaacagggtctcaccatgttggccaggctagtctcgaactcttgacctcaggtgatccacccgcctcggcttcccaaagtgctgggattacaggcatgaaccaccgtgaccggccgtctacttaaggcttttaacaacattttaacaaactgaaaatgtttagtcagggcatattatattctgacagatgctgaatttgccacatgatttgaagatgaacatttcaagcattaggtaacaacatttttccttctttcttttatttctttcattctttttttgtttttgagatggagtttcactattattgcccaggctggagtgcaatggcgtgatctcggctcactgcaacctccgcctcctaggctgaagtgattctcctgcctcggcctcccgagtagctgggattacaggtgaccaccaccacgcctggctaactttttgtatttttagtagagacagggtttcaccattttggccaggctggtctcgaactcctgacctcaagtgatcctcccgcctcggcctcccagtgttgggattacaggtgtgagccaccgcgcctggcccaggtaacagcatttttcaaaagaaacttttaagtttattctttactgtgaatgaagatcgtttaagagtacaacttctaattttagctttctttcatgaccttcctccttatccctatccacatcaaagttaggatatatactttagtgattaactaggaagctcaaagtatttatgaatccagtaagcagttaactagaaatattgtctcttaccatggataaaatgtcttatggtgctacctttgtattttaaagtactcaggcagataattaataatcttcttcaatttttggaattttggatttcttggcatactaggcaagtcccttaaatttcatgcctcagttattttgaaaataagtatacgcgatatgcctctaattgttcttttttttaaaaaaaaaaaaaaagaaggagtttcgctcttgttgcccaggctggagtgcaatggcgcgatcttggctcactgcagcctccatctcctgggttcaagtgattctcctgcttcagccttctgagtagctgggattacaggtgcccgtcaccatgcccagctaattttttgtattttttagtagagatggggtttcactatgttggccaggctggtctcgaactcctgacttcaggtgatccacccccttcagtctcccggagtgctggaatttacaggcatgaccattgtgcctagctctaattggttttttgaagttccttctaacatggattctactacctttagaggatattttgggaattatttctgttaaaaacctatacaataaaggatattttaaaaagttaaaatatattttaatatatataattttatgggcaattatagtattacaaaatatttttaaaagatacagggttctttaatttggaatacaaaagtaatcgtaatctaatataggtatttatgcattatgcagtctgatttaagagtttcctttacctttgcctttccagggttggagatgcctcagagagtaagaagtatttgcttgagccataacattccttttttttttttaagcttcaatccacaaagtttttctttgattagattgatttattttaataattgggaaaaatgaattatgatagtgttgaattaaaatattttctcaagggtgttgggtaaaagagcaggactatactaattgactggagaagccaatttaaagctgatccacagtagtatatgccatttcatatgtaaagggtaagttttacttatactattgcaaaggaagatactggaccatcttgggttatttggcatttcttccattctgtctagttttatccaattttcaatgttaataactttttctagagactatcttgaacataaggaataaagccaagaagaaaacagggacagaactaatgggaaattcatttttcagttcaataagattatataataaaataaaaaataaaaaaattttttttttttttttgaaacagggtctcacccaggctggagtgcagtggcatgatcatggctcactgtagccttgacctcaagcagtttacccacctgagcctcccaaatagttgggactgtaggtgtgcatcaccacgcctggctgattaaaaaaaaaaaaaaaaccttttgtagagatgggggtcactgtgttgcccaaactcgtctttaattcctggcctcaagcaatcctctcaccttggcttcccaaagtcatggattacaggtgtgagccactgtgctcagctgctaatagctctttacattaattttgtgggattgtttgtgaataatacagttctcctcatgagagaaaagacatactcattttgtgcatattagattgttgactgaatctcttttaaaaattgttttctcctctctttcccctccccacagaatctgtctatgatcttctcccaaaggagttacagttacctccatctagagaaacatctgtagcatcaatgagtcagacaagcggtggtgaggcaggctcgcctcctccagctgttgttgctgctggtatgcatttcattttactttattaaagaaaactagggccaatataaatctggccaacatgaacagtgctggcaaaattcatactaaaaagagtgtgatttgagggttttaaaaagaggcattaaaatatgtacttttaaccttaaactttttcaatattattttcttaatgtaattcttatttcttaaaattttacattgtctcatctataaatgccatttcctaaaatggaccttgtcttcaaatatgggaaccagcttaaagttgtttggttgactgtgcttaaaaaggttaaataccaagctgtgaatagaaaattatatttgagtttctgtttaataattaattttaaagacttgcaccaagggaaaatattttatatgatctgaaaaatgactgaagcactcaagtgtcttttatattcatagcatgttactgaaacctttttattatatttaaaaatatatgtgacttcgtagttttcaatttattgaaagtaatggaggacgtcaatataatatttatataaagacattttcttatattgatgaaaaggtatagaaagtaatgtttgaaatttattagacttatttttactcagctctcaaatcatacacttaatgatatacaattggctcaaatttttattttacataaaaataaaagatagacaagctaatagaaaaaagtgttatcagtgacaaattagtatcagtccttcctgtaatgttagtttacccacctaatattggatttatagactgctaagtgtgtttgttttaaaaaaaggaaacatatatatatatatatatatatatatatatatatatatatatatatatatatatatatattttgaagttttatctgtcctaattagaggtttcttgcctaatatgacacctctcatctttaaaaatgatatttaaagtttatcagagcattgttttcagtaaattattttagtttcaaaatgagaacagtaaagtgtaaggttgtggtttaaatgaggatattggtactatagtataacttcagatatatttctcatatgcattaacctatgtaccattaaccttatgtaccaatctttctcaggctgcatagtgcattgctgaagccttcctggttgaaggcaggaaaactttaaatatggcaaagaaactgatcagccctgttcactgttcatgtgttgccagacactttctaacagtttctgtggatttaattgtgaattagtgaactttttagtaatcaaattgataagatgacctggtttgctttatatccactgggttctaaaatggctctgatgatatttttctggaattttaagttttaaatctggttttaaaattgcatccaataataaaatatgacaaagataaaatattttttatgagatacttcactttaaatccacaagtagaaattgactaactgatttcttttgtatcttttgagattgttttttaaagatacgttgaatctatatagaactaaaagtctgtttcttctgtgctttttaacatctgttgacggtagatccagttccttttaaaagctgaaaaaattgttaggtttagaaaaagaacagttcttccttttagataataccaaattgaattttagaaattcttatatatataaaaatatattaaaagttcttgaatttgggtccctaatgaaatattaaccttctccccaccacagtatatttaagaaaaatctctcaagataaattacattgaaagctgtgagttgaaaaatcatgaaaataagaaatctaattaaaagaagtattttgaagtaatgcattcttattatcttgaaattattgacattgtaaagatggcaaagagagtaagaaggtaaactttctagttttgttatagtcacacacagaaagtttatatgatcattaacaagtcatttaaaatctttttcaaaatataaatttagcaaccaatgtagattattctaggattctaatagcttagaaagagcacttcataccttaccattataaacaagagagtttaaatcacagaataattattttaaggaaatcagtatatatcattagaattatatttttatttgacatactaatattcttggtgatataactgtcagagttacttggagtatattaccaagttactcaatgtttttctagccagaaggctagatagatgtctagggaaaggcatattaatttagacttgtatgggtttttaaaaaatctttagcatttttgaaaaaatatgggccaggcatggtggctcacaccagcactttgagaggcccaggccggcagatcacctgaggtcaggagttcaagaccagcctgatcaacatggtgaaactgcgtctctactaaaaatataaaaaatcagccgggcgtggtggcgggcgcctgtaatcccagctactctggaggctgaggcaggagaattgcttgaacccgagaggcggaggctgcagtgaaccaagatcgtgccattgcactccagcctggtcaacaagagtgaaactccgtctcaaaaagaaaaaagaaaaaatatgaaatgtgtaaaaatattgactcttgatatagttaattcttcagagttttgaaggagccggattggctgctctcaggtatgagggcctggtgggaacagacttctagttctgccataaaggtttgtgtttgacaagttttaaattaatttaaattttaaaatttaaagactgggcatatgagtgttcatggacatttttttgttgtttaattttttaaaatgtgtttctcagattcaccaatttagatttttttcctcttcctgttactaagggaataagtaaatatgatgctgctaatccacaatccagaatattgggtaaaagagcgtctatcaagcctttatctgcttctacacaattcatacttttatgcactcccatcaataatatattttagtcctctaatcccagggtcaaggtgtcggggaaaggggcttatttagacacaatttctcccctcttcatggggccaagtgtcagaatctgggaggtggagttcagagtcaccaattttgttaccccatttttttttttaagagacatgttctagctctgtcatctaggctggagtgcgaggtgcgatcatagctcactgcaaccttcaactactgggctcaagtgatcctcccacctcatctgggaaataagtgcacactaccacactgggctaattttttttttttttttttttttttaagagacagggtctgtcacccaggctgaatgcactggtgtgaccttgactcactgcagcctaaaccccctgggctcaagtgatcctcccatttcagtctcctgagtagctgggaaccacaggcatatgccaccacatggacctgggtaatttttttttttttttaaacagagtctcactctgtcgcccaggctggagtgcagcagtgtgatctcagctcactgcaacctccacctcccaggttcaagcagttctcctgcctcagcctcccgagtagctgggattgcaggtgcacgccaccatgcccagcaaatttttgtatttttagtagagacggggtttcattgtgttggccaggctgatctcaaactcctgacctcaggtgatggacctggctgatttttgtgttttttgtagagacagggtcttactatgctgcttctccagggatggtctcgaacgaactcctgggctcaggtgatcctcgaggcttggcctcctaaagtgctgggattacaggtgtgaaccactatgctcggccctggattgtttttttaattttttgtagagttgtcttgctgtgttgcccaggctggtctcaaacccctggcctcaagcagttctcctaccttggactcccaaagcactggaattccaggtgtaagccaccacactgggccctcctcctcatttttaagaattctgtttttgtcccagtggaaagatagttaagccttagatgttcaatatatcaatgaatgaaagctttaaaaatataaactttctgaaccattttgtaagttctcagtaattaaaagagaggccacgttcctaaaacataaaagttatccaaatgaattgatgacactttttggcaaaataaggagtttattaagaagaagtacaaatcatgaaaagattcttttgtttattttttggataatcctatagtatagttatacagaattaaaacataggtattaggagaactaaatgagttatatcagaatttggggcttttgaaaagatgtatggcaggtttggggttttttaaaataacagctttattgagacataattcacctgctgtataatcaaatatttttaatctatgtgcttacagttttaatcattaaatttacttaatttatttaaaatagaaagtcatggactttagtcttcattttaagaaatcaagttactttcttgttctattctacacttgttttgtttggcttcatttgggaatataacattgtgtttattagtttatttcaaaatatatttttctaagtggactgtttgaagtttctttaaaatttttaattcaaattcttgaactaaacaatgaattaaactaggccgggtacactggctcacgcctgtaatcccagcactttgggaggccgaggtgggtggatcatgaggtcaggagttcaagaccagcctggccaagatggtgaaaccccgtctctactaaaaatacaaaaattagctgggcatggtggcaggctcctgtaatcccagctacttgggaggctgaagcaggagaattgcttgaactcgggtggcagaggttgcagtgagccaagatcacgccactgcactccagcctgggcgatagagtgagactccatctcaaagaaacaaaacaaaacaaaacaaaaatgaattaaactataggttttataattcagccagagaatcttaataatgcattaataattctttttttgcatagcttcataatattcatattttggtttcagtaattatatattaatactctttttagaagtaacagtacactaatacttcatagcaattgtgcttttgtttttgtttttgttttttgagatggagtcttgctcttttgccaggctggagtgcagtggcgtgatcttggctcactgcaacctccacctcccgggttccagcgattctcctgcctcagcctcccgagtaactgggactacaggtgtgtgccaccacacccggctaacttcatagcagtttttaacatgtataaagataatacacagtcataaagtgtgtacagtggaaatcttggttgaatatctccacttgttggaccactgtcggtttttaagttcataacttgatgtgaagtgatccatataataaatttttcttttggaagagctttgatatatagtgctttgagttctatgccatgtcacttaataaatctcaagtatgtaacaagtattttctacaaaatttcattgagtgctatttatactataagagagggcactagagatgcaaattaatgtcctataatcaaataagtgctatattctaattcatttcatatctcctaatcacctgaattaaaatcacagaaatttctaaaccatctataataatacactgtacaaaaactgaggtgaagaaaatatgttactcctcctgtaggagacagcttttaaaaaatgaaaatatattatcacttttaagttcctactatgtgacaagaattgtgttaggtaatttgcatgtcatcatatcacaatccttctagccataaagtatctctcttttttcttttacctagttcttactccttgtcattgtgcttgagggaatttggcattgtgtgctatcacttcgattagggaaacgcaagatccttaactaggcaatgtatagaatattgagttgaaaagccatacctcttctctacaagtgtcaggatcttcgaatgggaatttgatttctataataataatttaataaaagtgatttctagcaacaaaattttttatcccattgaatttattataacttaatttacttacgttagaaagtatttacagttatataatgaggattttcttgagttgactaaatttgaggaagaaatttgcctttgattgctttcctgggttaacatatttcagaatttttgccacctaatgtagtatactcttcatgaaattaaaccagaaacccactaacgagaaagataattcacctacagatgctgtgagctaaaatgttgtgagttgatcttggttattctttatggccattcccttttttccaagaaaactagaccatttctagaaggaagtcagatcctagttacaaacatgttgcaagcagatttaaaaatctctactcctccttctatcttattatactgaaattacatagtaaatttaaatacatacacttatacatatggatggtatgtatgtatggatttatgctgaagtctgcattattagagagcaaacttgggcctatagccattaattcagaaacaactgctaattgtttgacagttacaaattgacattgccaaaaagcaaacttggcctattattgctttgttcctttaatatttctctttttattgtcctcttaataacacttttataaatattgtgatttattcagtttctaataaataagcatatttttatattacttgagtcaacagaacagcattttgaaactgttcacagattctcattcataagctaaatacttatagaaaatagatacagttactgattttatgcattctgtacaattttgcctaagaaattaatgcatagaagtggacttttttatatcaccaacaagattgaaaatataagcaaaaagtgtttataactaattgttttataagaaaggaacttcacctgtttctggatattttttcctctggaattcagccataaaaaagaatgtaatcttgtcatttatggcaatgtggatggaactggaggacattaagtgaaataagccaggaacagaaagttaaacactgcatgttctcactcatatgtgaaagctaaaaaatgttggtctcatagaagtaaaaagtaagacagaggatagataatagaggctgggaagggtaggaggaaggaagggatagggagaaatttgttgaaggatacaaaatttcagctagatagaagaaataagttctagtgttctataccactgtaggatgactgtagttaacaatactatatagtttcaaatagctggaaggaagatactgaacattcctaacacaaagaaatgataaatatttagataatggatatgttaattaccttgatttgatttctgtacattatatgtatcagaacattatctaccccatgaatatgtatgattattatttgttaattaaaaaaataaaattaaaaaaatcatacatgggccaggcatagtggctcatgtttgtaatcccagcactttggggggccgaggcgggcagatcacttgaggtcaggagtttgagagcagcctagccatcatggtgaaaccccatctctactaaaaatacaaaaattagctgggtgtggcggcgggtgcctgtaatccccagctcttcaggaggctgaggcaggagaatcactcgaacctgggaggcagaggttacagtgagccgagatcatgccactgcactccagcctggcgatagtgagattccgactcacaaaaaaaaaaaaaaaaaaaaaatcatacatagtaaaatggtagcattttttgaatatgagtggaagctacatgagtgttttaaatatttcataattttaaaatcactgggtgcaaatgactatatgaataaaagtgtccaataaactgtactcttaaaaactaacaaatatatgggatatattagatacttgatggatttatatttggcataagtaaggttatattcacttttcatccatcattgcatatatgtatcaagtatgtgtgtactggcagtatttatttagcccactcaggtagaatttattcttcccatataattacagggtattatcatcaactaaattaaatcagaaaatgaatgagaaagcacctcaaagtaccaggtctatacagccattctctagatcaaacttacttacaaacacacacacaacatgtacatagttttatttatttgtttatttttctcacagatgagattaacatgggctttggagtcataaagactgaatttgaatctaattgctatcatatcatatctcctatatagatggactcttgggaaagttaaataaatttctaataatattacccttgtagttagacaataataccaacttcttcttaaggttcttatgaagataaatttgtaaaatagccgaacattttctgacaagtagtaattattgaataaacattgacctccttccccatgtgtttctaacctcctttgttagtaaagtttttttttttttttttttttttgtcatccaggctggagtgcaatggtgcgatctcagctcactgaaacctccacctcctgggttcaagcgattctcctgcctcagcctcccaagtagctgggattacaggcacctgtcaccatgcctggctaattcttgtatttttagtagagacagggtttcaccacgttggccaggctggtcttgaactccggacctcaggtgatccgcccacctcagcctcccaaagtgctggtattacaggcgtgagccaccatgcctggccattagtaaggtgttaaaaaataggttctctttgtaaaaattagttttgaactttatttttactttttttctttgcattctcacccagtctatttttggtcttattttgaagtttcgcacaccagtcaagatgtatatatatgtgggccatgggatatactttctgactttgttattctgtcatgttgacactctctcagtgggaatctgcattggtctgttttcacactgctgataaagacatacccgagactagaaagaaaaaaaggtttaattggacttacagttccacatggctagggaggcctcagaatcatggcaggaggcaaaaggcacttcttacatggcagcagcaagagaaaatgaggaagaagcaaaagcagaaacccctgataaacccatcagatctcctgagacatattaactatcacaagaatagcacgggaaagaccagcccccatgattcacaacacatgggaattctgggagatacaattcaagttgagatttgggtggggacacagccaaaccacatcattctgcccctggcccctccaaatctcatgtcctcacatttcaaacccagtcatgccttcccaacagtcccccaaactcattaactcatttcagcattaacccaaaagtctaccagtccaaagtctcatctgagacaaggcaagctccttttgcctatgagcctgtaaaataaaaagcaagctgattacttcctagatacaatgagagtacaggtattgggtaaatacagctgttccaaatgggagaaattggccaaaacaaaggggttacagggcccatgcaagtccgaaatccagtgggacagtcaaattttaaagctccaaaatgatctcctttgaatccaggtctcataaccaggtcacgctgatgcaagaggtgggttcccatggtcttgggcagctctgcacctgtggctttgtagagtatagcctcccttccagctgctttcatgggctggcattgagtggctgcagcttttctaggtgcatgatgcaggttgtcagtggatctaccattctggggtctggaagacattggccctctcctcacagctccattacatagtacccagtacggactctgtgtggggtctccaaccccacattttccatctgctttgccctagcagaggttctccgtgagggccccacccctgcagaaaacttgccagggcatccaggggtttccatacatcctctgaaatctaggcggaggttcccaaatctcaattcttgacttctgtgcacccacaggctcaacactacatggaagctgccaaggtttggggcttccaccctctgatgccacagcttgagctgtgtacattggcccctttcagctatggctggagcatctgggacacagggcaccaagtccctaggccacacacagcatggggaccctgggcccagcacacaaaaccgctttttcctcctgggcctctgggcctatgatgggaggggctgccacaaaggtctctgacatggcctggagacattttcctcatggtcttggggattattaacattaggcttcttgctacttatgcagttttctgcagccagcttgaatttctccctagaaaatgggtttttcttttctgtcgcatagtcaggctgcacattttccatacttgtatgctttgcttcccttataaaactgaatgcctttaacagaacccaagtcacctaatgaatactttgctgcttagaaatatcttccactagataccctaaatcatccctctcaagttcaaagttccacagatctctagggcaggggtaaaatgccggtctctttgctaaaacataacaagagtcacctttactccagtttccaacaagttctttatctccatcagagacctggaccttattgtccatatcgctatcagcattttgggcaaagccactcaacaagtctctaggaagttccacactttcccacattttcctgtcttcttctgagccctccaaactgttccaaactctgcctgttacccagttccaaagtcacttctacattttctggtattttttcagcaacaccccactcctggtaccagtttactgtgttagtccattttcatgctgctgataaagacataccccagattgggaagaaaaaatgttcatttggacttacagttccacatggctggggaggcctcagaatcatggtgggaggcaaaaggcacttcttacatggtggcagcaagagaaaatgaggaagaagcaaaagtggaaacccctgataaactcatcagatcttgtgagacttattatctgtcagaagaatagcacaggaaagaccagccgccatgactcaaataccacctcctgggtccatcctgtgacacatggaattctgggagataaaattcaagttgagatttgggtggggatacatagctaaaccatatcagaacctttgtatataaaaggaacattgatagaggatgatgaaatcataggaaagaccgacagtttctgaaggactaattctataaagtctgctgtttaagagttcttaatagtatttttttaatgaagtgatttaagttgcatggttaatgatcaaaacttctggtagaggctgggcacggtggctcacgcctgtaatcccagcattttgggaggctgaggctggcggatcacaaggtcaagagtttgaggctagtctggccaacatgatgaaaccctggctctactaaaaatacaaaaattatctgggcatggtggcaggcacctataattccagctactctggagtctgaggcaggataatcgtttgaacccgggaggcggaggttgcagcgagccgagatcacgccattgcactccagcctgggcgacagagtgagactgtgtctcaaaaacaaacaaacaagcaacaacaaaaacaaaaaacaaaaaaacttctggtagagcaatttatgacttctggttttttgtctaggcagtttattttgtctacgattggatctaacgtacactttactccagacccaggtctaaaacctgattgattaaatcagaagtttttaatgatgctgtaaatgattttttattattgtttaatcatatcttaaaaaaaacaaacgtagggctgggcacggtggctcacgcctgtaatcccagcactttggaaggttgtggtgcgtggatcacctgaggtcaggagttcaagaccagcctggccaacatggtgaaaccccatctctactaaaaaatacaaaaaattagccagaggtggtggtgggcgcctgtaatcccagcgactcgggaggctgaggcaggagaatcacttgaacccaggaggcagagattgcagtaagctgagattgcaccactgcactccagtttgggcaacagagagagactcggtctcaaaaaaaaaaaaaaaaaaagtaaaaacattgaagtagaattggcaggaatgcctttattttttaatctaaaatatttaaaatgtattgtagcgtattgaagtgtccttcagataatatcccttggaactttttttttctctaattttgaagtttagtgatactctgtttttatcttaaagtgacattatctttcagtagttcagtgtttgtctctgtctctctctctttttagcctatacttcctggtatatttggcagtgtaataaatgtagctgtcagctagtataattattcccttttgtgtttaaattattggagatagaagattacatctggatattagtctcttcattcagtattgacaagtgatggtatccagtggtacttaaatcattggatgatggaaaacatctttttcttccattaggaaagaattttacatggacttaaaaatcaaagtatttaatgtgtatatctagtacatgttttatacactgtgcttagatcctttgggttgaatttttgtttgaatagaaaaaaattttgtttggatagaacaaaaaatacatttaaaacattgctctaagtttcaggataagcattttatttttcagggagcactctttagtaaatattatatgagtgtattaatggtactctgataaggtagaaataattatttaaggagaattcagattaaaaactggagagtaattgttttataacattagaaccctgaatggcaatttgatgaactggagaagaaaaagatgtctgcaataaatcagaaacaaacccttcagcttcagcagtagtgctcattattttttttaaaaaaatagagcctctaggatcaaacatattatacaaagtagcatgtatcattaaaagtataaattggtatcctttttaaggggagtataaagaagtatgtaggagtcagtgtggtctgaaaaatggaaaggttattttgctgctaaaatataggtttttttacagtgtaagtgcattgctcagaacatatcttcttccacgcttcaaaagagtttgggtaagggaacagcctgaaaaacacctgaaagagagaattctggcttatggattagagagcatctataaacagaacaaattggtgaataagagttcacaaaaattttgtctaagaaatttccccacatgcattcagaggttaataattaaattttttgaagttcattttaaaacattgcttattttaacatgtaaacgtatgttgggtgggaaaagtacaaatgggagattgaaactgttttaatcatgtaaatgatcagccctacaatttttgtttttttaataatctggaatgcttattttatatgctgggatgctagttgttttttctattaatacacttaacttgcattctagcttcgccattcagagacaggcatcgtgtggtgggttgtgtgacagtgtctgtcaatagtgaagacaaatagtgccagagacacttaacccatccaatctcacccagggtataggtcggtctcgttttcagacttcttcataagtccttctttctttctctcttcctttcttactttttgtttgtttgtttctaaatagtggattgatactgattgaaactaaaactttttgtaaagttttaaactttgcattaatattataagaaaaagaagaaaagtagaaaatgaaggttggcatgtaaggtgtcgacaaagcaggtttgcagccactttgtgtgttctagatatttcaatctcttggcaacatgagtgttggccttacagcttttttctctgaatatctttcttctttaatctgaaaatatgtccttgtatctggtgacttttatcagatgagaacttcagagttggtcattgttaccagtaagaaaaatataatgcttaagaagaaataacgaaggttgaacattatgtgttttagatcagaaatagtttctggccaggcacagtggttcacgcctgtaatcccagcactatgggaggctgaggcaggcggatcagctgaggtcaggagttcgagaccagcctgaccaacatggtgaaaccctgtctctactaaaaatacagaattagccgggcgtggtggtgcatgcctgtaatcccagctacttgggtggctgaggcagaagaatcgcttgactctgggaggtagaggttgcagtgagccaaaatcgtgccattgtactccagcgggggcaacaggagcgaaactccatctcaaaagaaaaaaaaaaaggccgggcacggtggctcacacctgtaatcccagcactttgagaggccaaagtgggcagaacacaaggtcaggaatttgagaccagcctggccaatacggtgaaaccccgtctctactaaaaatacaaaaattagccaggtgtggtggcgggcacctgtagtcccagctactcgggaggctgaggcaggagaatcgcttttacctgggaggcagaggttgcagtgagccaagattgtgccactgcattccagcctgggcaacagagtgagactccgtctcaaaaaaaaaaaaaaaaaaaaaaaggaaattgtttccaaatatcttttttttaatgattatttttgaatagtcaataatttattccttctttgttccactatttgttcacttagcactcttgcaaaattttatggctttttttaaactagcttttttagaaaactcaattttgcacagatgttgaaaaattataaaatatgtacatattcaaatgttagggatcaaattttaatcttggaagcttggaaattaaatatcatttctgtcatatattttaaagcagtgaaaggtatttctttcttttgaggacttcagcaaatatttctaatttcaaagctttctattaaaagtttttagttccatataaagtatatcttttttatgatattttaagcactaatatattatggtagttaaaataatttctagttgacaaatctagagctgatagttcttaagtttaaaatacagtttaagcaaggagtatataaaatctacatgggtttctataaatggtatcgtttaaaatcttatttcagtctgggcatggtgcctcatgcctgtaatcctagcactttgggaggctgaggtgggagaatcccttgagcctaggagttcaaaaccagcctgggcaacatggtgaaaccctatctctacaaaaaaatacaaaaattagccaggtatggtggtgcatacctgtagtcctagctattcaggaggctgaggtgggatgatcgcttgagcccaggaggtcgaggctgcagtgggttgtgatcgtgcccctacactccagcctgggcaacagagcaagactgtctcaacaaagaaaacaaaaaagaaagtaaagaaagtaaataaaatcctgtttcatcttttattaaattgcagattctgggatattcatattccatgtagacattatttaatatctgccagtctttgaatctcaactatttttgagtatttatagtttccatcaattcttaaaagaagctgtatgtacaattcaagttcaccatcgttactggcatttggtctgataactggctactgttaatagtggcaaacagacttaaatacaggatactttacatatgacactttacctgcctcttttaaattttaaaattattctatttaaaataatctgacattataaatttctatgagtaaattatagaatggtctattaatttttcctttagtttgttgtgctttctgtggtcacagaaaatgctttagaaaaaataaaattattctagcccaggcacagtggctcatacctgtaatcccagcactttgggaggctgaggtgggcagaacacaaggtcaggagttcaagaccagcctggccagtatggtgaaactatctctactaaaaatacaaaaattagccggacgtggtggcgggtgcctgtagtcccagctactcgggaggctaaggcaggagaatcgtttgaacccgggaggtggaggttgcagagagccaagattgtgccactgtactctagccttggcaacagagcaagactgtgtctcaaaaaaaagaaaagaaaagaaaagaaaaaggaaaaaaaaagtattctatataagttagactataggttcaaagataattccttcataaaagaaaaaaaatcaataaaatttattcacatggccatgcaccatggctcacgcctgtaatctcagcacgtcaggaggccgaggtgggtggatcacttgaagtcaggagttcgagaccaccctggccaacatgatgaaatcccatctctactaaaatacagaaattagctgggcgtggtggtaggcacctgtaatcccagctactcaggaggctaaggcgggagaatcacttgaaacctgggaggcagaggttccagtgagccgagatcgcgccactgcactccagcctgggcaacagagcgagagtccctctcaaaaaaaaaaaaaaaaaagaatatatagacgggtcagaactgcattcacactttggttctatagaatatcaagctgttttttgatactttatttagtgatacagtggtattcccaggaggatttgtcagcacttttctgggaatgcttggaaatgactaattagcattagaaatttaaaatgttctgatatcattattttatgtatttatattttaataggatattaaggatttttttcatggtaaatttatggatatataagtaggtaatttggcttacttataatttaaggaaataaaattactagagtactctcggtagagatagcaaatcgttacctctagactcttagtattttctctgtatcaaataatgctatcgtagtaatatatattctaagtactttgaattatatttgaattatatttgaatataaaagaataaaaattcttttattcttcaacctacatttatttgccagcttatctttaatgtaactccaaatacataccaaatttttggcttcccagaaatcaatttaataatttgaattttattacaatgtaggcactgtgataggtgttgggaggatctaagatgagaaagatattgtcagtgctttcgaagtgctcacagttcttaccctccattttactacctcacatggcattattaattaatgcactcagatctcttgctaaccagaatgtaatgttttgatgtgaaagattttatacatcattatcatcatcagaggatcaatagtaccatggtaaagaattttaggctgggtgtggtggctcacgcttataatcccagtactttgggaggccaaagctggaggattgcttgagcccaagaatttgagaccacctgggcagcatgacaaaactttgcctctacaaataatttaaaaagtagccaggcatggtgttgtgtgcctgtagtctcagttactcgggaagctgaggcaggaggattgcttgagcccaggagatcaaggctgcagtgagccatgatcgtgccactgcactgtagcctgggcaacagagtgagaccctgcctcaaaaaaaaaaaagaattttacagtttaaaaaaaattatttcatttgtcttaaaatgagtagaatctttgcaattgaggtagactttaaaaagtaatatttttctattaaaagatggttactgttcttttctgacagagttaatattttcagtgtcatagttttgtgctaactttttctttaataagtatgcccaggatcaatcctgcagttgtgcacacacaatcgtgtgttagctgtccatggaaaatgtatagaatatttaaatttatgtaggatatgatatcacagtttggcatacttaccctagaacacacacttatgtctgactgttaaatcagttgggttttataatcattacggttttgatatttgataagatttgcaagataaaattttttacctcagagaacaagacaaggttatatcgtgcatattaaattcataataccatataacttgcttttgggttcatgattgcttttcacctgtactttccatctgtcatgaacagggatccctgagatgttcatactctgcattctcatgtgcatgatccttagatttaaaaagggtgagtgggagaaagttgctttatagaaatataagttcacagcattcatgttttgtgtgttccactgcaaatattgcatgctgcatacttgtatgctgcatacttgtatttctctgaaaatgaagaacataggctcataagtacacaaaaaattagtttcgtttttgccaatagttggaacagatgaaggaatgttagatgtaataccttttctattttttctaaaatgaattctgtagtatttttcaaaagacaaggaaaaaaattatatttaaactcaaagtggctacaaatcagctcctaaactgtcactgacagtagcatatagatttcgtagtttttacaaacttttaaaaatatttatttactaagaaaacattgcattaatgcatgatacaaaattgataagttttcctttaaattggaatgcagtttaaagtgactgaattttccaatttcagctactgcatttgagaaggatacatactggaaaatggaactggtatcatctaatttctttagactccttcacttatggtagttgggaaaaatctttccatgtggcattatatagatcatattcttgatgactaatattaattactgtgctttttagccttgacagtaatgaagaattctgggtggatatagttcattcaaataatttaggtgtattttaaatacatgttttcaattgaaaaaaacagatctttggcacttggcttttaattatgtaaacattgacattcttacattttgctctttatattataattgatgtgtatgttgcaattccaataactgcacatacagttttatcatacactttaaaacagtggcatacttggtcatagatacaaattaattttagattgaaatatatctttgtcacattacctatttttatttttgtgtgtgtatgtaatgacaacctttccatattgtgaacaagataaaatgatatctaaaatgttagtcatgacaacttccaaccttagcgatcaacgcgcctctgagtttatgctgttaagggctaaagtaatagtattttcagtgcgctattctgccagttgccacacatgctgaaaagatctacttaaatctttcttgctaggcataacagataaatagttttataaaaaatattaattctgatgctctccagagatttttatgcttaactattttctgttagatttcagccagtaaaatttaccattgttcttacattggaaaattcccttactagtcacaatcaaccaggtcctttaaaaagagaaaatggacagctctaaccaattgtcaagcatgtaatcaagtactttattaagagaaatccatccattaatcagttcttcctttgcttttcattatgtcataaaggatggatttattttagagcttatggttttgaactaccacttccagcttctggagacccaatgattaacttgcttctacaacccagaatgttccaaatcatacctttttcatcttgattctcctagattttacaacaaatcatagtgacaataccagttccattttgcctccaattcagttgattatatattttttctatttatttctcattttataattgatatctggaataatcagcagctcttttctcatttattttctcatatttttattccaggatttgcctctgaagcagggagtgtctgcattaaaaatgacctgtagttctctgcttcataggttagaaacttattttaatattttgtggctaagcacagtcccacttttcaaattctataatgaattatttaattggcattgaatgtggaccaccagcatatatttcatattggggttttctttattactttaaatgattaaaattcaatagaatgtccagctgaggcaataaaagctttatttttgctttacagcttaaaacgttaaatgagattttaaaaatctatggattgtaacataagtaaaataatgctatttgggcatttttaaaaattccatttcttaggccttatattgcttgaagcatttatattctaaaacataaccaaattctgactattcattttggggaaaaacaatcagttcacaaatcacattttcaatgggactgctagccagcataggtgaaaacatgtatagtgtatttactcttgaattgtacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatgggttggtattcacattttttaaaattctatcatcattatgcaaaacaaacaaacaaaaaaaattcccaatttttcctaattgctgagctcaagtttgcatataaagcaacagtgctaattttatcattgaaatacatgaaaattttaacttaaaattaccaacttttactagatagaaaataaaataatcatagattctagcaatagatatcttattatcagtatagttaggtagtagaaaatgaaaataatctgttctgaaataaatttcaaatgaatttatattttaaaaggacttttactcagccaggtgcggtggctcacacctgtaatcccagcactttgggaggccgaggcgggcggatcacctgaggtcaggagttcgagaccagcctgaccaacatggtgaaaccccatctctactaaaaatacaaaaaaaattagccgggcattgtggcatgtgcctgtaatcccagctacttgggagaactgaggcaggggaatcgcttgaacccaggaggcagaggttgcagtgagccgacatcacgccactgtactccagcctgggcgacaagagcgaaactccatctcaaaaaaaaaaaaacaccaaaaaaaaaaccgaaagaactagcaatgtaatgactccatccaaaacaactcaaacagtcactaagagctatgttctctttccaattgtgtcctcatatggtttacattttttagaggattttagacttaatttttttctctttaattgatgaaaacaagaaaaaactaaattgagagtttgattctcatcatttagattcatgtatcataagcttttttcctttgatactaatacattgattgtacagagtcgatattttttttaaatcactcattttttttctgtgattctgggttacttatttagagggtgatgaaacaggatcatggtacatgtttgagttttctttcatctctgccagtcacactacccactaatatagttcaatagctatgttacagaatattcactgctataatgcagactagtatgacttttaattcctttagtaattttattgtaatatttaattgctagacttttaaattagatttttgtatagtacattcaaaataatttgttaaaatttaactctctaggacccaggatctcctacaatttcagttttacacaaaaagtggtcaagaagctttagattgatttactacttgatgacatcactgatctttttttggttaaaaattcagttgaatattatagagaatattcttaatatatatttaacttgcccttaagcactccctcagtacattttaaaaagtaatatctaccctttaagcaataattactctacaccgcttctttacctccttaagggtgatgtagttaaatgaaaatgaatatttaaatgcttttcagttttagaaagtccagtttagtaaattacctaaaagaaaataagatatactctttcctaaaatgttgccatttaataaaatcaagaatttcagaacataatatttgtagaactattacttataaaataaggctctgaaatgtaatgaatacagcaggtaaatacttaagtaactgtgatagtaacacagatctaaaagtctcatgaatatcatttaattacatatgtgtgtttatttgtgctttagtggagaaagtctttaatataaagttccagaagataaattttcatttttatatcaaaatgaatgttgaaggttcaaatttagagcaaatagaatttttacttatggctagtaaacagtgatttgcagttgctaattaaatatcttgaccttcatttttctgcttctacttttgtatgatagctatatcttagaaatgatttgaggttacccagggaaagtataatgacattggtcaagacagactctttcatgaaataattcatggagcagaaattccatcaagcagaagaaatgtccagcttcttaggtaatgaaaaaaatatttgaaactagtatatggaaatgatggaagaattttaaaattggaatttataacaactatattgaggaaaggatgaaaccatacctaaatatatagaaaaatcggccttaaaaataatttttcagagcatgtcaagctaaaagcctgtattcttcaacagtgaaaaaaatcttaaaatgttttgagagataaggatatagccttagatctaatgtgccataaatctacaatttatatcatactaagtatttagaaaatgtactttaaaatgtatacagcagtttattgatcttcaagataccacatagaaatctgatagcttgtagatgaaaatagcatttttatatgactaagatgttagagtctaataagagaataaaaccattaaaaaaaaaagcttagtatttgaatattcctagccatatcattcttaaatttctcaactaaatgtcctgagaatcagttgccccatgtctcttctagatatttctataagttaagataggatgtcatctggatgtgaaacctactttaggctttttgtaatgaaaattatttttttgacataggtcaccagaaggattatgcggcacgaataaattagaatgtcattttaagacttctgaatagaatatgccatgatggtggattttcctttttggttgtcatttagaagtaaaatcccatgtaactgactgctactttattttttcttaagccatcatgccttaaaaattagtaacttgactacgtttctaagcattagtggatgttttcatggttttacatgtctatacatctcaatatgtatgtattccatttttacattttagaaaaaaaagatagttttaagaacttctaaagtaccattttagaaattgcttaattacatgatattcttctttaagccataatgtgtatactcactcaatacttcatcccaagtgagatcatttgttttgctagactagtaaaactcactttcatttatttgcccttataaatattagcttgactagcataagtgagtataaaaacatgtcttgccaagttaatcgatatgctctatgaattttccttgtatttcaaactaaaattttcccttttctattataaaattgatacatatgaattacaaatatttgaaaaatacaagaaaacctcataatctagtcactcagtaaatctgctattatcattttgcagtattttctttcatctctttgtatgtatatttgggggatatttctacatagtttcaataaatgaatatttttactttaagattagtataaaacagaatatcatagactttcatgtgtgaggaactgcacactagttagaccaaatgtttgaatctgtacccagaatgatgaaaagaaaaacagggtttactgcccattgttccagcttcaacttgatacttatgttcatagaatttattcttccagggccttttaaatgacttgcacaagtaatctttgatttacttatgtcaaatttacacgaatggcattccttgtccagttaggatctttctcatcttaatattacagaagcttctttatccctctgctttcctttctttgtccctttcttcttctttgccttcatcaacaaacatttcttcagcacctgttatgtttcaggaagtgtgccaggttcagggaatataaagatgattaagcacagtattgcgccttgagaacttttcctctcatctatcagtcttactgaattcctatgctagtttcattccttctttgctccattcttttgcctctttcctagccaaggattcaacctactccccatttccattgaagatagtgcctttcctcactttgttcttgatgattaaggcaacaacttggttacagctggaggggtaaacattagagccaggtttaagcctgcttagcttctctgtgtttgaagtcgtaatattcctactggaatctggttgcttttagaggagatttttcttcacagtcatctggctcctggatctttgatgtgagtcaaaacttaggactaggagggtcacagagaaagctatgaccctgactttatttaaaaacatacgtgaattttttttttttttttgagacggagttttgctcttgttgaccaggctggagtgcaatggcacgatctgggctcactgcaacctgcacctcctgggttcaagtgattctcctgcctcagcctcccgagtagatgggattacaggtgcctgccaccactcctggctaattttttgtagttttagtagagacggggtttcaccatgttggccaggatggtctcaaactcctgacctcaggtgatccaccccgcttggcctcccaaagtgctggaattacaggtgtgggacaccacaccattgctcaaaaggaaagataactaacaatattgtttttacttgtttttattatgtatttgcagtgcttcaactattttacagattaaatgtgtttgcctgaagtcataaccaccatttgggatactgtttttctttgaacatgcattccacatagcaaatgcattataaataaatgttaaaaagcataactaaaaaaaataagggccaggtgcagtggctcatgcttgtaatcccagcactttgggagactgaggcgggaggatcacctgaggtcaggagttcgagaccagcctggacaacatggtgaaacccccatctctaacaaaaatataaaaattagctgggcttggtggcacacgcctgtaatcccagctacttgggaggctgaggcaggagaatcacttgaacccaggaaacagaggttacagtgagctgagattgtgccactgcactccagcctggatgacagagtaaaactccatctcagaaaaaaaaaaaaaaaaaggtagaatgctggtgctgtaaagcccagattgtaaaaatttttattgagggctttaattacttaactaatcacagataaaaataatctgaaaaatcacactcctagaaaagattgtttagagtaaagctaatttcccaataaaaattgaatcgctaattttttatctaatttcttcagtttggtttactgagaaggatactcaaaagaataagctacatataccttcatttggtttgtaggccattttgtatgggggtatgtagggtttttgggggtttgttttttgttttcgctaccctcacttcttttactgtgcagttaaaaaataacagtagttaatcttatagctttatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctcatgtatcttcctttaggcaatattttattttgccagcaagctgaatagttgtttttactattattgccagttctgtttcttcctttgtcttaatggctttttttttttatcaaaaaactctttttgatactttctccatgttgtgctttgatttctcagaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaaggtatttactttatttatcatttgaattttagttaaaatgtaaaggggaatgagaatatgtcctgaaaagtaaaatattttcaaatcatgaattttcttccctcatatttgatatttgaattagattcatcccaaactttagaaagaattttttttttttttttttgagacagagtctcactctgtcacccaggctggagtgcagtggtgtgatctcagctcactgcagcctctgcctccggggtgcaagtaatcatgcctcagccacctgagtagctgggactacaggtgtgtgccaccaggcccagctaatttttgtattttagtagtgtcgcagtttcaccatgttggcgagactggtctggaactcctgatctcaagtgatcctcccgccttggaggaagaaatattaaagtgaattcagagaaatacagtagaaattattaagaactttgaaaataaggtttttgagatggttatagtaatcaagactattggactgagaaaagacttgattaatacttaaggcttacggtttaagaaatgggatatcatttgcatccactcaagtacaggaggaaagaaggaaatgaggaaaaaaaaagaaatgaggtatcaattgagtcttaattttttttacagttgagactaaaagttaaaagggacttaaattttagcacctaggatatcttggtataaagaatatttgtctttgaagacaaacctcaaaaaaatgggggaatggggagaggacttaacaagtgtccctaccccttgctaaatactaaatagggaggaattttggctagtcatatggtagattcttattaaatacagtttgtataaatatgttagttgaacagtattttaagttaggagtagaggtggactgcctttcattttatacttgaatgaaattatgattgaaactctggatcaatcaggaaacgtgtctgccaccatttataaggttgttaatagtcacgtgtacaatatcaagtctacccttcttcactacatactaccttaacccacacccagtccttcaatcccaggacaggtaacaggcaagtgagaaatctatgttatgctttgtgtaaatatttgtctagctagatattttggtagtttggtcattacgtttaacctaattgccctgactttaagttatgttttgtctagttagaagtattgttagattaattgcttaactatgatagggaatgaattgaccttaaaagtttgtttagtcattcattcaacaaatactacactcctccatgtgccaggcactgttctagattctgctgaccagcaatttgactagtttgcttattttcctcattatgataccattttatagagatgtagctgtactggaatagaaaagatgtgtgaattttttaagtactttgtttggcatgcattgtacaatttactttgtgattttctgcattctatattaggagcttcaatgtttaactataagcctcatcaagaatcaggattggaaacatttgttcccaaatgctgttttaaatatttatttatttttcagcatacaaattataatttaatttatgaaggcttgctagagacctgtaatgatccatagatccccgtttgaactagcagtctctcagaccataatgttttgtctcaggatttaatgatgttatatgtatgtatctagtccgtgaaaatgagcttcatttccttcttattcatatagctgcactcatacttttctattcaagtagctttagtagaataaaaatttggtatatgtgctctcatttgatgatgatgatgatgccactaacagttttgtgagttttcccattagttatggtggtaggtcctgagcaacccaaatgctgcctgaagtactgtgcattcattctcatctgcttgtacaaataaattataaatgataatttatcatctaacatctaaatttataatttaagtatagttattacagaattaaaactatgacttacttcaggaatttagccaactcttttatgaaaatgttttatctctatttttcttgaagatttaaatttttttaaatgtaattcagttacaagtataggatttggtcttaaatatttgattttataattagattatttgaaatactaattagtgtttctgttgcatgttttctggtttcagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcgtaagtacttagtaagaatttttcattatacattacactcttgtgttaggcagaattgttcagtttctaatgtatagaagattttttgcgtattttattaaaatgttttaaatattatgaataaaaaaagacattacttcagaatggtaatgggttaaaattaactcttttaccatttgctaaagaattcccatggttgggccaggcgcagtggctcatgcctataatcccagtgcttttggagtctgaggctggtggatcacctgaggtcaggagttagagaccagcctggccaacatggtgaaaccctgtctctactgaaagtacaaaaattagctgggtgtggtggcacgtgcctgtaatcccagctacttgggaggctgaggcaggagaatcacttgaacccaggaggcggagtttgcagtgagccgagattgtgccactgccctccaagctgggcaacaaagcgagactctgtctcacaaaaaaaaaaaaaaaaaaaagaattcccgtggtaaaggcagggaaatcaaagccaagtggaaagctggccaaagacttacttttttgggtttataatagtaacattgaaaataaaaacttcaatttgatttgctttcctgaattccactttcttaatgtttgctttaaaaactttttttttttttttgagacagagtctccgtctgtcgcccaggctggagtgcagtggtgctatctctgcttactacaacctctgcctcccaggttcaagtgattctccctgcctcagcctcccaagtagctgagattacaggcatctgccaccacacccggctaattttgtatttttagtagagtcggggtttcaccatcttggccaggctggtctccaactcctgacctcaggtaatccacacaccttggcctcccaaagtgctgggattacaggcatgagccgctgcacccagccgaaaaactgttcagcagagactatgaagtgccttattccatcttgatgtgaaacacatattgctggtttaaattcaccgtctgttgttattttcctctgtttaaaaaatatatatctttagatttagattatgtgtttttcatcttgtgcatttaaattttaaaaattatttttccttaagccttttgtaaaggacctttaatcctaaaattgaaccgtaacagcaggaaatatattggtatggggtagatctatgttgtaattatttgtatattggatagttgctaaagactttacttggttttcagttttcttttgaaagccattttaaatagattggtaaaaggttagttggaaaagacattttgagaaatattttgtaaattttttttttttggagagggagtcttgctttgttgcccaagctgcagtggagtggcacgatctcggctcactgcaacctccacctcctgggttcaagcgattctcctccctcagcctcccgagtagcttggattacaggcgcccaccaccgtacctggctaatttttgtattttagtagagacggggtttcactgtgtaggtcaagctggtcttgaactcctgacctcaaatgatccgcccacctcaggctcccaaagtgctgggattacaggcgtgagccaccgtgcctggcctcataaatattttttaacttgtaacttttgaaaattactaaaaaaggggctgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaattagccaggcgtggtggtgggcgcctgtaatcccagctacttgggaggccaaagcagagaattgcttgaagccgggaggtggaggttgcagtgagctgagatcatgccactgcactccagcctgggcaacagagcaagactccatctcaaaaaaaaaaaaaaaaaaagacaattataaaaataaatacatataggccgggcgcagtggctcacgcctgtaatcccagcactttgggaggccgaggcaggcggatcacgaggtcaggagatcgagaccatcctggctgtcatggtgaaaccccgtctctactaaaaatacaaaaaattagccaggcgtggtggcgggcgcctgtagtcccagctactccagaggctgaggcaggagaatggcgtgaacccgggaggcagacttgcagcgagccaagatcgctccactgcactccagcctgggcgacagggcgagacttgtctcaaaaaaaaaaaaataaataaagtaaaataaataaataaatacatatagtagaggaggaaaggaaggaatttactgattataaaaatagtacttattcaatataagaaagttgaaaacaggccaggcgtgctggctcatgcctgtaatcccaatgctttggaaagctgaggcatgcagatcatctgaggccaggactttgagaccagcctggccaacatggcgaaaccccatctctactaaaaatatagaaattagccaggagtggtggtgcatgcctgtagtcccagctacttgagaggttgaggcaggagaatctctggaaccctggaggcagaggctgcagtgagctgagattgcaacattgtgctccagcctgggcaacaagagcgaaactctgtctcaaaaaaaaaaaaaaaagttgaaaacacagggtaaaaaaagctaaaaacatgccctttaaaaactaacttgtggcctggcacagtggcttgtaatcccaacactgggaggctgaggtggacagatctcttgagccaggagttcgagaccaacctaggcaacatagtaagactccgactgtactaaaaatacaaaagtgagctggagtggtggtgcgtgcctgtaatcccagctactcaggaggctgaggcatgagaattacctgaacccaggagggagaggttgtagtgagctgaggtagcgccattgcgctcaggcctgggtgacagagcgagactctgtctcaaaaaaataaaataaaaatataaataaaaaacaacttcctggaaataaccgctattttaatgtgtatcttcccagtcttttttggacaaaattgagaaaatactgtacccactgttttgtaatctgctttttacttaacatatcatgagcatttttcacatatcattcaatgtggtaacatactttttagtggctattattctatccttctggaggcagctactaattttttaaaagtaaaatccattttatctgttttctgaattagctctgtaaagaaagagactaaatgtatttttttattttttttttttttttaaaaaaaaggtctctggccaggtatggttgctcatgcctgtaatcccagcactttgggaggccagggtgggtggatcacttgaggacaggagttcaagaccggcctggccaacatggtgtaaccccatctttactaaaaatacaaaaaatagttgggcatggtggcggccacctgtaatcccagctactcaggaggctgaggcaggagaatcccttgaaccccaggagacagaggttgcagtgagccgagatcacgccactgcactccagcctgggtgacagtgagactccatctcaaaaaaaaagatctcttataagccattatttatgttcagattttaaaatagtgattttattttttttactttttattattataaacaaaagattgacaggattaggaacagtggtgaatgtttagaatttacccttttgtactttttgaacttggaactttgtaactttattacatattcacagaattaatagataagcaaaattttaaaaacaaacttgttgattaagaacattatactatttatacaacaaaatgtccctttatatattttttttctgtattagggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtagtaagtaagaagatacggagatactaaacatatggagtttctttcattttctgttaatcttttagacatctctaaattttagatatttcatatgctccggcttgtgatcatgcaaaatttgaaatattttaaaagcagtagtcagattttctagaccaaactagaggtgaatacttgggatacaattcaaaagatgtggaacattttgtagtttcctattatcataatatgctgatttaaaaagtaatttggaccagacagggtggctcccagcactttgggaggccaaggtgggaggatcacttcagcccaggagtttaagaccagcctgggcaatgtagtgaaaatcctgtctctacaaaataaaaaaatatatataataagttgggtgtgatggcttgtgcctgtagtttcagctactcaggaaggtgaggcaagaggatcacttgagccctaggaggtcaaggctgcagtgagccttgagcgtgccactgcacgccagcctgggcagcagactgcgactgtctcaaaaaaaaagaaagtaatttgagctggttatcagaagtaaattacaagcgaaagcattttctaagcatcttcactgtgtggtaaattactgtggttctaactgttttgtgttagaacatgagtaaggtaagcagaactttgcaaataacaacatgtcagaagtttcaattattaattataatattatagtatagtgttgggagtgggaaattcaattcttatcactaaccttgacatggatagaaaatgatgtgtgcgtgtttgtgtgtgtaaattcaattatgttgttatatatgtctcaccataattgtagtttctctctaatgattattgttataggtaataaataggaaaaattttccttttcacgtctctctctctcttttttttttcttttttgagatggagtttcgcttgttgcccaggctggagtgcaatggtgtgatctctgcttacagcaacctccacctcccaggctcaagcgattctcctgcctcagcctcccgagtagctgggattacaggtgtgtgccactagcacctggctaatttttgtatttttagtagaggtggggtttcaccctgttggccaggctggtcttgaactcctgacctcaaatgatctgcccactcctcccagcaccccccaccaccctttttttttttttttttgttagattgtggctcatgcctgtaataccagcactttgagaggccaaggcaggaggacaggagtttgagaccagccgaggctggtctctcttcctgtttccttctgtctcccattccaatcccagctcttcttactaaccaactttgttttcacctctcattttactccagctgtttaaacctgccaaaaagtttgtattcatggaaactaacataagccagaaacttataatggaagtgtattgaacaacataatgagagaacctgtctttacaaaaattaaaaaaaaaaaaaaaagccaggcatggtggcatgtgcctgtagtcccagctactcaggaggctgaggcagaaggatcacttgagcccaggagttttgagatagcagtgagctatgatcacaccactgcactccagcctgtataagagacccagtctcttaaaaaaaaaaaaaaaaaaaaaaaaaaaaggaaattgttcagatgagtgctttttgtttttaatttttattgtgttctgataacaaaatatgcctcattgctcattcagtcactcatttagtcaacataaattaaatgcagttgttctcaatcctgggtgtaggttcgagtcacctgtagtgctttaaaacaaacaaaaaggcatgccaattgatgatttgtttttggaaaacttcatagttaattcaatggatagttacagtgtgcctaactctgaaattaaagattatagtttaaggagcttacagtttagcaggctggggaaaaaacaggcaagtaaatgtctaattttatagtaaaattatattaacttccatatatgtgtatataaaattgtatataggccaggcgtgggagctcacacctataatcggagcactttgggaggccaaggcagggggattgcttgagcccaggagtttcagattagcttgggcaacaaagcaagaccctgtctctatttttttaattgcatataaaaattatataagcttccaattgtattataaagttatataaagatactatactgcacagtagctgtgtgaataaagtacagtggaaacatagtaagagcatctaattcagactgctcagagatggtagaacttgttctgtcttgtcttaaaacacaaatagaagtaaaacaagtaaaatgggatttacttgaaaaattttcatatctacccttctgtagtaattctgggcagagggattcatgtataaatatgctccctggaaggatatgattcttttgggggaaataaaaagagttttatgtgattggaataaaaagatatacattatgaagtggtaagatttgaggttacagaggtagacaacacctctttcttttttttttttttttttttttttgagacggagtctcgctctgttgcccaggctgaagtgcagtggcatcatgatctctgctcactgcaagctccacctcccgggttcccgccattctcctgcctcagcctcccgagtagctgggactacaggcacccgccaccacgcccggctaattttttgtattttttagtagagacggggtttcaccgtgttagccaggatggtctcgatctcctgagctcgtgatctgcctgcctcggcctcccaaagtgctggggttacaggcgtgagccactgcgcccggccgacaacacctctttcataaagagacttgtgtattcagcaaaataatttgaattttatcctgaccacttaggaagcttgatgcttgaacttgcgactttgagggctggatatgggaggaaaagaagaataaacataaaaatgatctacagtaaaacacaggacccaaaaaatctttttatttaaaaaaattaaaatgtttgttccattataagtttctggcttgtatttctttccgtgaatataaactttttggcagctttaagcagttgcagtaaaatgagaggtaaaaaggaaattggttagtgcaaagagttgggattggaatgggagatagaaggaaacaggaagagagagaggtagaaaaggaaaggggccaaaaggtgacagagttggaagggagaagaggaaacagatacttgatcttccttctatagatactcagtggaaagaatttctaatatcaggattcatgcagtgccttgtggctttaaaaaaattacttctaattattggtttaacaatggccattggatcctttgtctttttgtttttaaggggatagaagatcatccctttttacattcttaacatctttcatgttctccagacaatataggtgtatatgttttttgttttggtatgtatgtttatattattttgttatgttatatcaaattaagaatattaattttcagctaggtgcagtggcacgcacctgtagtcccagctacttgggaggctgaggaaggagaatcacttgagcccaggagtttgaatccagcctgggattcaaacccatctctttaaaaaaaaaaaaaaaaaaaaaaaggccaggtgcagttgtacacgcctgtaataccagcactttgggagggcgaggtaggaagattgcttgaagccaggagttggaaaccagcctggacaacatagcaagagtccatctccacacacaaaaaaaatgttttaagttagctgggcgtggtggcatgtccctgtagacccagctacttgagagactatgatgggaggattatttgagcccaagagttcaaggatacagtgagctatggtggcaccactgcactccagcctgggcaacagagtgaggtcttattgatctgtccttaaaaaagaaaaaagaaaaaattttcatatctacccttctgtagtagtttttaataggacaaaattaatcatggctttcttacatgtaatatatattagattttatcttatggttactcaattaaatatgactctgaatttaagaattttctacttcccctatttctacctatcccacagctatggggaaaggatggtattgttaagcaaactatccctctcttaaaattttggataggattagtaatttacatagtcagatgtaggctttatactctaaaatattctgttaactatgttgttctactagacattattacaaagctttattctcttgacaggttgaaatatttgcttacttatttttcagtattcagatattcattatttttttcaactttatttatttatttattttttgagacggagtctcactctgtcacccaggctggagtgcagtggcgatcccggctcactgcaagctccacctccggggttcacaccattctcctgcctcagcctcccgagtagctgggactacaggtgcccattaccacgcctggctaatttttggtattttttagtagagacggggtttcaccgtgttagccaggatggtctcaatctcctgacctcgtgatccgcctgcctcggcctctcagggtgctgggattacaggtgtgagccaccgcacccggcctcaactttatttttcagactgctagttgaaaagcatctaaaagcacacagtttttacaataccaaaaaggtgattttttgtgtgttctaatttttaagcattattcctttcaagtaatttttaagcattattcctttcaagagtcagcttataaataacttggtcgggcgcagtggctcacgcctgtaatcccagcactttgggaggccaaggtgggcccattacctgaggtcaggagattgagaccagcctgagcaacatggagaaaacccatctctgctaaaaatacaaagttagccgggcttggtggtgcatacctgtaatcccagctactcgggaggatgaggcaagagaattgcttgaacctgggaggtggaggttgcggttagccaagactgcgccactgcactccagcctgggcaacaagaacaaaactccgtctcaaataaatagataaataagtaaataacttaaaaataaaacagttaatgcttaagtaatcttgactttagttgtgtttagtatggcgtctgttggggactcatctcgtaaactttaaagaaaggaccttttaaaaggccagaagttaaattatcttgaatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaacggaagagcttctgcacagcaaaagaaactaccatcagagtgaacaggcaacctacaaaatgggagaaaattttcgcaacctactcatctgacaaagggctaatatccagaatctacaatgaactcaaacagatttacaagaaaaaaacaaacaaccccatcaacaagtgggcgaaggacatgaacagacacttctcaaaagaagacatttatgcaggaaaaaaaacacatgaaaaaatgctcaccatcactggccatcagagaaatgcaaatcaaaaccacaatgagataccatctcacaccagttagaatggcaatcattaaaaagtcaggaaacagcaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacacatatgtttattgcagcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaactggaaatcatcactctcagtaaactatcgcaagaacaaaaaaccaaacactgcatattctcactcataggtgggaattgaacaatgagaacacatggacacaggaaggggaacatcacactctggggacggttgtggggtggggggaggggggagggatagcactgggagatatacctaatgctagatgacgagttagtgggtgcagcacaccagcatggcacatgtatacatatgtaactaacctgcacattgtgcacatgtaccctaaaacttaaaagtataataataatacatttaaaaaaaaaactttacaagaatagtaaattttaagtaacaaaactgtataatatgtgggatctcttttgcataattgtataatgtcaagattcaatatacttcttttctgacttgtactgtataacttgtgaataaagcaggtcatttttgcagaaactaaaaaaaaaaaaaaagaaagtaaccgactagttctttctgtaatgtaaatacgaatatgtagaagataaatatattctaaaccttggggcctcatttggctgtcttatgcctttaacaaataaatttaaaaaatgagatatgggaaaaagttttatcagtaatcagtgaagtggaatttccacacagtatttgaaaatggagggaaaggttatatgctttacgtttcattttggtaatacaatatattaatgtaattttaacaagatataccatatgtttctggaatgtttttaaaaacaagtatctatttcctgttactccaaaaagttacctttgaataaactgatttagttaattcttcatttaaaagggtatatcattgtcagtgtatgaccaataaccctttccattctgttcacacatttaccctataggttctagacaatacttattttttgtttttttgttttttgtttgtttctttttttagacaaggtttcacttttgtttaccaggctggggtgcagtggcgtgatctcgggtcactgcaacctctgcctcctgggttcaaccgattctcctgcctcagcctcccgagtagctgggattacaagcatgtgccagcacacccagctaattttttgtatttttagtaaagatggggtttcaccatgttggccaggctgaccaacttgaactcctgacctcctcgaactcctgacctcaggtgatctgcccctctcggtctcccaaagtattgggattacaggcgtgagccacctcacccggccagtgtatttgtttatacattaacaatttctattaaactccccagcattgttgaaaatgtcatttatcatatacaaacaggttaaatatctcttatcttaaatgcttaggacccgaagtgtttcaggttttgaatttctttggactttgaatttctttgcatatacataatgaggtttcatgggaatggtacccaagtgtaaacacagaattcatttgtgtttcatgtacagctatacacatagcttgaaggtaattttacataatattttaaataattttgtgcatcagagtttcaaaaagcaaaggtgtcactgtttcagccacctttgtaaataatctttgtaaataacctgttgggcatcaccatcattcctgactctgaatttatttttatttttatttttttttgagacgaagtcttgctgtgtcacccaggctggagtgcagtggcacgatcttggctcacagcaacctccacctcccaggttcaagagattctcctgcctcagcctcccaagtagctgggattacaagcacccaccaccacgcccagctaattttttgtatttttagtagaaacagggtttcacccgactctgaatttatatgctaccaataagcaatccttttcttatatttcttcacacgtaagtacttaacaccggtgcagtcatgactcactgcagcctcaacctctggggtttaagtgatcctcccactccagcctcctaagtagctgggaattgcatgtgcatactaccacgcccagctaatttttttgatttttttgtagagacaaggtctcactattgcccaggctggtcttgaactcctgggctcaagtgatccttcaaccttagcctcccaaagtgctgggattacaggtgtgaaccactgcacccagcccaggtgtgtaaatttttgagcattgtattggcactcaaaaagttttggattttggagcatttaagattttagatttttggctgggcatggtggctcatgcctgaatcccagcattttgggaggccaaggtgggtggatcacaaggttcgagaccagcctgaccaacatggtgaaaccccgtctctactaaaaatacaaaaattagctgggcgtggtagtgtgcatctgtaatctcagctactgaggaggctgaggcaggagaatcacttgagcccaggaggcagaggttgcggtgagctgagatcacacctctgcattctagcctgggcgacagagtgagactcagtctcaaaaaaaaaagattttagatttttggattagggatgctcaacctgtatttaacaaagacaggatacttgtttgtatcaatagctgaaggctaaatgatactgcaataacacacaatttaaaagaagacaacaaaacaaaactcagtggcttacaacaactgagttggtaaaaccatgtgatggctctcaaaactttcacttggacttggcacattacttcagttcatatttgattatccaaaccagtcacatgaccaagcctgtcagtagagcaagaattatagcctttccagataattgtgtaactataaaaatatttattactcctccttcaataaagacaactcatagaaccggatgattgcaagttgattttaggtaagaaataagttttggtggttcttcttatagaatgcttatgtatctccacagctcagccagcaggagtgccagaaatcttaaagaaaagcttgcatagctgttcagtgaaaggagaagaagaagtgtttttaatcggcaagaactttctgaaaggaactaaagttattttccaagaaaatgtttctggtaagtacgcatatttgtggtacagatatttgtatgttttcactttgttatatggatatagtcatagctacagagtaaaaaaaatagttcaaaaatttaataaatcactttttatttcaatcagatgaaaactcttggaagtcagaagctgaaattgatatggaactatttcatcaggtaaaatttaagctttttttataatttggttatttactctctgagcaattcagttttgttttgaaattttcctgaatcaatagattaaatttcttcttcctatgggattgatatgaattatttaaagtttctttcttgagtttctttaactgaaatagaattattttcctaatggtaaacatgaccacctctattttaaaaagttaggatcattaacaaatgtttccattgttaataaacaaaatctttctttcctgatacttattttctctgaggatttgcataatcttaatccactatatagttaaataaaagggaaaccaatatttattgagaatctgttatgtttcaggtactttatatttgttaaaccttcttgtgtttagaagcactcatcacactgatattagtctgtatttgcaggacctcaccatgtattgtttcccaaataacaatgaaaacttgaaaacaaggatcaagacctgacttaggaattcgtatttagagcagacaggaccaaacccctagaaattgagactaacagaaggccaaatttataagcaagttagaaggcacatggagaagaggtagtatgtacaggtgtagaactgagacagagagagaagagagaaacaggaacaagctaatgtgtaaattacccaaagcctaaaatttagtgtaagctgatggggaaagaaaagagcacatgacagaaggtagagaaatagaagatgcaaaaattagacaatctatagccactttatccaaaaagtttataatttccttgttgttttaaaatttattttttattcctttgtgtatttttaaaaacctaataaaatttaaaacatatatccaatatattgccacactcaaggctcagggcacagccaagactgttgccacttcatacaccagacacaagttcaaaggtccccaggccaccctctttttttgaacgagtggctcaaacagtatttttcctactgtccccttggatttgataacttcctagaaaaattcacagaactctgggaagtgctatacttagtgcctgtagtttttttgtttgtttgtttttgttttgttgttgttgttcttttaagacagtcttgctctgtcgccaggctggcatacagtggcgcgatttcagctcactgcaacctctgactccctggttcaagcaattctcctgtctcagcctcctgagtaactgggactacaggcatgtgccaccatgtccagctaatttttgtatttttagaagagacggggtttcaccatgttggccaggatggcctccatctcctgacctcatgatctgcccgccttggcctcccaaagtgctgggattacaggtgtgaaccactgtgcctggcctagtgcctatagttttacaacaaaaggacagaaatcagaatcagctaaagggagagatgcataacacaaggtctcggagtgtcccaggcactaaccttctgtcatcctcaggaagacattaccatcttggcatagcaatgtgtgatgataacaatatgcagagaattaccaagcagggaagctcacccaagcctttggtgtccagagttattatttcagacctgattatatactgcccatgcagctacctttggtcttcacttccacaaggttagaattgatatggtgtgttccaaagcctctgttataaatcacattgttagactatccagcgaccaaagctctcaagtaaatatcactgtcacacaagacattgcaggaacctagagattacctcctagcagccagaggtaaagaccagaactctctctgggtaaagttaattatttcctagacaatatcgtatagtgtggagattcctatatatctagacaaatgctatgtggcaagttttcctctggccttatgcaactacatgttgtggaaaagagataatgggacttaacaaacattcctttgtcacacagaccattgggcaatatctcctagggtttatagtcagactagtcttaattgaagttttaatacctgctttgtcattagcaatctgtgttaactaagtaagacaaatgacttttgtgctccagttttctgatctgtaagataagcgctttcattagattatttgagactcctctgactctaacattttattatttcttatattatttgatcagaccatctccactcccatgaaccaacaatagcttcctctggagtactcctggaggttagaggcaatgtattataattcttctgtgttccttgtaataccaaacacttaatagatacacaagaaaaacttattagttcattttattcaccttgaagaaaaaaatgggtgactgtgtggtctaagtaaggttcatttgttctttccgaggatacttcaaaccctaatttcagccaggtctttaaatacctagagttgtaatcctaactgaaacttaatttattcatgcagtacttttgtatgctatgaacatgttttgtttcttgacaaattagttagattaatgtagactcccttgcttgtaatgctctattatgattgttattcttatgataaagattgatagataaggagactatttctggagattgagagacttgccttataaattatacaaaatatcaatgacatagccccaacaaattgtagtattaacttgctattttgtatagaactttatattcataagttatcctccctccctacctccatttttctttctctctctctctcttgccttttgaggcatggggtagttatatttttaaaacactttttttcagggcagttatgccagctacagtaggttaaagaataataatcataaaaataagacacgtggtggaatggaaaggaattatatccttatttggtgactatatctagaggtcctggggtttttgcaagcaagtatgtaaacaaactaaatcataatataatctgtcattaattctgtggttttgttcatttttatctttttcagagagaggttttattttattttttttctaaaggggttttcttggaagccttttctttgagtggaatcagagctgagatcctagagaattgattctagagattatataaaggaagaaaacccacaaagcaaacctttagggggaagaaaatgtgttgagactgggcatagtgactcatacctataatcccagcactttgggaggtagaggcaggaggattgcttgaagctgggagtttaagaccagcctgggcaacatagtgagatcccatctctacaaaaaatttaaaatatagccagtcatggtggcacatgcatatagttccagctacttgggaggctgaggtcagagaatcacttgagcccaggaagttgaggctgcagtgagccctgattccgccactgcacttccacgtgggtgacagtgagaccctgtctcaaacaaaaaaaaaagacaacacactttggatgtgatcagtaaagaaatattaggcctacacaaaaaaagttgaaagggaatctctacaatatttaaaaatacccagcagatggtatagtagaaaagaccatttaaagataatttcacaaattgcagttgtgaaagattgtaatagctgttcagttgcaaacccaaaatcaattcatcaggtattacactttttctatcatattataaatattgccaggcgtgtggctcatgcctataatcccagcagtttgggaggccgaggcaggtgaatcacctgaggtcaggagttcgcgaccagcctagacaatatggcaaaaccccatctctactaaaaatacaaaaatttgctgggtgtggtggcatatgcctgtaatcccagctacttaggaggctgaggcaagaaaatcacttgaacccaggaggcggaggttgcagtgagctgagatcacgccattgcactccagcctgggcaacaagagtgaaactgtctcaaaaaaaaaaaaaaaaaaaaagtaatacggtattataaatattgagactaatgaagtctggaaaaacaattctttgttcaattgttttctggtcttctggtccatagtatacctcatgctcatgtataccaaatatgatgggtacatgatcattcattatgtctattcccttttaacaactgtagatgagttatatataacattaattacctattaaaaatatatataaagggatattcaatctatatatacaaatatacataaaaggatagctcaggggaagatggtataaatgtggaaagaaaattcttgaaagaagtacaaaaaaaagatcctcagaagaatttgtgggaagaactagactaaacaaagacttgaaagcttagagttatgtttttcaaatcagttctaagagtaattttgtaatgggtctttggtcaagtctaattgtagatattctaattatgtaggtattctgattatatatattcccaactgtaaaattaatgtgacaaaataaaaagtatctcatagaagagtgaaagatatctagcaccattgctggtacactctgaaaaagattatctgctagggaaaaagttatttgaatctaagcagatttttctaagaagttaaaattcaattgttttcctctttttatcccaaagagcattatacctgctcccaaagcctcccaaccctttgtatgttttgtatgtactgtatccctagctcagtgatagttaattgtttctaatttatgagagggtattaaaaatagcttttgatcactagtgacagtttacctaatttttaattcagatcagttgtagaatttctagattcagattgaggaagtttgaagaattagtagcaaaataggttcatttggtttttaaaaggtttcaaaattagttttacttaaatgtgctctccaaagcaagtagagtaaaagtattttgataaaatatgcatctgatttgtagacactagtcctgttactaattgccaagaaacaagtttttattcaaaagaatagtttgaattatggagtttgccaaacaattttaagagtgagagctctcacaagctgttcattcaaccatctccttaactctagatagactgtttctgtgacatagttgtagtgtttaaacaacagagtaaaaatgaggtagacaagattcagtaactctgtttcttagaagttagatcaataccagtgcgttttttatgaccttgtatgtgttcagatttagctcctgccttataactgtggatgtatgcatatttgtacatgtttttccacctagttgaaaagaatgtggtttttttgagatggccaacttaggaggcattctgttaatgccgtaaattagaagctagttttttgtttttttgttttttttgttttggagacagagttacgctcttgttgcccaggctggagtgcaatgacgcgctcttggctcacctcaacctccgccccccgggttcaagcgattcttctgcctcagcctcctgagtagctgggattacaggcatgtgccaccagggctggctaattttttgtatttttagtagaaacagggtttcaccatgttaaccaggctgttctcaagctcctgacctcaggtgatctgcccacctcggcctcccaaagtgttgggattacaggcgtaagccaccatgcctggcctagttctttatttataatgtgactgtatttcagagagtgttttaagatggctcagaaacaaattaaattctcagaaatggaaaccttgaccttgatctcatttgtcccatattttctattcaactgagtcaacgaactatgtagtctaactaaattttaaatgtcatcaaactcacgtcaccctcagctgtcagcttcggcctcctgcaaatcagatcattagtgaaaaagcataatcactaccctgtgatatcccctaccattataataatctactagggaagaagaaaaaaaagtcaaatatggctcatattaccctctaagaagatatagtacccttgagtaagtactggtgaaacttttatgaactctgcctttctcttataaggatgcttctgccactgttccaactaaaaacatctttggtttactgagatgtggataaactgaacccaatttgacttaaaatgagaattatgttgttaggagtagcgaactgcattgtgaaatacatctcacattgaggttgtacagaatgtatggtaactgactttgcccttggtgggcatattttttttctaataatttattcattcttttattcaatatgtaccttatgtaaggtactattctttacaagtgagacagagtgaagaacaaaacagcctagatcctcatggagcttacattcttatgtttggagaaagaccaaaaaacaagcaaatagggtaatttgcaggggtgaggataagtgctgttatggaaataaacaagattatgttataaggttggggaagggttttgctttaaataggatgatcagggaaggcttctttgaggtgacatttgtatctgacctgataatgggttaggaactcaccatttgaggaggtgaaggaataatattgcaattgaagagaataacaagtatagagaatctgaggtaaaactgagtttagtatgttaaaagaagggaccgaggtcagtgtggctacagtgtagtgagctagaagagcaggaatgagatgaagttgacagggcagggatcttgaccttgtaagccattataaaacacttggattttaccttaaaagcagtgttaagattaatatcctgatgcctgtgaacctgagctttaaaatgcattcttttttttttaatcactttttaaactttacagctaacaggaaatatacttcatttaaaatttttaaatttaagtattgcttcttttccaactcttgtgcttttctttacattagaatcatcttattgtgaaggttcctccctatcatgaccaacatataactttgcctgtgtcagtgggaatatatgtagtgacaaatgctggaagatctcatgatgttcaaccattcacttacactccagacccaggtatgtcaaaatgaaaaattcagaactaaaacaaataattaatttccagttttttgaaagaatatgaagatgactagccaaccaaaaagaaagttgctcactaagatgaattgatgttagtttcttttggaaatgacattattttctaagaggacagccgccagatactgcttttactcttatattaaggaatcatttctaccttatgctataataataaaaggcagcaatgctctgaagtcagattctctgaagctatctgacaggttactcctccataagaatttccatgcattgactaccgcttatgtgcagaaacctgaaagtgacaactttgggaaattgctaatagtttagtttggctggtttatagggtacattttgagagagagaagagataaactagagtgacaggtgataaaataaaaaatcccaaagactgatggtgaataaatatttttttctttctatattgccccataatacctgataaatattttaaataaaactttggttgggttaaaacgatattttaggctgggtgcggtgatgcacacctgtaatctcagcactttgggaggccgaggcgggtggatcacctgaggtcaggggtttgagatgaggctggccaacatgttgaaaccttgtctctactaaaaatacaaaaaaaaaattagctgggtgtggtgatgggtgcttgtaatcccagctactggggaggctgaggaaggagaattgcctgaacctgggaggtacaggttgcagtgagctgagattgtgccattgcactccagcctgggcgatagagcgagactgtcctcaaagacagaaaacaaaacaaaaacctgatattttagaaatgagaggaactaaattttttttttttgcatgtgagtgggagacggagtctcgctgtgtcgcccaggctggagtgcaatggcgcgatcttggctcactgcaacctccacctcctgggttcaagctattctcctgcctcagcctcccgagtagctgggactacgggtgtacaccaccacgcccagctaatttttgttttttcagtagagacgaggtttcaccatgttagccaggctggtctcaaattcctgaccttgtgatccacctgcctcggcctcccaaagtgctgggattacaggcatgagccaccacgtccgaccctaaaatgttcaaagtttagaagatacctatttatgaagtgtctcacaagttatttgcctgcattcatttagatgcctgaaaaaagcaaaaagcctccttttggcagaaatggggagaacattttggaaatggaaactctttgcatgctccattgacctaggcttggcttctgccatgtttaccattggttcagttcagtccagtctcaagcatacttcagaattagcagttcttctctatctgtagtttattagtatgttatttccatatagttcaagatccagtgaggtagaaggtaaagaatggggcaaagaaagaaagccctggcatcaaaaagtgaagaaaacagtagctaggacagaataacaactaatttaagttaattgctttctgtcacttaatttttctattcactattctcttttcttttcttttctttttgagatggagtcttgtgttgcccaggctggggtgcagtagcgtgatcctgggtcattgcaacctctgcctcccaggttcaagcgattttcctacctcagcctctcatgagtagctggcactacaggcatgcaccaccatacatggctaatttttgttagtagagacagggttttgccatgttggccaggctggtctcaaactcctgacctcaggtgatctgcccgcctcggcctcccaaagtgctgggattacaggcgtgagccaccactcccagcctcatattttattcttaatcgtatctgaattttgcaacattattttctactaatttgttacaaaaggtatgccacagtacagcactgttaaaataccccttgaaggcctggcatggtggctcacacctgtaatcctagcacattgggaggccgaggtgggcgaatcacttaaggccaggaattcaaaaccagcctggccaacatggtgaaacccctctctactaaaaatacaaaaattagccaggcgtggtggtgggcacctgtttacccagctacgtgggaggctgagacaggagaatctcttgaacccgggaggtggaggttgcagtgagccaagatcacaccactatactctagcctgggaaacagagtgagactttgtcaataaataaataaataaataaccttgatatttgtctcagaattaaagatcatgtgtgaaaacattggaccaaaaaggcaaagtttagaaataacatcctggcttcaacaaaaataggagaaagaagattggcttattctcaaagaccaaatattttattgtttcctttctaggaaggcttaaaacatctaaggaaatttgatataaaattaataatagttggctgggcatggtggctcacgcctgtaatccccgccagcacttcgggaggccaaggcaggtggattacaaggtcaggagatcaggaccatcctggctaacacggtgaaacccatctctactaaaaatacaaaaaaattagccgggcgcggtggtgggcacctgtagtcccagctactcaggaggctgaggcaggagaatggcatgaacctgggaggcagagcttgcagtgagctgagattgcgccagtgtactccagcctgggcgacagagcaagactccatctcaaaagaaaaaggaaagaaaattaatgatagttaaagcattttagtaactgatagttactaaatattgacatttaatgtttggcaggagcttgcacaaacatgagaagaaagatggtataattaatacataggatttgtttcctgatgagcttctgcatcagttgtgttggaagggaaaggaatttatgtcaggaaatagccttaaaggttttgctatcctgaaaacactgagattttcttgtcttcacttgtttctttgtttttattgatatgagacttcaggactttgaagtacttagcatcaacactaagaatcatcatttcttagtgataaatgctaattattagaaattggcctttgataaattgctgaacaaacaacttttaagtattctacttcaaaggctatactaattgcctaattttggccattcttaggcaatcattactgtatgtttgctctttcaagttttcccccagcatattttgtatgttacagatagcaatcactcttagaaaaccttgtttgaataaatataaggtatgcaaactttgtaatacaatctaatgtcttagcttctgcctctatgatacagctaattagtcttcctgcaattttcatttttttgtttttttgtttttattttgttttgtttttttgagatgaattcttgctctgtcacccaggctggagtacagtggcgtgatctcggctcactgcaacctccacctcccaggttcaggcaattctcctgccacagcctccgaagtagctgggactacaggtgcccaccaccacacctggctaatttttgtatttttagtagagacggggtttcaccatgttggccaggctggtctctaactcctgacctcaagtgatccgcccgcctcagcctcccaaagtgttgggattacaggcatgagccacagttgtacttttttgtattttatgaaatgtaataatcttttcaagtgtccatgagaagtgtcttggaagccatgagagagaatatgatttcaggaaaacttgggcacagagaatttggcctatctcagtatgacaaactaatagctgttgtgattcatttagggactgttgttaaatatttgattactcgatagtgtattattatagcagccaaaacaaggtccatcctaatatttacgggttggagtagaagtggtgactgttaatactattagttgaaatacttaaaagttataaataaaactaacaaatcattaagtgaaatacctcctatcttactttgaccaaaataccctcataacaacctgaaaggctaaatttgaatttagaattttcaaactgctttgagttctaagctgggctatggtagcatgaggagagagcatccctgcctgccacccttcttttgccactttttggctccatcctatacttggaagcctttgataccttaatcagtgtttccacctaatatgcctaagagtgctcacaaaatctaggatagttgtacagaaaatctagggattggccgggcacggtggctcacgcctgtaatcccagcactttgggaggccgaggtgggcggatcatgaggtcaggagatcgagaccatcctggctaacacagtgaaaccccgtctctactaaaaaatacaaaaaattagccaggtgtggtggcaagtgcctgtagtcccagctacccaggaggctgaggcaggagaatggcatgaacccgggaggcagagcttgcagtaagctgagatcgcgccactgtactccagcctgggcaacagagcaagactccatctgaaaaaaaaaaaaaaaaagaaagaaaagaaaatctagggatcctgggtgcctgttacatggtctaaaggtagggtcaaggcaaaggctcaagtgaacatgtcctggttccacacattcttccaggtacagaccttctaacatcccatggggccatactgccccaaatcaaaatgtgtattctctcaggcacttagatacttttcagagtcataaaacctttgtattattgatagtctctgaagctttgcttagccattaaaacattttaattttttttttttttttacttcagcctattcagacacaaaaatcacacattatttgctgtaactccacagtggtgatttctataagaaatgggaatgtaatatttaacattttttttttttttctaaaaaagaaattactggctgggtgaggtggctcacatatgtggtcctgacacttcaggaggccaaggcaagaggatcacttgagcccaggagtttgagaccagcctgggcgatatagtgagacccccccccccgccatccctacaaagaaaaaataatactaagctgagcttggtggcatgcacctgtagtcccagctacttgggaggctgaggtgagagatcgcttgagcctgagagattgaggctccagtaagccgtgatcatgccaatgtactccagcctggacaacagagcaagaccctgtctcaaaaaaataataagaagaatttaaaaataactcataacatgatttataagtagaaatttaaatttttttcaaggattagcttatatttttaaatcttttattactagaattaatgtcatgcataaatatgtgtgttttttttccattcagttgcctataaatcatttgttggacctactgtgaagcatactaagataaattatttaacttcattctcaggagatgtgtacagatttccctctttatttttgttataactatcatttgacatgttagaaaatataaaataaatatattgaaaaatagaaattggctgggcgtggtggctcacgcatagaatcccagcactttgggagaccgaggtgggcagatcacctgaggtcagaagttagagaccagcctgaccaacatggagaaaccccatctctactaaaaatacaaaattaacagggtgcggtggggcatgcctgtaatcccagctactggggaggctaaggcaggagaatcgcttgaacccaggaggcggaggttgcagtgagctgagatcgcgccactgcactccagcctgggcaacaagagcgaaactccgtctcaaaagaaaaaaagaagaaaaaagaaaagtagaaattaaggccaagcacggtggttcatgcctgtaatcccagcagttagggtgtctgaggtgggcagattgcttgtgctcagcagtttgagaccaacctgggcaacatggcgaaacaccatttctaccaaaaatataaaaattagactggcgtggtggcgtgtgcctgtagttccagctactcaggaggctgaggtgggtgatggcttgagcttgggaggtggaagttgcagtgagccgttatcacgccactgcacttcagcctgggtgacagagccccagaccctgtctcaaaggaagaaaatatatatgtatattcaaataaaatatataatcatttgaagcaagaacgaatttatttgtaatttattaaactttattttttagaactgatttatatttaggcccattaaatttatagtttaaatttgttacagtaggctgggcactcaagcctgtaatcccagcactttgggaggccaaggcgggcagatcacttaaagtcaaaagtttgagacccagcttggccagcacggtgaaaccccatctctactaaaaatacaaaaattagcctggcagccagtgcggtggctcacgcctataatcccagcactttgggaagccaaggtgggcagattacctgaggtcaggagtttgagaccagcctggccaacatggtgaaaccccatctgtactgaaaatacaaaaattacccaggtatgatggtgtgcgcctgtagtcccagctacttgggaggctgaggcacgagaatcccttaaacccgggaggtggaggttgcagtgagtcaagactgcgccattgcactccagcctgggtaacaagagcgaaactccgtctcaaataaataaatagcctggcatggtggcgtgcacctgaaatcccagctactcaagaggctgaggcaggagaatcacttgaacctgggaggtggaggttgcagtgagccaggatcataccactgcactcctcctgggcgacctagcgagactgcctcaaaaaaaaaaaaaaaaaaaaattggctgggcacggtggctcacacctgtaatcccagcaatttgggaggccgaggcgggtgaatcacgaggtcaggagttcaagaccagcctggccaagatggtgaaaccttgtctctactaaaaatacaaaaaaattagctgggagtggtggcaggcgcctgtaatcccagctactcgggaggctgaggcagagaattgcttgaacccaggaggtggaggttgcagtgagccgagatcacgccactgcactccagcctgggcaacagagcgagactctgtcgcaaaaaaaaagatggggtttcaccatgttggtcagggtggtcttgaactcctgacctcaagtgatcacccgccttggcttcccaaagtgctgggattacagacgtgagccactacacatggcctggtattgttttgctaagtgatcacatgctccgcccacttggagattggagaatttagaggatagaaatttacctcaactagaatttctgctaaataaataattaaatgatactttgtgacaagatattctaattaaagaatttaagatacgaggtttttaggatgagtaaatgtagataaatacattaatcttttttttaatagcagcagctggtgctttgaatgtaaatgtgaagaaggaaatatctagtccagcaagaccttgctcttttgaagaggccatgaaaggtaccaagtaaattcttctcaaaaatcgtaattgggtgctcctgtatgttttctctagcacaccttactattttgttttctcttaggtacttataatactttgcagggtatcttcatattgtaaaataaatatgtgtttaactttactaaatgtagagacttgttttccaatttgatatttttcttgctgaatatgtttttatatatatatatatatatatttttttttttaagtatattggagtggaggagttttgtttttttttttaattacccaatattaaaagtatatgaggctgggcacagtggttcatgcctgtaatgccagcactttgggaggccgagtcaggtagatcatttgaggtcaggacttcaagacctgcctggccaacatggtgaaaccctgtctctactgaaaatacaaaaattagccatggggctggtggcaggtgcccgtagtcccagctgctcgggaggctgagtcaggagaatctctttaatctgggaggcaggggttgcagtgagccaaggtcatgccactgtactccagcctgggcgacagagcgagaccctgtcttaaaaaaaaaaaaaaagtgaaataaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctccaaaaaagaaagaaagaaaaataggccaggcgcggtggctcatgcctttaatatcaacactttgggaggctgagcttggcagatcatcggaggtcaggagttggagaccagcctggtcaacatagcgaaaccccatctctactaaaaatacaaaaaaaaattagcctggcatggtgatgtgtgcctgtaatcccagctactctggaggctgaggcaagagaatcacttgaacctgggaggtggaggctacagtgagccaagattgtgccactgctctccagcctgggcaacagagcgggactcggtctcaaaaaaaaaaaattaaaaacattaaccgggcatggtggcatgcacttatcatcctagctattcatgagactgaggtaggaggattgcttgatctgaagaggtcgaaggtgcattgagctgtgatcgtaccactgcactccagcatgggcaaaggaacaaggttctcaaaaacaaaacaaagcagaaatttggttggtttatatacttttttgataaaaaatttaaatcaggctgggcacggtggctcacacctataattccagcactttgtggggctgaggtgattggatcacctgaggtcaggagtttgagaccagcctggccaacatggtgaaacctcatctctactaaaaatacaaaatttagctgggcatggtggtgcgtgcctgtaatcccagctgcttgggagattgggcagaagaattgcttgaacccgggaggcggggattgcagtgagccgagatcatgccactgcacttcagcctgggcgacacagtaaaactccacctcaaaaaatatatataaatcacatatgagaaattgtttggtagagattacttgagaaaaaatgcaagtgttggattgtaatgcattgacaccagcttgatgttcttagagcaaattaattcttaggaggagaaaaagattaatctgatattttcatttataatgtactactaaattgaagttgactagaagattattattgaattaacaagatggaacatatctgacaaacttaatgtctggcctggagacattttggactgtttttggtgggactagacttaaataaaattggaacaaggccagatgtggtgactcacacctgtaatcccagcactttgggaggccaagccagtggatcacctgaggtcaggagtttgagacctacctggccaacatggcaaaaccctgtctctactaaaaataaaaaaattagctgggcgtggtggtgtgtgcttgtaatcctagctagttgggaggctgagacaggagaatcgcttgaatccaggaggcgaaggttgtagtgagcccagattgagccactgcactccagcttgggcaatagagcaagactctgaaaaaaaaaaaaaaaaaaaggattggaacataaataaaattaacctttgtgacctttgtgcatatggccgtagaaggacttgtgtctttgcatgagcattagactaaatgtccttttactgtttgtctttaccagtagacatacttgtcagtggtcaactgaggataggtaaaagactcttgctcaactttctctacctagtctcactttccagaaagggggagaagataataagcattactatctaaatacattttaagaaaaattgtagatctgttaagcagtaagtgtataggtgatatatttatttatatgtaatttctaattgaattataatataatcttatctgtaaacatggacatttttagatcaaaaatactattaataaaaatataagccaggtacagtggctagtgcctataatcccaactactcaggagactgaggtgggaggatcacttaaacccaggagtttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaataaaaaaaaaaccaggagtttgaggctgcaggtactcactccagcctgggtaacagagtgagaccctgtctctaattgaatgaatgagtgagtaaatgaatgaatgaatgaatgaatatttttaaaaagaaaaatacagactgtatatttttatttttatttattattattattatttgagatggagtcttgctttgttgcccaggctggaatgcagtggcgtggtctcggcttactgcaacctctgacctctgcctcctgggttccagaggctgaggtaacaggtgccctctaccacacctggcttttttttatttttactttttttgtatttttagtagagacggggtttcaccatgttggtcaggctggcgaactcctgacctcgtggtccacccacctctgcctcccaaattgctgggattacaggcatgagccaatgcgcctggcccatatttttatttttataggattaaccaaacaatccacaacaaactaaattgacagtgataaagctaaagtaagattattttcttcattcattcagcaaacatttgttgattacctactgtgcaacaggtgataacaacatctgccttcacagagctcatgatctaatggaattcaaaagcaagaatagtagttgactattacaggatcaacttaagataacactaatggtttttcaaaatgttctatgggatattcttagattacttttaaatgcctgccctgtgcatgatctgaagttttgtctcagtcaaaattaggttgtaggccgagtgtggtggctcacgcctataatcccagcactttgggcagcctagtagggaggatcacttgagctcaggagttcaagaccagcctaggcaaagtaacgagactcttgtctctacaaaaaaattttaaaaattagtcaggcatggtggtgtgtgcctgtagtcccagctacttatggggctgaggtgggaggattgcctgagcccaggaggtggaggttgcagtgaggcctgattgtaccactgcactcccaccaacagagagagaccctgtctcaaataagataaaataaaataaaaatctggttgttaggggaattgtattggtattagaatttaggtgaaaataggtccaaagaactcatgaataaatgattcatttctcaaactacttaggtagaataataaaacatggaatgtcaaaagttaaatgagcactttcccctctgtcaaaataatcagttttcataggaattaggtttttagccaaatggctgtgaggcaagttgaagtaagacaagaaaattgcaaatatttttagatgaaaatatttactttcagcagattttgagacagtcttgctccgttgcccagcctgcagtacagtagagcgatctcagctcattgcaaccacctcctcctggattcaagcaattcttgtgcctcagcctcccaagtagctgggatttacaggcatgtgccaccatgccctgctaatttttgtatttttagtagagacagagtttcaccatgttggccaggctggtctcgaactgctggcctcaagtgagccacctgcctcggcctcccaaagtgctgggattgcaggcatgagccaccacacttggcctttcagcagcatattgactgacaacaacaacaaaaatttatgaagggagcgatccaacttatagaccatgtgccattttaaaagcttctttatagccaagatttcttctcgatatcaaattaagaaatttaacagctatgctttctgaagactgtttccatagagcttccaagtggtagtaaacttttaaatcaggatttggctatgtgctcaactcagaagactgtcattagcaatagcagtaggtaccactgagtgccactgcggactcaagtagacaaaaaagaagaaagaaaagcaatcaagggggaaaggtagatatagtgaagtggtagaatcttgctatatgttgcctctaggtataaatctagaactaactactcctgaaaatggaggtagtaggaggtgggaaataatttttcattttgcttgggaaatttggtttgtaaacctaaaatagcccttatttctggggaaaaaaaaaaagatgtttaaagtccagtctaaaagagaattgtgtccatgtgtcaacttgtcatattcaagttttctaattaatttagttttcttttaatttagaaaagcaaaatttattaatcactgggtggtattttctaatgagaagcttgaacttagtttaagaaagaagtgctctgacaatctcatagtccttaagaagttctgagactatattgtcagatagctaaatgctaagaggagagtgtagtttgtaattgagtagctttatcctcctggagatttttaagctgtatcctataatatactcttggtcaggttgggtagtatgattcaaggcacttggaaccgtcttggggaatatagcttggtaattgaactgcttaagcttattattaatatttaagctatagttccaggcccattccagaggtcccccagccaatgcacttcataaaagggaagatatatcttaatataccaggtttgtatctcatgctaccattgtagcatcaaaaaaatagacatttaaatcatggctaataacaaattttagaatgaaatagttggtaaattttgtgattttaaacttttctttttgtgtgtgtgtatatgcagcaatgaaaactactggatgtaatttagataaggtaaatattatccctaatgccctgatgactccactcataccaagcagtatgattaagagtgaagatgttactccaatggaagtaacagcagaaaaaagatcttccactatttttaaggtaagctgtattgactagtgcacaaacctcctatataaaaattgctgtcttttacttttcctatttttttaacattatttttactttggatgcacttaatgaattttgctgtaaagagggaatgctttatacttcagcaaaattgcccacatagtgacttccaatatacaagggaggaattaatatgttgtatgagatattgatgaaagtactaattttagcattttcagaattagagatgtttttatttttttcccagtcttttcccataactttctgtttcttttttttacttgtcttatcccctgtaatgttactgaggagccacaaaattgagatattttgatacctgctcttcatgaaccataaaattactgtgttctgattacccttaattcacctaagcatatcaatagccgattattctacttccttgtttgactatctttgcttgtcgtacttttaaaaaatatatctcaaggaaaatgagacatcatgttatggagaattgtagtcctgtacctgttttctaaatgataataatatagagtggaaagctggtcctgcatatatttttagagcaatagtgatttttgatgtatgttacaaacttgtttaatgtttatatattcataatatttggggatttttattttttagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaatagtaagaaactctaatttttcattacttaattggtcattattattattagaaggaagcagagtgcagtggtgcgatctcagctcactgcacctgcaccctctgcctcccaggttcaggtgattctcctgcctcagcctcccaagcagctgggattacaggtgtgcacaaccacgcccagctaatttttgtatttttgttagaggcggggtttcaccatgttggccaggctggtgttgaatttttgacctcaagtgatccgctggcctcggcctcccaaagtgctgggattacaggcgtgagccaccacacctgtcctgtatagttgttttaagagtacagattgtagttagaactctatcacctatagactataagatcttgtacaagttatttggcttttatgggtctcaattctctcatttaaaatggtgataatattacatactttacatggatttggggaggattaaatatggcaatgtataaaaatgtgtgtttgccattttaagctataaacttaaaaggaaaatgaagtcagaatgacagataataccttacccagttgaagtaagtagtttctaaggaggtagaaactcatctttaatgtttatataccaaggaatttatataggacttttgatatttaagcaaagttgtatttttagactgcttaaaggaaacctaagatgaattccagtgccagtctgtgaaaacctttttcttggactatcaggtgcctaacttttagtaatatacaaggagaatgcagtaatgaattttccccaacaactaataaatatcttttcatgaatctttactaatcagatagcttctatttttaatgtttctgcagactgtagtcagcttttaagcttctgttttcaatgtctctgcagactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctctactaaaaaatacaaaaaaaaaaaaaaatacagaccaaacatccctagtccaaaaatccaaaatccaaaatgctctgaaatccgaatctttttgagtgctgacatgacatctcaagtggaaaattccacacctaacctcatatgatagggtcatagtcaaaagtcaggctcacaacatgcagtttatttggtgtccccaagggtaaaaaagatccttccagctcccttcagctgtgatagatttttttaggtgtatgtgaaacagaagtgaatttcatgtttggacttgtgtcttatccccaagatatctcattgtgtatatgtgcatattccaaaatccaaaaaagaaatcagaaacacttctgatcccaaacattttagataagggatactcaacctatattggacattccttctgcctctgagcttctttgccttggaataacaaaacatctgatgagtatgcaaaatgtgtttcctttgtactatatattggatataaccatgcctcacttatcccttcctccagaaataaatattgagtcagaaaagtctgtggaagatcaaatatgataaagttttacttacagtaccataatatactttaggatcattcagggtgtcagaaactttataaatgcttccctccctagtaagttaaattaaactttttctcttttttagaaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgt

SEQ ID NO: 12612 - DNA, 24509 bp, Human
aaacttcttgggtctgtaggtttgtagttttaaaaaaacttttcaatcattatttttttttgttgttttgtttttgttttttgagacagcgtcttgctctgtctcccaggctggagtgcagtggtgcaatctctactcactgaaacctccacctcccgggttccagcgattcttctgcctcagcttcctgagtagctgggattacaggcacatgccaccacacctggctaattttttatatttttagtagacacgagatttcatcatgttggccaagctgatctcgaactcctgacctcaagggatctgcccgcctcggcctcccaaagtgctgggattacaggcgtgagccacctcacctggcaatcattacttcttaaaatgtctttctccccatccttccacccccaggggacttcaaatcacactgcttgaagcggccccacagctcactgatgctctgctcactctcttagccttccctctctgttttacgttagacgacttctgttgccatgtccttgagagttttaagtccttgctttcctccttggtagtgttttctgaaacctgatgttttgcccaaaactgatatattattttcatgtatacatgtgtgagtttagatttgcatggctgagctttcatagcccatcgttgaatcattgtaatatattggtctgtgtctaaactgtgatgaaatgagcgaaagattcagacccggcttagaagacgatgtgcaagtcacaggcctttaagtgtcctaatgcctagacagagaacagacaaccactgagtgagatgggaatgtgggtgagaggttaagtacaggaattatttcaagattgcaaaaataagtctcttaaagaccacatattgcatagttcccttaacagggaaggcccagcctaggcaaactcctggacacagaagattagtggctgcaggcgggggaggggcagtgtgctgactgctacaggagaccggtggtgaatgcagcggtggaggcgggcccagcgctgggaatgtaccaccaccgtcgcgctgtgcattttttttttttttttgagatgaagtctggctctgttgcccaggctggagtgcagtggcaagatctcgactcactgcaacctccgcctcccgggttcaagcgattctcctgcctcagcctcccgagtagctgggattacaggcacgcactaccacgtccagctaatttttgtatttttagtagagacggggtttcaccatgttggccaggctggtctcgatctcctgacctcctgatccacctgcctcggcctcccaaagtactgggattacaggcatgagccacagaacccggccatgcgctgcgcattttacgcggatgaagcggatggcctgggcactgtggactgtgggtccagggagctgttttgacaacgtcttcattcctgccgctgtaatggggcgcacgtgcacgcacggacgtggcttctccccagggtgtcaccgcgtaggtatcacgctgattccagcgcagccgccctcgccgggcctcagcggggagtggccgggcagcaggggcgtggctgggaaccgggcgtggcctgagctgggggcgtggcctagctgtgggggcgtggctgggccgtgggggcgggccctccgcgcaagcatccgccgacgtggggcggggccgggcgtgcgggcggttgggcgggggcggggccggcggcggcgggtaacggagggggcggggctggcgcaggggtggggttgccgttgcggggcggggcggcgcaggcgctgtgcgcggcactcagcggttttccctcccccaacggcgcgccggctgtggccggcgcagagtagtgctcgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaagtgcgtgcccggcggccgggggctggcggggcccgggtggaggccgaggccggggccggggccggggcggaggcaaagggggccctcgctgtgcacgcccccagcctgccctcccggcggcacagggcgcggacctcaccgggtctggggccgccccgaaaggctgtgtgcgctgtgcgggccccggggagcaggtacttccagaaactaaacaccccctccctcagtggccccgcctggagtggggccgagcgcgcagaattcctgggaaccatgtgctccgggtggcactcttggatgtcagggaagcctaggaaggcccgacgggggtttgcaggctttgagctctaaaatgaggctccagcctgcagccgcccccttggcgaccctcagggatggctgtggaaggggctgcgtccgcagttttctgctcatcccagcctgtagttgcccatcgtggtcacactggaggatggcaaaagtgagattggtgtcaggatgtgatgagagcagggaggtggcgcagttttgcttttcctccataggaagaggaggacttccacagcagcgatagttgctaattgttgtgtagagatttccaggatgagagttgggttgctgtctggaaaaactagccagagccatgggagtgggatggtggatgcttgtctgccacgtattgctgacacttctgggctttcttttgtcttggcagtttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacaggtagggaacatgatttgtgaagctttgctcttttgtattaaatgggtaaattttaacttattttggttaggtcccaagtacttttttttcccttcagtgagcttaataaccttttaagccgggcgccaaggccgacacctgtaatcccagcactttgggaggccgaggtgggtgggtcatttgagttcaggagttcaagactagcctggccaacatggtgaaaccccgtacgaaaattaaccaggtggtagtggcggacacctgtaatcccagctgctcaggaggctgaggcgggagaatcgcttgagcctgggaggtggaggttgtggtgggctgacatcgcgaccctgcactccagtctgggcgacagagtgagagcctgtctcaaaaaaaaaaacaaaaaaacaaaaacaaaaaaatacctgtgaaagttgagtgtttatgtggtatgcgaatatttttaaatcttcagtgcaactaaagttcttcaaattacgtgttagtagttttgatgtttgttaagtgcatttcatttgtgcagtaaagaggagagtaagccacatattgataaaattcctgttgcttcatttttttccagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggaggtaagcgatgaagcagcaggtagtgggagctttcttctgactgagccctgtggctgatggcattttggccttggggggcaggggagacagatggtttgtacacatgtgaaacagtcttggaggtgtctgtgtatctcaggggtctgtccacccgcttccctgtcttttcgctttaaacattattctgattctcaaacataattaatcttggtgtgagaacgttgcgtttgagggctttttcttaacagtaaagtgatagacttacataaattttcagttattttcaagttactgaaagtactttatagttttttattttccttatgttatactcgatgagtgaggcagtcatctaacatctgccgaaagcctttggataggtggctgctaataggaggaccctattagggctgccagggagaggctgtaaggtgattcggaaagtttggaaataaagtcactgctgaaggcactgctgcgctaacctgcatagtcccttcctccctgggaaacacctgcgtagccccttcctccctgggaaacacctgcgtagccccttcctccctgggaaacacctgcgtagccccttcctccctgggaaacacctgcgtagccccttcctccctgggaaacacctgcgtagccccttcctccctgggaaacacctgcgtagccccttcctccctgggaaacacctgcatagccccttcctccctgggaaacacctgcgtagccccttcctccctgggaaactgatttgtgaagtgacccgaaaaaagaacactccttacacttagctttccaagagttggtgaagacaagatggggaggaagagctaccgccttctcccatgtcagtccttccttttcctccctataaaattttatgccaaagtatatgttcacatttgtaagatacaaagatgagtattaaagcagcctctgtgccgactactcaggttaaggaataaaatatcaccaaaacgaccgaattcctctctctcctgctgaaagcttcatcatccttctgaaatgggtgctttgtgtggcatacgcgtgcacatgagcacgcctgccagtcacgtgcctgtggtcctttgatggatacagttccactgacgcacacgtggcatagcctgtcacgcagcagaaaagctcggacgctacttcttcctgctttggggaggagagccacttctgcggcgagggcacacacacacgctgctgcagttttgttctgagcattgcagtaaaaatactgtcatattagaataattgtttttttttcttgttcttagaataattgtatataaagaaaatatttttgggaggaaatatgtccaggtggtttgttgttgttgtttttttttttccattctgacctttagaaaaagtaaacaacttcttgttttctgtattcatagataacacctgttaattaaaaagaggggctttggatgaggtcatattggttgcatagcacttggaaaacgtatttagtgtgatgattgattcttgttcagtttcgttgtataaaataggcttgggcttcatggtccctgctgatgctgaaaaactgcattagtacatctctttgtgtttcggttctctgtgctgcttacccaataatgtttatatcttggattgaaaaggccaaaactgtattcagcattaattgagataagaatacaaaattaaaaaccacttttttcttctttcgcaaagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggtaatacgtgtgactgcttgtcaggctgactcatatatgattaccttagtcatacatggttatcacagatgagtgatccttagccgtttctgcgttcagagggaataaagcaggtaggagcatcgttagctttcccagatggatcaaggatcccccagactatgcccaggctcgctggctcactaggaggactcccgggactccgcatgcagtcactctcaggctgtgacttactatggagaaaggatgccaggtgcgatcagcaaaggcgcgtggggagaaggcaggagctgaggtgcaagcttctaagagcgcgccctgtggagtcaggcaggttgcccctcatgcccccagccatgtggtctgaaaacgtgggtgaggtgttgccaaccaggaaagctcgctagagaccaggggcgtgtcacgtaggcactgcccccatgcatgcaaccacagtccagtctcccagaaggaaagcagttgttcagtgtcagccatatcgtttgcacagtgtaggttctgggggcactcttaactccctgaatctaggtttgcagactccactaagggccagccctgactgcaggcctttctgaggagagtggtcaggctgttttggtaactgctgcttaccagccagcttgagttcagcaagttttgcctggttctttttttttttttttttttttgagacggagtcttgctctgtcgcccaggctggagtgcagtggcgcgatctctgctcactggaagctccgcctcccgggttcatgccgttctcctgcctcagcctcctgagtagctgggactacaggcgcctgccaccacacctggctaatttttttgtattttttagtagagacggggtttcagcatgttagccaggatggtcttgatctcctgacctcgtgatctgcccgcctcggcctcccaaagtgctgggattacaggtgtgagccaccgctcctggctattgcctggttcttttaagattgctgggaaggaagaggttaaaattgttatttaagtggttttgtctgtagattttatttgtggtatccttctttgtagaattaagagtggttaatttttttctattataattgggttttcttttctttttcttttttttttttttttttgagacggagtcttgctttgtcacccaggctggaatagtgcagtggcatgatctcggctcactgcaacctccgcctcccaggttcaagcgagtcttctgcctcagcctccccagtagctgggattacaggtacccgccactacgcccagctaattcttgtaccttttagtagagatgaggtttcaccatattggccaggttggtctcgaactcctgaccttgtgatccgcctgcctcggcctcctaaagtgctgggattacaggcatgagccaccacacccggcctataattgggttttcatagaatatttccctaatctataattaattaactacataatgtatcgagtactggtactgtgtaccagtttctgctttaagttcaggaaataaataacagtgagtgagacaaatactcaggtttgaagctccaaggttgaatgttgagctaaggcaatttatttatttatttatttttttatttggtgagatggagatttactcttgttgcccaggctggagtgcaatggcacgatctcggttcaacgcaaccttcgcctcccaggttcaagcgattctcctgcctcagcctcctgagtagctgggattacaggcatgcgtcaccacgcccagctaattttgtatttttagtacaggaggggtttctccatgttggtcaggctggtctcgaactcctcacctcaggtgatccacgtgcctcggcctcccaaagtactgggattacaggcttgagccactgcgcctggcatggcaatttcttttaaagggatctattcaaacttgctggggcagggtgcagtggctcatgactgtgggccgaggtgggaggattgcttgagcccaggagtttgaaaccagcctgggcaacatagcaagtccccgtctctaaagaaaaaccaacaatactagtagtggtggtgttgcacacctgtcgccccagctacttgggaggctgaggtgtgggaggatcacttgagcctgggaggtcagcgctgtagtcagctgtgatcatgccactgcactccagcctgggccacaaagtgagacccatcccccaaagaaagaaaattaaaaagctagctaatatctttttatgatacttttatacacatggactaactgagggccttcctcaccctactgtgaattatgaagggcattttgctccgacatttatttaatagacatttattgagtacctgctatgtggaaagccttacaccgtacgttgacagtttgaaagttggacttctagctctactgcgtagacttgtggttagagttcagtgagctgatgtgtaaagagtgtttcgctcaatgtctagaagtccaaaagcacctagtaaatgccagctgctgttttactggcaaagtctctaattaaagttctaaatagacgggtgtgaaggtgagtaacaagggccatattgaataagttgctcagtatctgcttgtttaggactttgcatgttactgaatgtaatatgtaaaagtttaaaaaatagtctaataacaagactccaattgtttatctctacaaagaccaagtttcagaatattaacagagtgttgggccgtgatcctttctgaatcagggccccttggagaaagctgtgcacgagttcctggtagggtatttagcccgtgaagggcaagtaatatcagtcttgaatgacagagttatctgcccaatttggacccctcagtggtccaaatggaagaaggtgtcagacacaaaatgttgcttccagtttcaggggctttggagccatccctaatctagagacttgaacctggcccgtgagaagtaaagagggaaagctccagggagcttgtgggtcatggggccgccaagggcacccgaggatgctctggcctctggaaggcagtggctgcctctgtagacaaggccgtggcaaagccgtggggcttcctgtggtgacaggcgcttccgtggcactcagtggccaggatgcacgagctctggttccctcaagtactacaggagacgcttccttttacatgtttgttttgctccggtctctctcggtgatgactttgggttttgactataggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggttagtggtaggccaggtagattttcagaattttacaaattttacttaacaatgtccctcctttttcctaaggataactcaaactatcctttgtttcctggaatctaacatcaaatactaagtccagtatgagcaaagctctgctctttaatgatataacttgtcatttattaaagtaatagtcacagcctacatgtgttacactcagtgtgtaaataactgtgaagaggcaattgtcagatagcaaattgggcacctgctgtgtacggtatattgcactggggctgacgggtgtgtaggacatgatatttgccctcagaaaaacttgtgaaagggataaaagcaagaatagaaaaacaaaaaccggccagccacagtggttcacgtctgtaatcccagcactttgggaggctgaagtgggaggatctcttgagcccaggagtttgagaccagcctgggcaacatggcaagaccccatctctactaaaaaatacaaaaattaacctggtgtggtggcgtatgcctgtagtcccagctgctcggggcgggggctgggagggaggatcaattgagccagggaggtcgaggctgcagtgagctgagatcataccactgcactccagcctgggcaacagggcaagaccctgccccacccccacccaccccaaaaaagaaagagaaacaaaaatgcagataagtgtcaaatagtctgatctggacttcaaatatgcccagcaggttaataagaaatatacttctgtggactgggtgcatatacttctgtggactgggtgcatatacttctgtggactgggtgactatacttctgtggactgggtgactatacttttgtggactgggtgactatactgtggaccgggtgactgtacttctgtggaccgggtgactatgcttctgtggaccggtgactgtgcttctgcggaccgggtgactgtacttctgtggaccgggtgactatgcttctgtggaccgggtgactatacttctgcggactgggtgaatgtacttcagccgaccgggtgaccatgcttctgcggactaggtgactatacttctgcggactgggtgaatatacttctgctgactgggtgaatgtacttctgcagactgggtgactatacttccatggactgggtgaacatacttttgtggactggttgactatacctttgtggactcggtgaatatacttctgcggaccgggtgaccgtgcttctgtggaatgggtgaatatacttctgcggaccaggtgactatgcttctgtcaaccaggtgaatatacttctgtggaccgggtgactgtacttctgtggaccgggtgaatatacttctgtggaccgggtgaatatacttctgtggactgggtgactagggaggagccggcgtgttagcgccagcatatgcagtccctcaggacagccagcctgccgtgatcctgtctgtgtggtcgtggcagtggcctgcagcaagccatcgtggttggctggaactagacgtgtgatttgaatgcaggagttcagtcagcccctcagtggcctaaaaggaagaaggtgtcagtcacagggctggttctgggccctgccttggggggaccccagttccagggttctgggccctgccttcaggggacccgagttccagggtcctgggccctgcctttgggggacccgagttccaggtcccggcctcagcgttgcagtggccagggtcagtggctctttggccctctaggagtgagcagaccttagtgaaatagatccacagggtcctgactttgtacctggtccaagctgttggggaattgctgctgttgacccaggcaggagtctgactagagaacaaactaaggttgctgcaacaaacaaggacctcttccaagaagggctcccaggcctggcgcagtgactcatgcctgtgatcccagcacttgggaggccgaggcgggtggatcatttgaggccaggagttcgagaccagcttggccaacatgatgagacccccgtctctattaaaaatacaaaaattagccaggcgtggtggcgcctgtagtcccagctactcaggaggttgaagcaggagaattgttgaacccgggaggcggaggttgcaatgagccaagatagcaccactgcactgcagcctgggtgacagagcgagactccatctcaaaagaagggctcctgtgtctacgtcatggtggggctagagagaggtccccgcagctgggctgtgttgagtgagggctcgtctcttcagcgccaggcaatagtttgtcttgtctctgtcccttttctgtgtccacatgacatttacatcttgcgagttgcataatttaagttgtttatttacattatacatttaattgcattctatagcgatgctatgttgaatgtattctgatcggatcgtttatggttatttacaatgcagttactcttgaagattattgttagaggtagactgttgatttgttttgataaaataaagcttttgtgttttaaaaaatgctttaatgttttggctttgtgtatctattagtaaatcattattgatctgatttactcaagacgaaggcatttataatttttgaaattaaaaaatgttaattgtatgtatagtcaaagattaagtagaccaaatgtttatggatatgatactttacatacattatgtttgctgaatatttcttaaatgtaattacattgaatctgattacttctgggtcacattattagacccaccaagaaacaggctgaggtcaagtcagttcacaattttttcggggaattagaacataaaaagccgaaacacatgggttcttaattgtttctttagtgactgcccccttttacttggatgcatatttttgtccttgaagacgtaatacatgagagttttaagtgatttctctacattattttggtacacatttcactcagcaggtcttttccagtgtgaccaggcactgctgaaggtgctggggtaccctgcgcaagatagaggcatgtctggcatggagggaggcaggggacgagtaaacgtgaagacagtgggagcagggccttgcgggtggaaggtgctgctgcgagccagccggactcgggggctgctttggattgggtgatgttgggtggtcgagggaggcgcccaaccaaggcccaatgatgacagggagctggcagccaggacctgccggctgcagagtctgaggagtgcctgcctgccagccagtgttgctgggcagggcaccggggcaggctggggcctggtggaccgctagtcctgagggttgggggcctcggcagtctttgggcagtgagtgacatgacccatatcaccctgctgctgggggacactggatgctagggagtaggagctgggctggggtgagagtggaaaccaggagtctgcagtagctggaagatgtggcttgccgggcgatggctgccagggggcggcgctggggaggaggaaaggcacaaggcttcttgtgtttgtggcggtaccagttgggggttgtgatgggaaaaaggcgtcagggtttggcctcggtggctgggtggatggggctgtttactgagagggaagactcagagaagcaggatctcggcattctgggggcgtcaggtggggacatcgggaggcaggggatagataagtatggggtgagggcagggcggcgtcagccatcagtgattcacttctgttcgttttctagtgaacataggaattacagtgaacacctgtacacccatgcttcagtctcagcaatgaacatttaccgtatttactttgtacacacgcacaatttcaaagacaattatagacacgaaccttcatctctaaatatttctacataaatctccaagacaggccttccacagaatcccagtgccatgatcatgcctccccaagataataagtctttttcatatcctctaatgcacagactattcagatttgcccaaaatgttcttttattgccactatacctgcctaatttttttattttaatgtttattttgttttgttttatttttttgagacagggtcttgctgtctcccaggctggagtgcagtaacatgattatggctcactgcagcctctgcctcctgggctcaagcaatcctcttgcctcagcctcctaagtagctaggacttcaggtgtgtgccatcatgaccagctaattttatttttgtagggatggggttttgccatgtttcacaggctggtctcatacttctgggctcaagtgatcctcctgcctcagccttccaaagtgctgggattacaagcatgagccaccatgcctgactagttttttaatttttgtagcaatagggtcttgctatgttgcccaggctggcctcccaaagtgctgggattacaggcatgaaccaccacacccagccaaaatgttctaaaaatgactttcatagctgtttttttccacagtccagcacccagccatggattatgcactgcatttgatgacagttttcaagctctttgagctacaagaatcccccccacagttattaactatggcattgaggctttgaagagatcaggccggttgtctagagaatgccccacattctgggtttagatggctctatttactgttggtaattttaaattttggtgtaatttcaaacttacagaaaaattgcaagaacagtacaaagagctctttgtaggcctgtccgggtttgctccattctccctgccggtcccagtttctctccaggtatctttgggatccatttgatagtaagctgcagacaccatgcttctttatacttaaatacttccgtgttttttttttgagacggcgtctcgctctgttgcccaggctgaagtgtagtggtgtcatcttagctcactgcaacctctgcctcccaggttcaggcaattctgcctcagcctcttgagtagctaggactacaggcatggcccaccatgcccggctaatttttgtatttttagtagagaccaggtttcaccatgttggccaggctggtctcaaactcttgacctcaagtgatcctgcctacctcagcctcccaaagtgctgggattaccattgagccaccacacccagctaatttttgtatttaatagagacagggtttcaccatgttggccaggctgattttgaactcctgaccttgtgatccgcctgtctcagcctcccaaagtgctgggattacaggcctgagccaccacacccggcccagtgtttactttttttgagacggagtctcgctcttgtcacccagtctggagtgcaatggcgtgatcccggctgactgcaacctccgcctcctggattcaagcgattctcctgcctcagcctcccgagtagctgggattacaaacgcatcccaccacgcccggctaatttttgtatttttagtagagacagtgtttcgccatgttggccaggctggtctcgatcttacctcaggtgatcctcccgcctcggcctctgaaagtgctggcattacaggcttgagccactgtgcccggcccccgtgttgactttttaatatccacaacgatgaaaatcaggacatttaacattggtgcaagactgttattcacattttgcctgctgtctcaatagtgcccactacaactttttccccagtcgggatggcgtctggggcgctggttgtgtttagttgtgagatgcccctgcacgctgggggccctgaaggtgccagccactcctggggcctcccttgtggtgtctgtccctcccttcttcacaccagcaggtggttgagtcccgcttcgcatctccctgccatctgcatcaggccccggtgtcgctgtccctcacgtgctgtctgttgtcaggccctgctgcagactcggactggcctgtcccttctctcctcctttcctgcggacacgctgtgacttctcccgtgatccttctgtgagaactccctggacctcgtgtcctgtactggcaaccgcccatttctctgctctccttggctgcccggctgcccggcgcttgtctgtacctcctgagccacttcatcctctcttggatccattcccagcagcctgtgatcatggcctcccatgccgtttggtcacgccaccacgcccagctaatttttgtatttttagtagagatggagttttgccatattggccaggctggtctcgaactcctgacctcaggtgatccgcccgcctcggcctcccacagtgctgggattaccaacgtgagccaccgcgcctggcctacatacggattttcattctgtttttgaacatggccactggagggcctctcggctgcagagcaagcgtttgtagcttgttcgtggcagaatgagccgaacgctgtgttgtgacctgttttaaaaataaagcatcttgaaaaagaaaagccattctttttgtcctaatgagtttatgcctccttacctctggccacctgagctccttggtctgctgtacccctctggcctgggccgtgctggagtctttctggggctcagtcattcactttgttggttttttatgtggggtcagtggtagtgctttttccatcataatttgctcttatctttattatcccaaaaccttatttctattatttccttcttgaagttttatttttttctggtatcttgggttgaaagtttattttgtctatgttgttttctaatcaatgcattatagtaaatttgtcctggtgtgcttttgaaacatttcacaggttaggacacaatgctttcattgtttctcagttttaaatagcttgtaattttttttttttttttttgagatgaagtttcactcgttgcccaggctgccgtgtaatggcgcgatcttggctcactacagcgtctgcctcctgggttcaagcaattctcctgcctcagcctcctgagtagctgggattacaggcatgtgccaccaccccggcaaattttgtatttttattagagatggggtttctccatgttggtgaggctggtcgtgaactcccgacctcaggtgatccacccacctcggcctcccaaagtgctgcgattacaggtgtgagccactgcacccggccgctttcttcctcttaataacttcctggtatattttcctgacttatagttagagctatttcttttttcttactaagaaaattttttttattgttggtattattatttttctttttctttctctctttttttttttttcccagcgaggggccctcattctgtcacccaggctggagtgcggtgcaaccacagcttagtgcagcctcgtcctcttgggctcaggtgctcctcctgcctcagcctcccgagtagctaggaccgtaggcgcccctcaccaccgcacccgtcttgttgttattcttctcatgttcacaaatctaacatgagtatctgctttgggacgttgtcatctcaatgttttgatgttataaaaattcctttaaaactcaacgatttcacatatgttctgttgcaaatagatgcatttggattgaggtgcagattgagagtgcgatgacatcagtaccacgtctttggcctgggctcagctgaggaggactaaggggatctgctcctctctttcacagctgccccagctcccaggagacgggtcgtgggcgggccctgcaagggtccagatggaaccacaactcaaccctgcctctgcccaactgttcatagtgaaggcagacgccgggactagcctcatcactgtgtgaaaatagttcagaagatcttgcgagcgcctagttatgtctgaggatgattattttcttccttccttctttttttttaaattatcgtcttttaaatttagatggataattaagaatgcttccaatttaaggttctaagcacaaactccagatacgtcatgttatggacttgcttcctgaagatgaaatcagcagttgatggaaagaatccacaacacgcctacagaacagcaaatcacaaatggctgtgtctccacgaagccaggagctttgcatttgaagtttctatctgggctcatttccagctgttcagggttcggattcctgaaggcttccttagcatttaactcattctttgttgactgaaggcactggcactgtttctccacacgcaaactgatctttgtcataaatcacttttataatgagagagcagcctggacacattgccacaccttccccattctccagctcttccttggtgatggagaagttatctccgcatgggcagggacagaaatatgtctccgagtcctcgtcatattggaagtcctcgatttccacctcgtcatgaaatactgccatggtcagcgggggttgctgaaggggtgacgccccagcagtccgagaccagctccgagggtctaacttctccggagccggcccaggctctgactttcatttaattgtcctgaaaggtgaattctatcttgccaaataggcaagtgttttttatatgtaggctttaggtgtcagaatataggaaattatcaaaatgtggggtcattttaaattgcatcctaaaaccttttaaaatttgggaagaagctgggcgtcgtagctcacgcctgtaatcccagcactttgggaagctgaggtgggcagattacctgaggtcaggagttcgagaccagcctggccaatacggtgtgacccccgtctctactaaaaatacaaaaattagccgggcgtggtggtacatgcctgtaatcccagctactcaggaggctgaggtgggagaatcagttgaacccaggaggcaaaggttgcagtgagctgagatcgtgccattgcaccccagtctgggcgacaagagtgaaactccatatccaaaaaaaaaaaaaattgggaagaaaatgagtatatttatatgcaggtgtagattctgagtgcacacagtagttggaaatggcagcttgcttggttggaaagttgcttaaaagtggatgggtggaatgttccagtcactccaggtggttcagaagttaaatccatggcagcatggcgcttgtgtcctcctggacttgaattaagtagaaagttactacaactcagcaacaaaaagactacacagactgggaaccgtggctcccgcctgtaatcccagcactctgggaggccgaggtgggtggatcacctgaggtcaggagtttgagaccagcctggccaacatggtgaaaccctgtctctactaaaaaaacaaaaattagccgggtgtggtggcaggtgcctgtaatcccagctattcaggaggctgaggcaggaaaattgcttgaaccccaggaggcagaggttgcagggaggtggaggttgcagtgagctgagatcacgctgttgcactccagcctgggtgacagagtgagactcggtctcaaaaaaaaaaaaacaaaaaacaaacaaaaaaaaacagaaaaaaaatgttgaaagccaggcgtgatggtgtgcacctgtagtcccagctactcgggaggctgagcctgcagtgagccgtggatgtgccactgcattccagcctgagagagcaagaccctgtccaaaaaaaagacagcacaactgaaaaatgggcaaagaacttgaatagacatttctccagagaagatacacagatggccaataagcccatgaaagatgcgccaagccgttagtcattagggaaatacgaatcaagacccaatgagatactacttttacacatactaggatggctattcaaaaacaaaaacaaaagcaaaatagcaagtgttggcaaggatgtggagacatcagaatccctgtgctttgccgctgggggtgtgaaatggtgcagccactgtggaagacagtatgacagctcctcagaaggttcaacatagaatcaccagagaagcataaaccccaaagaggtgaaacagggacccaaatggatgcttttctatgaatattcatggcagcacctttcacagtggccaaaaggtggaaatgactcaagtgtgctccagcagaggaatgagtaaacaaatgtgttacaagcacacaacagaatcttactcagccatgaaaaggaatgaaattctgacacaggctacagcatggatggcccgaggtcattatgctgagtgaaataagccagtcacaacagggcacaccctgcgggattccgtaaacaaggcacctagagccgtcagattcagagagacagaaagtggactggtacgtgccaggggctgggggccggagcggtgtggagttagtgtttaatgggtacggagtttctgtttagggtgatgaaaaggtggtggcggctgcacagcactgtgagtggacttcacgctgctccactgtacacttacacatgcttaaaaggcaaattttatgctatattttaataccacaataaaaactgtataaacctggatttaatcgtgtagaatgctatgttttaaaaccaacttatggaaattttcaaatctgcacagaaatagaaagtgaactcccaggtccctctaactcagtttcaggcatcagcttgtttcacctatcccctcgccctcccacccccgctgaattattttaaaacaattccagacatcatttcattcataaatatatcttccgaaagaaaaggcctgtttaaaaacacaaccgcattatcagtctccttcctgaaagccttcactccttattacccacctgagtctccttcccgaatctgagcagaatctcccgtgagcccacaggtgtctctacggtcagctcatttgaatcaggatccaaacatcacatttggttgatagtttttaaatatatcttaacccgtaatagttcccccttcctttcttcctcaccgttcatttgttgaaaagggaatgatttgtcccgtagacgtttccacattctgcccgtggtggttggcgcctgtcatcgggccgtcgcctgtgcccctctcttcctctcagtctccttcgggaggttgagactgaccccaccattataattgaggccttttgtaaaagacaggtggtgtgacaggagcaagctcagcccacccccaccctgctggcagggtctccccaaggacagagccatctcagcgagcagcacctccaccttgctggccttggaaccctgagtgtgtggcagtgcagagggcaaggcagtcgccctggggtgggggtagatgcccctgacttgttaattgttgaaactttttaaaaatttatttttttgagacggagtttcactcttgttgcccagactggagtgcaatggcatgatctcggctcactgcaacctccacctcccaggctcaagagattgtcctgcctcagcctcccaagtagctggggtcacaagatgcttgccaccacgcccagctaatttttgtatttttagtagagatggggtttcaccatgttaatcaggctggtcctgaactcctgacgtcaggtgatccacccacctcggcctcccaaagtgctgggattataggcgtgagccgccacgcccggcctgaaacgttttaatatatacactctaccttctctcacacgctgggtttacaggtttattagctagggcccattagcggttgaaacgttcatgtcatgtatattttaccacaataaaatcaatacagtgtggccagacattctgagtattggaaaaacaaaagtacatgtacagtgtaactgctatttgaaaaaaaaaaagttaaaatctgtttattatataaatccccttgtgaggtaagacacaagtttgtgaatgacaccttaaaacagcgtattctaaagtcatttacttagctcttaatttgaaccttttgcactttggaagacagcagttttcatgtcagttaattcagtatgttaaccgtcacttcttcactgcaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgttactctgtagccagtcattaatctgaaggtttaatatatcattttattgggatgagatcatagtctttacacaaatgctatgtaaacaagttactgaatatttttcacctcgtggagttgtacacaaccttttatatatacacaccctaccttctctcaaatgctgggcttacaggtttattagctagggccttttgaggtatgctgtcaggcgacagcccgatgagggtgctcgctggcaaggcccgcgcgtccagtcggcggccgaggggcagccaggggcgctccctctcctggacgtcacccgcctgccacacccccgctccttcatgaccgtccactgtgcttcgggcgtccttgtcacttgcttcctcacgttgaattttatgagcttcgagagcctgatttctccccgacccctcctaacacggctccttggcaggctgaggtgtcgcagatccccggtgtcccctgggccccaatggcacctggaagcccaggatctccgggaggcccaggctcgccgggagcaccgtcctggccgtccttgctggtgccgggcacgccttggggtccttgggacagagcagaaaggtgagttcagctgcagcccggactgaaagcagggggacttgacatccagctgtgggcaagccctgctcttccatctgctcactcttcacttggggagaggccacagcgggtggggaggccgagggaacggcacacaaaggctctccgcggggctggcggtcgggagtgtccggggaaggccaggcgcggccagccccaggcaggggtgcagagccgtcctgaggacacccgcactctgacttacgcgggtttggtgggggctgtgtgagtaaggagtggatttggagtgagcagggggcccggagtggggggttgtggggtggctttggtgagtgatgacagtggaaacatgggaggcctgggtgtgagggaagagggagtcagccgcctaagtggggggtgtcagagcccttcactgagatgaggtgacaaagtccagaatggtgcgggcatggtgtgggcatggtgcgggcatggtgcggccgggaggctgctgtccaccagcaagtgcaacacagatgctgttcagagccacaggcggagagacgtggctggggcctgggacccctgtgcgtttggacaccaggtagaggcagagctaggtcagcaaaggagagtccaggagcatggggcacccagagagcagtgtgtgtgcgtggaggggagaaggggagagggctccagggcacccagagagcagcgtgcgtgcatggaggggaggacagggctccagggcacccagggagaggtggggtgggtggaggagaggagagggctccagggcacccagggagaggtggggtgggtggaggagaggagagggctccagggcacccagggagaggtggggtgggtggaggagaggagagggctccagggcatccagagagcagtgtgagtgcgtggaggagaggagaggagaaggctccagggcacccaggcagaggtgggagcgggtgccttctcgaagactgttcgggatccttctcatctggacacacacatccttggagtctaaggcctcctggttttgagaaggcaccaggctaagacaggggcgggcaggggatggcctttgccaaggatcctggcgctgcctccctccgtgacaaagcatttatttttgacattagaaatggaaatattcaacgtatgcacaggtcaattaagagaaaattctgttatactttaactgaaatagatactgagtagcttaaacagaatctaaccaaattgacttagctaaaatagatccaggaggatctgcttactgattaaacttttttttttttgagatggagtctcgctctgtcgccaggctggaaggcagtggcgccatcttggctcactgcaacctgcaacctccgcctcccgggttcaagcgattctcttgtctcagcctcccaa

SEQ ID NO: 12613 - DNA, 13497 bp, Human
ctggacaacacagcaagactccgtctcaaaaaaaaaaatattttaatgatgaaggaactatgttgtaattgcaactcaaggacgacccaccccaccaccatcagggaattcgaggggagactggcagttatccagggatcccagaaggagtcaactgggagttaagagtcctaacaaccctagaaaaaaactttcaaagacacaggtcttctcattaatctccataatcacagaggtcttgcctaaaagggccccccttgagtacacagctctgaaactggctaacatcttctgctgtctcatttgattttaaagttcacatttgtgaagggctctattgtacaacatggtgactatagttaataacagtgaatttcagttaataacctgaatttcactgagagtaggtctgaagtgttctcatcacaaaatgagtgtattagcatcgctcatagctcatttagccattacacaatgtatacacatttcaaaccatattgtataccataaatacatacaattcttattggttaattttaaaaataataaaagttctctatcagtcccataaattacaattttcaggcatctgcaaaggcagcatgttttggtttacatgtggtctttccaaattttatacgtataaaataaatgcataagtgtactacatatgcaaaaactaatacataaattttataaagtcaatgcacgcggggtcactgggatgaaccaatttcagtgcctgcagtctaatgtttaaaatcaaaatggtacaaggtcaccaccaaagaaattgtttaagccaatgtttctcaaactaaaacctttggacatactcccagaatcccctgtaaagaaatgtatactgtactcaaagttgagaaccactgacttagcataaagggaccgtatttcttttctctcccacccagcacaggcccagtgctcagcagaaattggggctccacagttctgcccaacactgggtcactgctgagaagtctgcaccaggccttcctgcacctttccactgagcaatggagtttgtttattcatttatttatttatatggaatttatttatttattttggagacagggtctcactctgtcacccaggctggagtgcagtagcgcaatccaggttcactgcagccctaaactccttgggctcaactgatcctcccacctcagatacccgagtagttgggactacaagcacgcaccaccacgcctggataattttttttaaatgttttgtagagatggggtctcccgatgttgcccaggctggtctcgaactcctgggctcaagagatcctcccgcctgcgcctcccacggtgtgagccacctttgatcttactgctatgatttttttattgataaaaactaataaatattctgagtctcaagaaagctttctgaaactatcaaagggacccaggcggcgcatcactacctgtgaggccgaccccactcacagcacagactgcaagtgaggcttacagatgggaagtgccctaagcgaggttaaacagctagttagcagcagacacggaactagaacctaagcctgctgtcccagcttcggtgcccgtgctcacagcggaagctgcctcggctcatccgtaagggcgctgattagggacgacaaagacctcaccccaccgtccccgtcccatttccgccctcccagatccccaacctccttcgagtcctctccaagtcgcctcgcctcgctccactccaggccttagcaagcattccacatgcctttaccccaaccctactgcctgtcccccaaaagatgcaggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtaagcggggccgcgaagttggagagggttggggacgttaagggtcggggtcttggtactggtgggtgaaatgggtccgggctacctgttgctgcggagtcctaacagaaccgctacaggaatgggcccaccctacctaagaaaaactgagggctggagcacgggttagcctggctcgacctctgagctagggagggatgtcagggctggaggcaggttctcccggaggctgctcagtggtgtgcgatgctagaggagggttccaggccttggctcaacttggccactatctcccggggtgaccgcggtcaagatcctgctcctttctgcgagctggtttcacactcttaacctgatgcaaagcgccgagagctgctggggaatgatatcactaacccaaagctttggtccttaggggtagaagacatgtgccaaggaggggcgtgtagacaccgttaagactgggccttcaatcagaatttttatttttcatctctgccactttctacctatatgatcaagtagattgtctcggcatgtctgagcttcagtttgctcatgcacataagtgtaatgagaaaaaatatgtgtaccttgtaatgaggtttctggcaagtaatggatgttcagtaattgttagatgtgtattgttgcagaaagacttccaagtctgttactaagcacctgtaacagatgaagcaaagttatcaggccccgcaagttgctctctacagtttataatccccatcttccatttgagggagaactagatgctatatataaaacttgcaaccacattggtttgcttgatcaaacaaacatacctggctgggtgtggtgggacacgcctgtggtcccagcactttgggaggctgaggcagggggatcacttgaggccaagagttgaagaccaacttgggcaacaacatagcgagaccctgtctctacaaaaactggaaaaaaaaaaaaaagaattagccaggtgtggtggcacacacctgtagtctcagctactcaggagactgaggtgggaggatcacttgaaaccaggaggtcgaagttgcagtgagctatgattgtgccactgcactccagccagggcaacagagcaaaacccagtatcaaaacaaacaaacaaacaacaaaaaaaaaaacttgtaaccaccttgcatcaaacattctcagggaagtacaagaaagctggaattaaatttacagagtatagtgtaaattacattttctagctatttagctcataaaccaggccttagtagtcccattcttattccattcacacctgtactctgtccccagtgccatggttttcttctttcaaaaaattaagaaacagaagtgtggaatttattttagaggttgaaactttattgaccaatgtatattttgagtttaaaggaaaaacttgtattttatcagttcaggacaccatcgattatgtgacacattataatttcatattaaaatgtgaagaatctttttaaacatcttacagttaacaaaacctatttctaaccatctacatcctagacagctatatcatataacttttaatgagttaccttgttagcaagtgctcaagcttctaacttggggtattttaaaccaatgcaactcaaaatgtgattcactgacctgcagtagtatctgggaatatgttaaacactcaggatctagggtaggagaccaataatctgcattttaataagatcccagagatttttacacacgttaaattttgagaagcattctttttaaaccatgtgcttggaacttctagcatagatgtggccagagggtgggataagaggcatccaagaaagctttgctcttaataccaacctcatcttctcctatctctgaataagcagttgttctgctataagtgtagttattttcttttcttttcttttcttttttttttttttttttttttgagacagagtctcactctgtcacccaggctggagtgcaatggcacgatcttggcgcattgcagcctctgcctcccaggttccagcgattctcctgcctcaatctcccatgtagctgggaatacaagtgcaagccaccatccccggctaatttttgtatttttagtagagacggggtttcaccatgttggccaggccggtcttgaactcctgaccttgggtcaggatccgcccgccttggcctcccaaagtgctaggactacaggtgtgagccactgcgcctagtggcgtagttattttcatagttagaaaagtcttgggtcttacagccatacccaacaagaattgatcatttcttttttttaatcccccaggtgtgatctaccatgcattgtctcagaaagaggcgaatgactccgatgtccaggtcagttcttggcagggagtccaggagcaacagaggtgatggcaaagatggctcagtagcttctgagcccccagcactgattgagatgtcctttcccacatcatactcctcatttttctggcagacatctaaggctggatcaaagtctgtagttctcattacctgttcccacgtgccagcctccttttctgttgtgccaaagtcaagtttggtaaaatgaggctttccttaaccttttatcatttcccactgtgttggggacaccaggctgtgcccacgtggtgggcagcatcattcaaccttgtcactgtgccctctgcacttctgcagaaggtgtgcaatcacatatcataagtgaaatttacagattatatctgaatgcctcggcctgctttgtcagttttgcaaaagttcctcttgtggctcataatgagagcattaccttgaaagcaagattttgaaagaccagtatacctttattttgcttctccatgaaagatgagccactcaggtatttaagagaatcagatcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactaatgacagatcagcatcagtctgtcagcctcagtcttagcatttagcacctggctagtgcaaaaagagctcaggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctcagatgctctcgacggtaccttcctccaagtgatggtctgcggggcgggagcggaccttttggagagtggccacaccatgcccacagagctggaaacccggttaaggagtattgtcctaagggcacagtgtcagggtccctgcgccctgaggcttggccgaccctggagccctagttttgctgttttctgtagtgttaggatcacttcctccatagcttagtgctactctgagctcactttcatctggtcatgcctggttgaatatatttgttatacatttctcaagctttctcttctgccaaggatgagagaattcttcttcaagatagaaaggttttggtcctttcagaataacctcagaaaagcagggccagagcaggaagtgagcgtttgacacgctgttgtgtgtgacaaacggtcatgaattggtgtgtgagtgtgacttacatctcggcagctgtgggtagcagatgcatggcggatgagcaggttgagagcctcagtaggtaaagggatgggccccatttgctcttgcagtagctgccgggaatggcgggcgggatgcctgggatcctgggctgcccagaccggagcagtgagcgccgcacccccttgtccgcctgcagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagaggtaacccgagctccccacgtctttctgcccgcggtgcttacccttcttggtgtgtgaacttggctgagtggctggggaggcagcctggctccacctaagctaagggggcctctctgtcgtctgccacaagagggcagccttcctttaccaatctgggctgtgttcagcgaggcgggtgagacaggactcattgtctggcctctctcctcaccttcaggagtaagacccgtgcaagtacatctgttgcccatggcaacaggctgtttgtccttcggctttgttagacagaaaagaggaactgatatgtttttagtgtgtattactttgtagcttttgatagagccagacagtcacccactcgggtttcattgccaaagcaagatgttgcccacacgtttcagaagtttccaaaaggaatgcatcactgtcctgtcctgtgggaggatgtcttcctccagccgacccgccatccctccttggtgacgggtctgagtgtgggtgtcttggggctgtctgtaggcttttgcttggagatcaacggccaaatagcctcccacgctccagaagacgcttaaagtatgccatgctgttcccggccccactcaggagatcagctgggcctcaggtggagaaggggctgctgcctcccagggtttgcctcccgggtggagcccaggttgggtttgagcttaaggtcctcatttctctaacctaaggctttgtggtaacggattccccacaggatatcaagactggagataatggcccagaagaacgctgttggggtccttgcccctgctccccgcttcttctccccaccacttgcttgcccaccttccagaccagcctgctgcctcacatgaggacctgcgtgacaaccagcaacccctgctttactgggggcttactaggttcaatttcacgtaacagaaaacctcaaaataacagtagcttcaacaagactcacgtttatttctctctcatgaaaagaagtccaggtggacaccgccctgggctggtgtggtcctaccaatgaggaaactgaggttagagaggtgtaggttcttggtctcggttatcagctcaattgctcatcgtcggatttgcacatagttcctaatgatcccaggttgcagttgttggcatcaagtcaagctctgtgctatttggacattgtcatcccaagctcatgttgtctaactttttccctgtttctgactttgctgcagatacagccttttcctccctctccatgaactctggaaacagtacatcagggacctgtgcagtgggctcaagccagacacgtaagttgcattcctgaagctttgctctttggggtggatctcaagcctctgatcattgtaaatgcggcttcaggaaccagcgttggtattgcctggctgcagacggttaaagacctagttgcttcttttggaactttttatcatgatgtaaaccaagggcttctgtttaccctgcaggcagccacagatgattcaggccaagctcttaaaggcagatcttcacggggctattatttcaggtaatttacctaagagcgtgtagcacatggccatccagaggttcactctgtcactctgtggagacccggggcgtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactcacccacggcctgggatcttgaacacagaatccctttcatccaatgctgtggtttcaaatgtcagctacacctgacagcccccaaggtgacatctccagcgtaggcctgtcccctgaactccaggctcaggcatccagctgcccacttgacatagccacctggatgttcagggggcatctcagactttacatagccaaagctgccaccgattctcctcacagcaacccctcctggtcttttccatctcagttaattactcagttatttacactggttgttcaggccaaaaacctaaacagtgtctatgtttcttctttcctaatctcctcgaatccttcggaacatcctactacttaaattcagccactgtcattccccagattacctcagacacagctcctcaccgcaccaggcagccagagtgccggttacgtagaaatcagagcacgttccttccctgcttcaagtcttctggcagcgtcccatcgtatgggagtaaacctgcctccttgctgtggtctaaggcctccccgctccctggggcagcaggcctcccacactgccttcctcctgccctgcctcagggcttcgcctctgctccttacctctacccgggagttctcctgtgtgtgcacagtccagcttctcattgttcagccctgctccaatgccactcccctcagggtctaccattgcaaaccatgaccctccacacattgccctgtccctactcttcatagcactcgttgctgtcagaaagtagaatggtgtggttcaccgtgcatcaccctgccttgctagaacccgggctccgtgagagtaggatccgggaccgcctctttccgtgctgtgtccctggcatctcctgaggatggtgcaggcattccacagctgcttggtgactctgtccgctacactgaggctcgggtcaggacgagggaggggctgctgcttgtgatggtggctcatctcgcagtgctggctgctgggcagctctgcagccacactcacgttccagccagcatcctgggcagtgcatggtggtgtttgtgcagatcctgcaagggagacctggctgcatcagagcagccagcccgtgggccctgatggtgctgggcacatatgtgacctttaattccagaatcctgcccaagacccctgtggccacagaccctccgaaggacacctcataggaacagtccagaggctgcaaagccccaggggaagcctggattcttgttggttacatcagggcccagctgttgagcccccaccccctgggtgctctgttctttcatctgctagctcagagggtgggatcagcacccccaacccctgaggcctgcttctctgtggttcccccagcaccacagaggcctgagcctggaactgtcctttttctttgcagtgacaaaatccaaatgcccctcttatgtgggtattacaggaatccttctacaggaaacaaagcacattttcaaaattatcaccaaagaagaccgcctgaaaggtatgtaggtgtttctgagggcattgcttgcgggctgtggctcccagctactgcgttagccttttcctcaaggctccaagagtttgatttgacccctcaagtcagcgcagattgcagatacttgctgaacctgcattaaagcctgcagagaccatcccctgcacccgtggctcccccaagaggtgtgtgtcagtgcagcctgcaaccccggccagaaatggccaaggggaaggaagacctgctcggctgtgcctcaggggacctgggtctgtttaggccccaggagagggcctccacctgccccaaaggctgctgctcccagaggaatgtagccaaacaggcagcagggtagaaacaggagtggcgcctgtccctggagttctgagctgtgtccttggcgataacacttgggttccatccgtggccagcattgctctagcagatactttgggtcagccaggatttctacaccccgccttacccacaaatccagagatatcaaaccatagttagaaggttttgttcctttaatttttttttttttttttttggagacagtctcactcttccacccaggctggagtgcagtggcacaatctcgactcactgcagcctccactcccggattcaagggattcttctgcctcagcctcccaagtagctgggattacaggcacgcgccaccacgcccggctaatttttgtatttttagtagaggcagggtttcaccatgttggacaggctggtctcaaactcctgaactcaagtaattcacctgcctcagcctcctaaagtgctgggattataggtgtgagccaccgcgcccagccttcttcctttaatttttgagcttggtttttcttgttgcttcccttattttcctacatatccttctacctcacattgtaaacctcggaaagtggtgtaatagtttctccacagagcataaggccaggagcccatctgaaagttaatgtgggaaaaccagtttctggcaggtgttctgggactttctggttctgggaatttggtgtatagcctttgaccctgaagattaggtgccaagctacatttagcatgtgactagattgacctgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggctcgcctttgggtggaactctgacccacctaaggtttactttgctatttcaggaaggttgaagaggattgaagggtgagttgctaagtgacttagggtttattcacttcaggaatcacagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccacttgccatgtgaaatctgtttttcatttagctcagactcaagtttctgtgtgagtggcggtttaatttgtagatacctctccctctcccccaaggagacatggtgagggtgctcaccggccactaagctgccgctgtgcctgcctgtttctaggatacactgttgccctcatggcccacccaggggtcatatctcccaggtagaggagggaaaggggagggcccagctgggcgggacatggttcctgatgaggaacagctgcagaaagcatgatctgaggcccaggggccgtggcaggggccagggctgccatgtctccacaggctgtggcacagcttgtcatggagggtaatgtggtgctttttggcccgatctctcccatgtccactgtccaaggagcaggaccctggcagagctgaggccttggccatgtggtcccacgggagacagagccacattcgacttgtgtaagcctccatgcaccagagaaagtgccaaagaggagagagtggttagcaactcaggacaggacccagaggctgcaggac

SEQ ID NO: 12614 - DNA, 248968 bp, Human
  misc_feature (1)...(248968): n = A,T,C or G
tagaaagactgaataataacactgaacaatgtttatgatcgtattgttgagtgagaaaagcaagactcaattgtaccttataaactctctcttttatagtacttgccaatttgttttttgtttgcaattccttgtcctttttttttttttgagacagagtctcactctgttgcccaggctggagtgtagtggtgcagtctcggctcactgcaagctccgcctcccggtttcacgccattcttctgcctcagcctcccgagtagactacaggtgcctgccaccatgcccggctaatttttttttgtatttttagtagagatggggtttcaccatgttagccaggatggcctcaatctcttgacctcgtgatcctcctgccttggcctcccaaagtgctgggattacaggtgtgagccactgtgcccagattccttgtcctttttaaactgtctttatgtctagacttgggagtatcctgagggcagagatgggtcataggacagaacatgagaaaagtatccgtagtacttttacccttagtagatagtcaccctcttggacctaagggtgtacctgtgggcagaatgaataataaaactttcttcccacccaacatttcctaagagctgctaatagttttccatatcttaaaattatgggaaacaatatttagagagctccttttcacactgaatagatttaaatgattaattttctttcttttttttttttttgtttgttttttagttttttgagatagtctcactctgtcacccaggctggagtacagcagctcaatctcagctcactgtgaactccgcctcctggattcaagttattctcctgcctcggcctcctgagtagctgggattacaggcacccgccaccatgcccggctaatttttgtatttttggtagagatggagttttgccatgttggccaggctggtctcgaactcctgacctcagatgatccacccgcctcagcctcccaaaatgctggaattataggcatgagctactgtgcctggtcttaatttttatttttaaccttgttgaatgttattggatcattaagaaggttttccaatatagtattagcaactgcaataaagatgtgtctttcttgggggatgcagtgatgacggtgcagggcccatacaggcaggggtggcgcctgagggtcccgggccaggcagcagcacacaggtggcaggatccactcaggctgcatctcccgtggtgctcatctggctgctgccatctgtgctggaccccgccaaggtatagagtctcatggacacgatctggaaggacccagacagtgtgccatcgatgtcctctagatcagaggggcccagggaggtgactacttctactcctttggggactgccaccgctaaacagcctagcagcagctgcagccagactgccaagcttgtccatttcaccctctcggacctaagggtgtacctgggggcacccacaccagacttgcagtaaccacctccttggcacctgcccccacctccaagagcccagaagacacacctggcctccagcaggctgggccttccagaagggatagcagggatgcattctctttgcacctgtggggagggtctcactctgggcacccctctcaccagctgcaaggccttggactcatgctgaacagtgtgggagcctcagttccaacatctatgacagttggatcatggccttacccatgaagcattattgagagaatgaaaggagaacagagatgggcttgcagagccacatgctgctggctccacattcccaggaacaaggatcctactgcatttttgtctttatataaccctattatatggactacattctgccataaggaaaggaaaaccttggatgcgatggtttaaacaaacaagtttgtttttccacatagcatgaattccagagatgggtggctaatggtattggttcaacagctgtgtgatggtaggggtcacatctccgagatccttttgccttgccctcatttgcttgttacttcatggtcacaagatggctgccatgtctccaagaatcatgtctgtgatcaaggacaaaaggagtgggggaagaagaagggccaagctcgctggacctgtcaacttctatcaaaaagtaaaacttctgtcagaaacctgtttcctgctctctcctcctgcagattttcacttaggtgcccttggcctgagctagctaccactgcacctgtagctgtgaagaaagttaagacagtagggaacagagttgtattggttgagtagaccagtcatgttccatctactgagactggcacactgcctcctgaaataaaactggaatcccatttaaacaaaaaaaggaagtgtctttcttaaatgagtttttttttgttttgttttgttttgttttttttttttgagacggagtctcgctctgtcgcccaggctggagtgcagtggcgcgatctcggctcactgcaagctctgcctcccgggttcacaccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttaaatgagttttatacagacaattggcatatagtcctttcatcagtatccttaggtcaagattatattacattgcagattgtctccagggtactttggagatggattctaattcttattctcatattgcagtaacagggaaactgagagataggggtgtgtcagagtttgaaagacaaactatttgaagacagaaactctagtggagcttgattattagccaaaatacagaatttactattaaagaagagggtccagaatcctatcccaagaagttacttgggcatccaaaaacagatcgtaagacacattgaaagtgtggaactcagactttgtataaggcttttgtatcttgagaaggaaaatttaaaaccttaggaggattgggagcttcacgagttcatgatccttctctgcaccaagtttacacgtgctaacctttctgctttagtagctaaacttttgattccatgaaatcaaaaccttttaattgctttctctattggtgatctttaagagataacttgggcttattggtgtcagtctgtaaagaaaccaaactctgaagtgtgatactatctattgaattagacaggggaaaagctaattagtactatagtgagactggagtgcttctcagatgttacctagtggcaactgaggatgtggaagtttacagatttttagacagtctatcaaattacaatcttcagaaaaaagtatttccaatgactgcaatgtttcgcctctatcaactannnnnnnnnnnnnnnnnnnnnnnnnnnnnnncctggccaacatggcaaaaccccatctctaccaaaaatacaaaaatttgctgggcatgatggcgcacgcctgtaatcccagctactcaggaggctgaggcaggagaatcgcttgaacctagtaggtggaggttgcagtgagccgagattgtgccactgcactccagcctgggtgacagagtcagagtctgtctgaaaaagaaaaaaaaaaaagaaaaaagaaaagaaatgttacttttgcactttcgtggccttggctagttttaaatgctttttcattggtagaaggcttacagagatcatgaaacattaatagttaccatttattgtgtactctttctgtgccaagtactgtgctaaatattttaggcatattatcacagtcagtccttacagcactcctttgaggaacatggcattttccccaaaatacatttttaagaacccttgagatttcaaagatcaagaccagagcaggaagggaaagctctgggtctgaaccaggtctgtctgccaccaaaacaccactcttgatagggatgatgatctggaacagtggtaaaatctggcataattcaaacacttaaactagtttgcgtatatgtataaaattcctagaattccttataaaacacacttatgacattgaagttcagtaacttcccatgttccatataagccacagaaatattgatttgccacagtgaaagagttagtggaagctattgggccatccaaaagaagctaaggctgaaaaggctacatatggtatgattccaagtacatgacatcgtggaaaaggcaaaactacagagagtaaaaggatcagtggttgccaagggctaaggggagggagggatgaataggtggagcatggaggatttttaggaatgtgaaactattctggatgatactgtcatagtggattatacattcgtcaaaatacagaatgtgcaacaccaacagtgagccatcacatgaactatggattatagttattaataacatatggatattggctcatccattgtaacaaatgctccacactaatgtaagacattaatgggcataggtgaggggctatacggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatctactcaccttggccttccagagtgctaggattacaggcaggattcccttcatttttaaaattactgaccccaggccacaagacatcaatcatggtaaaaattccactgtccttgatggcacacttgatattttgctagctctgtggatgagcttttccttatctgttttctctctcccattccagctgccagcatgctagctgcttacgtttggtctacccactcccagcctgtcctacctcctgccatcagattaatcttcctgaaatggagtcctgagtctatcattcccctggggaaaaacctttgttcatgctactctccctcctcggtttctccatcacctgcatcacgtggtctgtcctctctgaaatctcgttagaagcagtcattgaaatcagaagtgacctctatcatagtatgttgtttgtagcttgttgacatttgttcagacactcttgcattaaacatcacgttgtacttgcctccccctccccctcagttggactgtaggttacctgatggttaagactaagactgttttccctccaccttggtttttgaatcacctggagtgcttttaatacagtgggtccttgaaaaatgcattcagctgaattcagtgtgtctgtgttctcagtctatccagagctctgctattaggtgaaatggaagagaaactcattgcctatatgactgttattgtgacgtacagtgcaatagctgatatgtttctgacattagaatgctctcatttattggtatttgatcactggcatattatatttgggatttgtagccctactttgactgctctactatgtattgaatgaagagtttagattggtattaatatgttttaaccagtacattttaaaccagtcaaacatctaaccacatgcaaaagaagggcacgtacttatcatgcttcttcacatgcttaccatgcttgttacatgacaaagggttgcctttacctatttttccttttagaagattgaaaatatttaaatgatgctgttgttttgatcactgttttacattctttgaagattgaggaatctggtgactattttatcaagcgatttttctcctggagttttcttttttaaccttttgtggcttaattccagtaaaagattttcaagtaagtgaaaatgagttgcatatatccattaagtctttttctttatcttaagtaaaagggggagatgaagtagaaatatttagcaactcagttattgcctctagcatttaagagttcagcttgaagaaaagtagttgacttgaaagaatatgacttaaggacagaggtgagaaggagataaagaagtgcatctataggaacaaatttgtttcttatttgctttaaaaattgtttaagtaaagcacatttcaccaagttgaatttcagcttgagagatgtccagatgtgaaacggcaaaactccaaatactgcatatactgtgcttttagaaaaataaagtagtttttttgttttgttttctttttattctttaaaaatgaaggtcaagaaaaatatcagcaggaaagtcagaagtggatttagatatataaatgtcctcattgaggaacaagggggtgatcctttttttttttttttttttttttttgaggtagagtcttactctgttacccaggctggagtgcaatggcgagatcatggctcactgcagccttgacctcccaggctcaagcaattgttccacttcagcctcttgagtagctgggactatgcgtgtgccaccatgcctggataatgtttgtgttttttacagagacggggttttgccatgttgtccaggctgtctagaactccagggcttaagcaatcctcccgcctcagcctcccagagttctgagattacaggcatgagctactacacccagccagggatgatctttttaaaaggaagtatagtttaataataatatgcagaaaataggcttaagattttagttgactataaacttaatataaatctataatgtaatgtggttgcccgaaccattcttaaaatattaggttgtttcagtatgttttactgttttgaggaaagataagcatcctattaagatttcaggtggacatactttttaagcttttgtatttgtttcacttataaaaatcatcaagctataacaaaacttaagtcaacttgtgatgtttgccttccaacagtagctgatggcatatttttttcaagttcatactggattatagttgaattaaaagttatttcttaattctccaggataatagaaacattaattgttcagagaaactccaaatataaggaactttagagaaaagatgtgtttgagtatgtgcgtgtgttgggggagggggttgccggaatacatgatggaaacttgtctaaagaattctagtgctttaactagagcagaaaatagagcagaaaatagccacagatgttaactgacggttgaacatgtgtgaattggatctttgaaaatttacacatggattttctttgcaagttatgtgcttcacagagaagaaaggtatatgttcccttttgcatgtctgcttgctttccaaagactagctgctatcttaacttaaaaaattttatttttcatgccagaaaacattgtattttaaaaattgataaagacactccatttgtaagtacttgttttaaagtaatatatctagaaggcaagatagtggccccctttcctgtcaatgtggagttccaaagcagctgaaggtagaaattaacagtcggtaagagagctatcaaaagaaaaccaggagccagagaccaactactggtagtcagtagtaattctgattgtctactcaatctgccaaggaaaactaaatacattttttcccctgagtcaggttaacacttaaagtataaaaggaagtacattcaggatctcatatgccatagttcaaaatatttttttactttatatatcatcagatacatacgtgcacacacatgtaaatatgcatcatccatgggatgtgatctcagggagataagtaccaactcatatattccttttaaacccactcaccattgccccaatttttgttccttctaactgcattcaactcttcaattcataatcatacagattcatgcaaataacagtaacgtgtttacctggttttacattctaatgttctatttctagaactgcttaaaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgtaagttcaccagaggagttgggaattgggaagagagttgggtagcaacaactagaagttagatccatcgcatacgagtatgcgattgttgaattacatccttacctggaaaatgagctgttgtaagggttaaatgaaaacctatctaaagcacctattttagagtaggaactcactaagatggtagggctgctgcttttataaggggactgtattagtccattttcacgctgccgataaagacatacctgagactgggcaatttacgaaataaagacgtttattttattttatttattttttgagacaagagtcttgctctatcacccaggctggagtgcagtggcatgatctcagctcactgcaacctccgcctcctgggttcaagagattcttctgcctcagcctcccaagtagttgggaccaccaggcacgcaccaccatgcccaggtaatttttctgtatttttttagtagagacggggtttcaccatgttggccgggctggtctcaaactcctgaccttaggtgatctgctcaccttggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggcaaaaatagagagcttgtgcaggagaactcctctttttaaaaccatcagatctcgtgagacttattcattatcatgagaacagcacaggaaagacttgcccccatgattcaattacctccaaccagcccctcccacaacacgtgggaattcaagataagatttgggtggggacacagccaaaccatatcagggacataagtggaagaagggatataaatagagtttaggatttcaactttgatgtatgtaagtaatggcggttcttctgggtgctgcttggcagtaattgaacggaggttatttgcccaaagtttctttgaatttatcagctatttaccaaacactattgatggagttgacaggaccacaaaaaagactcacagcattttcatctgattcctagttttcaggagaaaaattaaagttctttgggagaactttaaaatgttacatttaaatatagttaataaaaaatggcttttgggtccagtgttaacgttagtaaattaatgtgattgagtttcaagtttttggcttgtgcatgcttaaaactttgtgagtcaagaaattcctattataaatttattatcttaaaaataagatctgctcccataccagagaagatgagacaatgagtctaccatcctaacaaacccaacacagatatgtttcaaatctttttccatctctttttattatttttttaagtttacatacatgaattcattttttggtgtaaaattgcacaagttttaacttatatattcctgtaatcaccaccaccacactaaggatactaaactgctacattattcctaaaagtagcccttgtgctacttctcagtaattaagcacaaccttcctctactccaaacccttggcaactactgatctatggttttactttttccagaatatcacatgaatggattcataaagcatgtaatcttttaagactggcagcctttattcaacgtagtgcatttgagatttatccatgttgtgtgtaatgatatgttcctttttattgctggatagtattgccttggagagagataccacagtttgtttggaggacatgtgggatgttttcagttattgctgattatgaatagagctgtcatagacattcgtatacagagttttgtgtgaatatagttttttatttctatgggataagtatctagcagtactgggtcatatggaagatgtatggttaactttataataaatgaacaaaccattttccaggatggccgtgccattttgcattcgtgccagcaatatatgtgagttctatttttttctgcaacttcctcacacttgatattaagctttttgttttagccattctaacagatatgtggtagtatctcagtgtagtttattgttttgcatttttctaatggctgattattttagctatttaaactcctttgacatttcatatagaagttttatttgctcatttggtaaactatctgctcaactcttttgcccattctttaaaattcggctttcttattgttgagttctgtgagttcttcgtatatttggattcaagttctttgttggatatataaaaagcaagtattttcttttagtgtgtagcttgtctttttactcttatcagaatctttcaaagagcaaaagtctttaatttcaataaagtccaatttatctttttttttttcattaatggtttgtgcttttggtgtcatatctaaaaactctttgcctaatccaaagccacagagattccctgggtgtttttttttcccaagagttttatgttttacatgtaggtctgtaacaatttcgggttaatttttatataagatgtaaggtataagttaaggggggttttttgcctgtggatttttaattatctcagcaccacttgttgaaaagactactccttctccattgaattgcctttatacctttgtcaaaaaccagttgaccatatttagtagagacggggtttctccatgttggtcaggctggtctcgaactcccgacctcaggagatctgcccgcctcagccttccaaagtgctgggattacaagcgtgagccaccgcgcctggcgcattatagtaagtcttaaaactgggtagtatgagtactctaacttttgttttttcaaaattattttagctatttaaattcctttgccattttcatgtataaagtttattattggcttgtctatcccttgaaaaaattctgctaggattttgattggaattgcattaaatctatagatcactttgagaagtgacaactgtgttagatcttcaagtccatgaacatcataggtctctcctctttttttttttttttttttttgaaacggagtctcactctgtcacgcaggctggagtgcagtgagtggcacgatctcggctcactgccgactccgcctcccaggttcaagcgattttccttcgtcagcctcccgagtggatgggattacaggcacacgccaccatgcccggctaattttttgtatttttagtagaggcgaggtttcaccatgctggccaggctggtctcaaattccttacctcatgttccacccgcctcagcctcccaaagtactgggattacaggcatgtgccaccacgcccggcctaggtctctccttttatctagattgtctctgacttctttcatcagtgttttatagtttttatctctctttaaagttgaagaatccattgattctgatgtttgggggttttttgtttgttttttttacctttcttcctaacagaaatgttttcagaatctgatttaagtttcttttactgcagtaggtacactagaaaacataattatttgtccagatctccatcttatttagtgttggacccaggccctcaatgacagaaggtcccctttaatagggcagtgactatgtgtaccaattccacgggtctagccagcttttcataagtgacaacagaccagagagcatacttacgtcactatttcctatttctctcatctttattttcagttacagtttctgtctttggggaaaagcaggcaaaatctaatttgtaatggatagaactagctgtccacttaaacaatagaaaactgagtcataaattctgtctttataaaactcctccatacttttggaaaatgactcacttttaggcagcgtctgccatagatatttgccagaaagtgatctaacttggataagcttgatgctttgtacaagtttcagagcccctgtagagaaagctcttaggaaccagagaccatcgtgtgcctgtctgtgtcccgtgactttcagtccatcaacacacgtcactgtagcattttggaatgttctggttcagttgctctcagatgttagctacttcagaaccacctggagggcttgttagaacacagatgattgtgtaccactcccagaatttctggttctatagatctgggataggtctgagaatttacattttgaataagttccaggcattactgaggctgctagtttggggcctgcttggagatcaattcctctaatttctgtgtttgtgtcattcaaaagtaattgataattaaaaaaaaaaatgcaaccaacagtaatctctataaaatcatatatgtttacaattaaatcattcttacaagtaatgagatggtatggatttgttctcaagttattggatggaaacagaaacttctccactaaggagccctgtccatagctgatgtgagagagaaaacaaagctgggccacattgctttctgccttcttcttttatgtaaccaggagggagcatatccctagaattttttttttttttttctaaaggcggagtgtttctctgtcgcccagtctggagtacagtggcgcaatctcggctcactgcaacctctgcctcccaagttcaaccaattcttctacctcagcctcctgagtagctgggattataggtgcctgccatcatgccctgctaatttttgtatttttagtagagatggagtttcgccatgttggccaggctggtcttgaactccagacctcaagtgatccacccacctcggcctcccaaagtgctgggattatgggcatgagccaccgcgcctggccatttaacagcttaaggttgggtctcaagtcctatttcttacctcaaggaaatgtacgatgtttatatttatttctttcatttaggcatgctaaattctgtatattgacagcagacttaacttgaatgcagaaaggagaattcagcagcactcaaaatgaatttacaacgtgacagtgtatgattcattctaaaatgcttaccattgactaaaagctttactcctatgtaccttgatagagcagagatagtatggtagagtagaaagatcaatcattaaccaaggaaatctgttctgtgtgccttggacactcaatacaagggccttggaagccacttactttgaatatcactttagtcaggaaattgaggagtttttggaatcgatctttttaagtttctttttggccttgagattttatgtttttatgtttctatttatttctgcctaagtaaatgaccccgttttctttcttaccaccatccatccccattacaaattacatgcctttttgtaaaagatcttaacctcagaaggagaggaaatgcaatcagcaaactcacaaattttctttcagtcttaattttcttttgcctttttttttttttttttttttctgtgaggcaaggtctcactctgctgcccaggctggaatgcagtggtgtgatcatggcttactgcagcctcaacctcccatgctcaagtgattctcccagttcagcctcccaagtaactgggaccaaaggcaggcaccaccacactctgctaatttaaaaaaaaaaaattttgtaagggggagagtctctctatgctgctggggctgttcttgaactcctaggctcaagcgatcctccctcttggcttcctaaattgctgggattacagccattgaaccaccacgaccagccttaattttcactgggaaagattattgaactgtatgctgtgttcattagcaatctcgccatatcaaatttttgctacctgggttgaaacagggaatttgcatgtctttctaaaatgcatgcatttttgtctgcagatgtcaaataggcaaggcacagctgaataagacatggaaatgtagcttgttacaagtatagtgtgtggaggaatttctaatctctttctgtccaatcagctatgcagtaagagctcagttttcatcctctagccctgaatagaatgggggcatcatcagcaatctattctggagcatacatttttaaagtgctttgaagagaaaaattttcatctactaagtagtgaagaactcctgattaataatcgcatttcttttaatttgtttaaattgagatgattaggagaaaacaaagatgggggaaagattcaggattttagagagttattacatcctgattcgggtgattatccgtactctccacctcggacacactgtgagctttatttacgtacattttgaggcagacaagattagctagatcccaggtgtccattaccctgtgaccttttaccaatacaggtaagaaatcttaaactcaagcagaaacctgtacacagctgatctctttaggagtctataaatctggggcatgtgctgtgagatgtgtgcaagccttgttgggtcactctctgttaggagaaggccccccagttaaggcaaaggacaacccaacctattcccaaattgacctgtgtagcagaatcagctttggtcttaataatgcaaggaatcaaagagcctttggtgttgaatgaagtatgctataccttagccagaagcctcacttctgacctgtgcttgatatcctgtgtattgtgacttgattatccatacatttgacttttcaagactccctgaggctgggataattagaatagcctggtaaagccatttaagagttttttaaataacaatttagggactgtagtagggttcctgttgccactgttctccaacagcacccagcatttgagaatcagttagtaccgatccgatccagtgatatataagcaaaaattctgattgtgggaaaacagaagagaaggcagtgttggctgttcaagccacatgtctaggcataaatggggaggccatgatttctcactgcttttgacatgaaaccacaaagaatgtctttgttaagaatcaaaaaacataagagttgaacaagccaaaggaagaaatgatatcatggcctagttgaatcaactaagaaatatttttatgttaaagaaattctttaaccttataactagggcattcacattcttgagtatattgagtggaagattcctctgaaaagaaagttcacatcaatagcctttgaaagatttagggaatattttgcagtgtaagattcgttatttaaaatctgaaatatatttttccttcctacgactcttctatgtgtttatagtaacatcaagacaatgacatcctgcaattgcactagaatgtattacaaatgcatgccttgtgccaatgtattcaacaaggaagctatctttttcctctgtcttattttcattgaggaaacccatgcctatgcattatgcatgcgagtctggtgtggtgtttaagtaacctcccatgggactgccgtgagactgctgtgagtctggatttgggggagagctgtgtcttggcattttcaaatataagagaaggatgttacctgatactcagagaatcttggctgaagcttagcatccctctctggattagcttagtgttgtttcatgatactattttttgttttaaccagttgtgccattgtttgctgatggaaattgttacatgccagccggcaatgctagggtttcagataaatagaatatcagcatcattcttcatatcagcaaaatgataagttgtggttttgcccatcatacttaaagctaatttaggacttaaaatctggagccatgcaaatttataagaactgcttaataggagacagtgcattagttgatttagtggttgaatttccagtgaattttttttttttaattctgtgtagggacccattttaagataatctggaaaagaagagaaccagggaggaaaatacagtgtgaggcaggctgggtggcaaaatggaaagagaggtaggctttgggattaaataaagccagtagttctcatattttctgtatggcaagagctcctttagcaggctgaaagttctgtggaacccctctcagaatatttttaaatgcataaaataagctggactacaaagaaagccagttgtattgaaaagttaccaaaatatttaagaaaacacttatggcacagtagtatgtgcttttttactaacacacaaaataacaagttctagttgtgggacctaatgacttctatagttttgaaatggtgatgggcataaatgatatttcacaattggcaacaactgtgaagtgatataaaaatacgggtatttctgttggagacaaggtcatagatactgccaatatctggtgggtggtccatacattcataattgaaggaaaatgctaaattgtagaggctaatgcaaagtaaaatgtaattattttcctgtcccagtccccaaaacaagagcttgtggatctcagattaagatcccctgggttagaagaacttggctagaatattaacatagccttttactggctgtaccaccttaggcaagttaacctcaaaaagtctatttcctcatttataaaagcgttgatgagacctactttgtacagttgtggaaaggcataggaagatcatgcctagcctcactctttgtgtacaaatgatgacttgaagcacgttaggtcttctggccagatttcttttggcagtgatagaataaaatgacacttgctacacttgctgagaggtaggggcagactttatgctaggcagggaactcaaagattacactgaaagcagaaaactcctttacctttagattttcttaagagttgtcgacccttaaggagtgtcagaagtgggatataatatggagaaaagagaaagcattataaaatatgtggaaaggagtctattaggaaatttcctcctggccttgttgatccaaagcctttagttgcaaagaaacagctttttgttcattataaatgttttaacaataactagaactggtgttgccatccaccccatttgggcatgagcttttttcttccaccggagacgtaggtccccagatgattgattggctgcaaagtatggacatgtcttgattgtttctagaaggggcgggaccactgccttcttggattgtaactactacacctgcagagccccaaaaggtctggctactctattagattaaggtttaacatgtgataatagtctagttttattacttaaggggaaactcaaaagtgtggataccttgattttgtctggatattttattaagcacatgtacctataggccataaggatgtgttctttttctggctggccactgagtgtgtctgtgcatgatgctgggcagctcttcctttctccctgacagcttttaaaggcaggatactgagtgtttgatccatcatctcagtgagggtgtgaaatcagtgaggcaatggagcttcagggtttccttgtcccttgggtcatggctaacaccccatttaatgtctccttttcatcaaaaccagatttgtcgtctcacttatttcccagtgtctggccaagatagtgatctttatgaaaacaaactggaagtaatgcaagccagaaaagatgggagagcttcgcctctgcagaaggaagctgttaaggggaacagatggagacagggtctaaacagcttcaagaaagtgtgcacttgctagtctcagaggtgctccctgtcccccaagagctgtttgaatcaggagctgcttaaggacctgaatgacttctccaactctgccagggatccttcattagccctgcacttctgagatcactcagtgccccccatagacctctcctgctcttctgaatgcagaagcaggagtgggatataaagtgaaaatatagtaaattctaacctagtgtggcttgaaaaagaagttgcaatttatagagaattgccaaatatactgtgatggatcactaattttcaacatataataatttattaaaacactaaggatgacgtctataattgtcgtattaatctctgaaggtatcaggactttacaaggttcctgtgccttggccatcattgtgatcatttatagtgactaatcaatttgacaactatgtggcatatgaatggtaagcattcttggcaagcaaagggaagaaatgtcttatctgcatttaccagatctcatgtcttggctgtttgcagttatttacccctttcttccattaatctaaacttccaagaccctaagctcacattgtatcctgtattaacttgctaactaacctcctgtttttgtggttttctttctctgatctaatcagtccaatcagaagaaagattacacttacagatgcacatgctgatgtcatgacatcatcctcttatttaaggatctccctttgcttccctatcaagtctcaacttctctggccatctagacctcaggtgaggtccttttatcttagcgaccttgttctttgattcactgacatggatcttgggcgccattaagatggtttatttgttgtcagacaccctttgttcttttctgtcctttcactgtggaatttttctcttggccaaattctatccattcttggcccacactgccttcctagcattcttgtatccctctctcactgtctcgcctgcacaatttggtatatttggtttactattggtcttctgttatttcacatattacttgtttttccagcaagtcagagttccttaatagaaagtattctgctctatttattttatatattataattcttagcaaagcaccagcacacagtaagtgttcaataaatatttagaggaagcaggtaaaaggtgtcatgagttagatatttccaataggaggagatggacccttgatggggtcaaccagcatcaagtgtgcctcttttacaaaaccaggaacccaatcttctccttttttcaaagttgatccaggcttatggaattcagttcataaaaaccaagctcaagggagtgaatgccaattcaataacaatgaaaagtctaacctctaggtaacagaaatatctgtgtcagccattcattgcatcctttttcttgtagcaaggcttccagcaggcgactctagggtcattcgtggccaatatgattcatttgcaccagctctgaagcctagtgcatgccatttagactctagggacaccttgcaaagttcttgctttttactttcaccccttcctcatagatgactctttgctttttaaaggaattgaagggctattctatagacaggagtaaagcctgttcagagatgttctaaacaccagattttgtttgcttgagaagcaaagagaagataatttagacaagggcaaaagcaccatgagaagactttgaaacagttttacccaagttgtaactggagaagaagacttgatgagtcttgtgaattaggcagatagcattcatgagctggagagaatgggaaatgcagagtgcaagggagattagttttgagggagcaggtggcagtgttgagtgatgctgaggggagatcagaatgttgaaagagaagtatgactgatatctggttagtttctttgttttgtctttcttgagctgctttcaccaatgatgtacatatgaaaaagggatgttatgaataagttaccttcaaactaaattaactgagtggtttttacatggagcttcaggatatccagaagcatatgtctaggaataaaaatggttatttttgagggctgggcgcagtggctcatgcctgtaatcccagcactttgggaggcaaaggtgggcagatcatgaggtcaggagttcgagatcagcctggccaacatggtgaaaccccatctctactaaaaatacaaaaattagcctggtgtagtggcgcacgcctgtaatcccagctagtcaagaggctgaggcgggagaattgcttgaacccgggaggcgaaggctgcagtgagccgagatcgcgccactgcacttcagcctgggtgacagaccaagactccctctcggaataataataataataataataataataataataataataataatggttatttttaaagtaatatttaatgtgaaattcataagacttgaaattgggggaaattggaagggattaattcctgtcctttgactcattgtcctttaacacagattagtatttttgcaatcttagaattatgtatttatcaggggcttctttttcctgtggacagtgtcaaggggtgttttgaagtgacttgagcccaggaagtctgtttggataaacactgatggactgatgtagaacagtttatcatctctgagcaactggtaatcactcaaacacatgtaagaagctcagtggttgctttttgcaactatcaatcatgatggttgtgtaatgcaaataggagtaaagaaggtttgattagtctgtaacagcagctggcacattttttttgtaaggggctggatggttttgtgggctgtgtggactctgtccttatagtttgaaagcagccataggccataaacaaatgtgtgcagcagagtttgaataaaactttatagaaaatgaagtttgattttcatgtaaactaatgtgttatgctattcttttttaaaaactttccagccattaaaaaatctaaaaaatatccttgacccacaggctgtatgtgccaatccctggtacataacatagaataggatgagtttcgggaagaaacagtacaaaatacaggctgctatatgtttgcaatagtgtgaaaagaaagtttacccagcgttttcttggcaactgagacttcttgtaccattcattttcaaaagtcatttcaaaaccaggaattttttcctaatttctccaaactgattatatcagctttctaaaatatttggtgtgtaatcaaagtacagttttgttgctggatttcaaaggctgcagtttagtactaggtttctcctgtttcaaaagaaattgtgttatgtacataaatatgtacgtgcacatgcacacacaggagggctctttaccttaacaatttgaagttcttctaatttcctttttgttcactactaagtgattctttattctccatgtgtcagtttatttccagatgtacatcttagttttcttctggtaaagtcctgtttcttcctgtccttgctgatagaggaaaccacataaagcatttcttaaaattaagaaaacaatgtcacttcagctgtgaatcctgtaaactttaagaatccattcagaatgcacttgaatgggaacattttgtaaagaaagctgaaaaatggcagtcagatttttacagaacagcccaaaggggtgttttgtgtgctaatgattagaacttttgcagattcttgcttagtaattaggactgacagatgggctctgtattagtccattttgtgctgctataacaaaacacccaagactaggtaatttgtaaggaacagaaatttatttctttcagttctggaggctgggagtttcaaatcaaagtaccaggaggttagggcccagtctctctgcttccaagatggtgccttaaatgctgcatcctctggaggagaacaccatgtcctcgggtggcagaggggcagaagagagagaacctactcctgcaagcttgcctttttaattttttaattttaatgtttttagagacagggtctctgctctgttgcccatgttggagtgcaatgacatgatcatagctcactgtaacttcaaacccctaggctcaagcaatccacgtgagtagctaggactacaagtgtgtgccaccatgcccagataatttttatttatttatttatttattttgagggacagggttttgctatgttgtccaggctagctcaagctcttttgatagcagcattaatctactcatgagggttgtaccgttatgacgtcaatacctcccattaggctgcacctcccaacactgctgcattggggattaagtttccaacatgcaaatttggaggacatattcagactatagaaggctctgttcctcggaacactgtctttttaaaaagaagtgcatttaattattcaaagaatacatgattatatttttgtcttttaaaataatatggataaattgaatttctcatttgaccctgtctcctccactcaatacttcttcccttcccagagataatgtcttagtctatccaggctgctataacaaaatgtcataaactgggtggcttagaaaccacagaaatttatttctcacaattcaggagactgggaagtccaagatcaagacattggtagattcggtatctggtgagggtctacttcctcatagatggctgtctgctcacgtaatctcacctggtggacagagccagggatctctctagtgccattcatgagggctccaccctcatggcctaatggcctcccacaggccatatctcctaatactgtcatattctgggttaagattttagcataggagtttgagggggacataagcattcagttcattgcgggcaaccattgctatcaatgttttgtaatcattttctgtgtgtttatgtaaataaatgttcatgaagtatgtttcctaatagaaaccatatgagaccaggcatgctggcgcatgtctatagtcccagatactcaagaggctgaattgcgagcattgcttgaggctaggagtttgagtccagtctgggtaacataacaagaccttatcattataagatgaaaaagaaaaaaaacccatatggatgttatatcctacagattataatgaaaattgcttttttttcctacttgatccatgttggagaacacaggtcagcatttttcttttgccatgctttcctgaggattgggtgggtgggggggtagaaggtgatagaaaaccctttgcatatgatatggtggtaagacagcctcctatcctgtaggcgtggtcaaggtttaaagctgactatctcatggggtgctcatgagggttcttcaaagactctgtcatctgtgtcagtttctgggagtctaggggtccaccaccagtcctgccactgtgatcatgttgccctttcagacagccctagaggactggacctgaaacaagccctggactggctcgttcttgtcggaggaccactccgtgcccttggaaacatcaggcactctttgcccccacacccacagcctctgagaggatggcccagacccactgcagcagcaatttcccttcactcccatgccaccagggcagctagccacactgcctctcatgttccaggtccccagagaaggggtgccagcacctctctgtgtctctttaatggtggagcactcaaatcaagcccccaactggcctcactgaaatccggcttgtgaagtaagaagctgatattcctactctttccccaatgggaagagggtgctgaatggggatctcagtgcagctctttccaaagaaatcctccctcacatcttgctcttgaccctccctgtgggagaggagcttaagcctagttcttagttatctcctttttgaagggcagatgggtgttttttttttaactcactttggtatctgatattgctagcatcttgtgttagagccaaaacttgcagtgtagcatcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatttttttatttttttcttgagatggagtctcgctctgtcgcccaggcttgagtgcagtggcacgatcttggctcactgcaagctctgccccctgggttcatgccattctcctgcctcagcctcccgagtagctgggactacaggcacccaccacacctggctaattttttgtattttttagtagagacggggtttcaccgtgttagccaggatggtctcaatctcctgacctcatgatccgcctgcttcggcctcccaaagtgctgggattataggcgtgagccaccgcgcctggcttgccctattattttaaaaattgtctctatttattgatttgtaattctttatatattctgaatacgaaccctttgttacatagcaaatattttctcccagcttggccttgtcttttaactttgggaaattggactacatcaaaggcacgatgaataatgactttgtgttgtgtctggcttaaaaaggccatccttctccagggttataaacaccttctcctatatattcttctcatgctgtaatagttgacattttacagtgttttgagggttaatccatcagggatattttcatgaatagtagaactctaacttaattttttcccacatggagagctagttatttcaacactgtttgtggaaagccagtagcatggtgtgtggccactagaataagggtagtcaaagggctaaagtggctggagtggggagaatgacagataattgctaaacatcctactgatcaaggttagatgacttctcagtctagaagatacatacccttctgagaaagccccctgtaggagtgaacacccaacatcctttgaccggttttactatcagaacatttacatacaggcagaactaaaatctgtgattatctggatgagaaaacagttgtaggcaacttactcatttttctgaacaagaaaaggttctacataattacgttctctatgaatcttttatcagatttaatagttaagtctcttcaaagaacatgagatattctttttttaaagtgagcctatgatttatttatcctcattaatacttgttttccccaacccttccaagctgtttgggaatgttgtgtgtcagggatcagtgaaggtcatgaagatgcctttaaggcctgattaacctgatttgaaaaactttaaaactgaccttctctacatctccccattattgtcctacgtttcacagtcagatcaaggcttattatcctttccactggggaagtagcccaaatcatagtgtgagtgaaaaacatttactaagaagtgtgagtcttttaaaccctcttgtgtttcttttaagaaattaaaaccaataatgactatcagttgaatttggttgttccacctttattttatcaaaatccttggacatacattaaagtatttgtcccttgggcaggtgccaaggctatgaagttggagcgtggcatgttctagaagcagaaagaaggctggtgaggtagggacacagcaggtagggagtagagtgaggccaagccccaggtcagggctggacctcagggcctaggtccaggtgaaagcactgggcatgatgctgagggcagtagatgctgtgggaggattttaagcagggtgacaagatcaggcttgtactagatgagaacgttggctgtgtaaagatagattgacagtaagcaagagtgaatccagaaaaaaataatctagaaacctgttgcagtgatacaggtgagggatactttgcctttattggatttgaaagtataaaaaaaaaatgaacatctgttgtttagagtaaaagccctgtaaggtatggtataaaatgaaacattttcaaaaatgcccatgtcacaaaaaaattttttttaaatcagctctgtgcaggaccagctacctaatttgcagggccctcactgccaaatgaaaccgtgggacctcttgtgcaaaaataaaataatttcaagatggcaacagcagagcattcaacgaacatgggaccctgtgtgattgctatgcggcacgccctgggtctgtgtgacaaaatggcttgagtcagtccctgagaagcttctccttgcctgttccataaaaaggctgatgatgactcctgtggtctaggcagagaggtaaagataagctaagcttgtgtagctactactgttattttgtttgtttgtttgtttagactgcttcttgcagagcagggctaccctaccggcagtgcgcccagagtaacctgttctttaactcaaaggctttgttaaccttaatacaatgtaaattacagagaatgtcggaaacaaaactggcagcaggtatttatgactagaggaggtgagtagggatggtgatgggaattaagagaattgttttttgttcttattggctgtggttgatgaaaacataaactaggagaaggaaataacattaacattaaatttgttccttagaactatttatttctcctagcacgtacccatttacctggctttccaggagcatattctttttttttttttttttgagatggcagagttttgctcatgtcacctaggctggagtgaagtggcacaatctcggctcactgcaacctccacctcctgggttcaagcgattgtcctgcctcagcctcccaagtagctgggattacaggtgccagccaccacgtctggctaatttttttgtatttttagtagagacagggtttcatcatgttggccaggctgatctcaaactacagacctcaggtgatccacccacctcagcctcccaaagtgcggggatcacaggcgtgagctaccacgcctggcttccaggagcatattcttaaacagtttggagggaaaatggtttgggcaaaagacttcctgttaaattgtgtgctgctttctttttcttttttaaagaactggtaatacagccgggcacggtggctcacgcctgtaatcccagcactttgggaggccaaggtgggtggatcacctgaggtcaggagttcaagaccagcctgaccaacatggcaaaaccccatctctactaaaaatacaaaattagccaggtgtggtggtgcacgcctgtaatcccagctactctggaggctgaggcagggagaatcacctgaacccagaaggtgaaggttgtagtgagccaagattgtgccattgcactccagcttgggcaacaagagtgaaactccgtctccaaaaaaaaaaaaaaaaatttggtaagacatggcttttggctttttatctccttctccacttattttttacctgtggaaaatgattcagaaaccggacagagctttgcataagaggtgtaaattgtgaagttccttaactctgaaaattgaagacataaatatatagaattttcccttctagtatcactgagggaagaatagtggctgtgggaatttggtagtttgggatattctgaaattgtttgctgtcattttcatttgtaataagtttacttggcaagttctgtaccaaagctatcttgagggcaaagtttgtgaacaccttttaaaacacagtttacgtttctagaaaaaagatcttatgcttactaaacaaaattcctttcagcagttttcaatgactcagagccctgatatttgcatagtgattcggccaatggaagttgactttgagataattttggttaagataagtctcctggtttatgcttttaaaaggttaggttaataaaggcctgtccggaatagtataatgtgcagtggtttccagccacttttgattatctcaaatgccacctatagagctgggtagtaatagtgatattaaggtattatttcagagggacccacaaggccaactttggactcttgacattaaacactgcaaaattccaaagtgcagacagcttggcaagtttgagttctggtgcattctgttcacaactatttttttttttttttcaatagtgcttttgtctttctgctaaaggtcagactgtagttgtcgagtactggtattgttcctgaattattcgggaagagggtggaaatattgacttagtttttctattataatatcctatcacaatgctggattttaatgatttaaaaatgtaaataaaagtatttgcatttttagactacttgtgagcagctgccaattctaaaatcactatgggtgtttgcagctcttttctgggctcattttacccatctttgatcttctatcaacatgcaggtctgtgtgatgggctagaaccagcatgtattttgtttagagtcagactttgttggaatcctggtgtcacaatttggaccctcggggcagcacccagattaagtaacctctgtaatatgggggtgccaccactgctttgcagagctgttagataaagtaatgcatattgcctgctacaaagtagatgttgtatttgagtgtagaggaggggtgtatttgcccattctcatgatgctaataaagatatacctgagactgggtaatttataaagcaagaggtttaacagactcacagttccacatgcggctaggaaggcctcacaatcacggcagaggatgaaggaagagcaaaagtatttcttacatggcagcgggcaagagagaacttgttcaggggaactcctctttatcaatccatcagatctcgtgagacttatttgctgtcacgagaacagcacaagaaagacccgcctccatgatccaattaccttccactgggtcgctcccacgacatgtgggaattgtggaagtgacaattcaagatgagatttgggtggggacacagccaatccatatcaagggggggtaaggtttaagtgcagagccattgagtccaggctgctgccacgtactcttccagggcaatggaggtagtctgagtctgctccatggagagtggccatgagggacccagagctgacctctgcctgcctcaagccggattacaattctgttgggactgtttttcaactgcacccagctgatctagagagagtttataattgatgtgtgtttagctctgtgtcagcatcactggtttcttaaggagtctcactcaattcattggggctaaaaacatgaaatgggtttaactttctctaggcactgcttaccactgtgccctgttaaatccccccttccagtctctgaatggtggattgggcatcttctatcattctttcatctttccaaatctcctaatgttacatccagttcatcttctgtgcctctcctactctctcttctgagctctaggccctctgggatgctggggtggagaggagaggatggaaatggggagcaagggactagtaattatttaactcgccaagcggagttggtggtgagaaagtgcctctcgtagcctgctgcttttgtgtggtttgttctgatggtggggtgtctgctcaggtgatgtgtgactctcttggggctgtgtttggctttacctcagcctcgtttgtgagcagcctgtgcaaaggacagcagtgtccccctttggtattgctgggtgttcatgccccatcaggcttcaactcctccttctagtgagtgtcctggtgcttggcccatcagctgcctggcagcccaagggctcctgcccctctgacctcaacactccttcaaaaggaactgtgtgagttactgcagtcctgtctctctgtccaggggttgtagggaactgaactggagcgggaatattccagtcttctttcctggaacattcccttgaggctctgcttgcatgtggctccctcagtgggcctgccactcccgaatctctgactcaaaaatgggtaccagtctcatgctcatgggtgtgcccccactccagggactggatgccaagttccccctactccctgacatgctccgttctgctgcagtgccagcctggaagggagcgggaaactgtgaagtcttcagctcagccagcagtcagactaggagcaagatgctcatctctccttcttgcaggtatcctagtctctcctagtgattctcttggaagtcccccaacccctacctggttggggaagcagacagtaacctgcactagaaccttgccctccccataaagccaacatcaacctttctccttgtccttgcatgggaagaggggctgtggtcaggtagtaagactggtcctctgacctcctggggaagccatagggggcagtgtctgaccctacttgtttatggctttctgagtagggtacttagccctgttgtgctcagctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacctttctccggctcctcgcatggaagagggcctgtgcatacagctagtaagacatggtcactctgacctcactggggacacccataggacgccagtgtactgacctacttgtatatgactttcatgagtagggaacttagccctgtagtgctcagctagggcctgggcatgtattgtaaaaataagggaaacaagccgaagaagcgaaggagtccattttataaggagtattagtaagtattgctctttctagtagtgacccaggatgttcatgtccgtgtgcatccttttgcgtagcagtagacagagtagagggcaggagcaagcacataatacattacgtggcagttatgatgatcaggattcatgatacagtaggcttaaaatgataatatatcaaccttaggaaaggtatggtaaggggtactccagtggaacatcaccttatgaaattagctgcaggaattggaggttcaaagcgccccaagttttcttcagtttccccctcctgactctatgccagtgacttagaaatataaaggtgtgttctcttggatggattgtttgacttgctgcttcctcttcatattcacctaagaaatggacggtcaaaataaatggaaagtcttactttaaatagcagagttgatgattaggttcaggtaatctatttcattgttcatttattaagtagatacaagaaagaaaaaggaaaccactgggagggtatgagtgaaatggctagctctttttgggaaaagttaatctggtggcagagtatggaaactagatcatccaggggaagaggagttggaggtatggagcactagattataggtcagtgttcagaccagaggtcaaagggcctgaccacagtaagtggcagtggtagtgggaaggaggggatgaaatgagagagaggcacagagttgctggaagccaacaacggactggaatgagaacagggaatgactttgcagcattaatctgggatccatgaaaggagagggtaccatgaacagaagtaagggagttagaagaaaagaccaatttgagggtgcggaacatcagggctacccttggcctatagtgccttttcaagaaggaaaagatgttccctcctccaggcacaggacctggcctgtagcacacaggctggtctgggctaggttctggtgcacagtgtgccacctacacaaccatacatgatggccccggggaagattcctttagagcagcaaggttcccatggagtaagaaggcctcaacacttcatcaagggcatagccagactctaatgtcgaatgagtgatagtgcttattcctgtattgattgcagaaaaagccatcatgtaagaaaagcactccttttgacagacacctacctaatctacacatatcacagcttttcttttttttatcgtgatgaaatatatataatgtaaaatttaccattctaaccatttttaaatggacaatctagtggcattaagtacatttacaacattgtgcaacatcatcattctccatttccagaaatttttatcttgcaaagctgaaactctgttcccattaaaaataattccctattccccctcctcctagccccctggtaacctctattctactttctgcctctgtgatctgcctactttagatacctcatataagtggaatcatagaatatgtgtcctttggtgcccatctgactttttaacttagtgtcatgtcttcaagtttcatcgtgtggcatttatcagaattttattccttttcgtggccaaataactttgtattgtatggatatataccacattttgtttatctattcatctgttgctgggcacgtgagttgtttccatgttttggtgatcatgactgatgctgcagttaacatggggtgcaggtatatatttgagtctttgcttctaattctttggggatattataatacctatactggatcacaaagtaattctacgtttcactttttgaggagccaccaaactgttttccacagtggctgccccatcttacattcccactaacagttcataagtgtttcaacttctcatcatcctcaccatcatttgttattttctgtttctttaaaaccagtagccatcttaataaagtaatattgcattacagttttgatgtgcatttccctggtgtcccagttctacttttatatacctgcttgtcattaagaaagctctacttttcaagaatgctggaaagagcagctttcccccgctataaactcatagccaaccttcacttatatgagaacatgcagagcatagtttcatctcctttgaaatactgtaataagagttttagatgtatttgattcaacgtgcagaatgtttattttttgtgtgcgtgtatgtgtgtatgtgtttgagacagcgacttgttctgtcacccagactagcatgaagtggtgcaatcacagctcactgaaacctcaccctcttgggctgcagcaatgctcccacctcagccctctgagtaggtgggactatgggcatgcaacaccatgccatactaattaaaaaaaaaaattgatagagatggtgtcacactgctgggcacaagcagtcctcctgccttggcctcccaaagtgttgggattacaggcatgggccactgtgcccggccactatttttcagttagttgtgagcatttaaaaaaacagaagaactcataaaaaatctgaatcttccacttttcaagaaatcccaaaggtcaggcccttgtggtccacatttccacaagtagctgtgagctagagccaagttgcttacagcccccacccagccagcttcgttccttaccggtaccggcctcacccctgcaggtatctgtttccaagcccgccctgttagagtggattttctgaggctaaagttagtttggatttattccaacttatataaataatcgaggtgattagatatgactaatacttctgttctacctagctacttaatacctccactgacactttctttcctgataaaatctgaaatctcttcatttatccttgcatcccttgagccccttgagggacaggtcttatcaacagattggtttctactggttaaaagttgcattaaatttgtctcctcatacctggaacaattggatatcatgttttgcatctgcccatcaggtagatacacccttttagctctgccacattctaacatagagtggctcttctgtcattgccacctaattgtaggcctctgcttgctagttgtatccactgtttacgttatagagaaatcttttcacatatgtaaggactttatatctgtgtgtgtgcccattcatttaatagtctttgtatatgctagaattaaggcacaagaaatacaaatgtttcatgtctgtggtcaggaaatacagttagcaatggctgtagctgtttagattgtgaagatgataattggccgcttcagatcctgtgtcttacagataatcagtactggaaggtgtagggtgaagctgcgtcacagccatgaaatggaggcattgtgaaacccaagccggcccagaacaccctcgcagcatgatttgttattgcacagagctggctgtactgctgctcaagccatatttcctgaaactcaagaacgccagagtggaatagagttctcttataaccagctcctgttccctcaaaccttcgcatgacaccccttgtggttttcagcccgtctctctgtgtggtcgctaatgacttcattaaaggtgaagcatttcagtgatcaagagccagtgcttgatgatggttggagggacgtaaatgtgcaagcgggcctcagagcctaggtggaccggcctccttgccttcactctcaggcatcacggccctccagcatgtttctctgaggagctgttgatcatttgcccaggagatggagctgggaacctcgttgtcaccaagtcagtaccaatgatttgtgcttcctgtcagggaaacctgtggtgcatgtgtttgtcttctgcttctcagccagtttctttttgcatccatcaatctcttcttatctgtcttctttttcctgactgggcatagtagtcagttgtgagtttggacttgtattttcttattttgtaacagtttgtttcctggcttcatcttgcccctccctcctaaaagctccacttgtcttttatttctcaaggtagatgggacgaggttttttgttttttgtttttgtttttgttttgtcaggttgacttacatttccccccattagggtgtgccgcagaaagaagttttctctatttctgatgtctatgtcaatacagaacaataatgaaattgttaggcaggtgaaatggtacttaactatctgtctggaaactcctaagcgcctgcaagtctttctgagtgagaatttactgtggatagcagttaagatgccccattcctgaacatgctgtaggaatgggtcctggtaggcatcactttctagccagtccaaagccacgctttcctggcagcctgttcctctcatcatcttcctgttcccatggccatggcaccccaaatgtctgctgctctgaccaaaaagctggcagacagtaaataaactgacttctaagataagaaccttcatttgaaacaatttttaacatgccttctttgtcaaggagtaaagaccctgaatcccccaggggttcctacagcccacgatggttcacaagagagtctacaatcctcagagccaagaagcactgagactcaaggacagggccacttgacagagagagcagttcccagccgacttggggcctaggaggatattctgggtggcagggctctaattgattattaacctacatataaaatcaaggacatatagccaagcacagcagcaaatgctgccaccttgtgagctgcctgtggttgtgctgggtggagatggatctagctaaggcacaccaggatgcagcttagagagaacttggtcagatttttactgcttctggtataattggaacactttacttcttaagcctactgtgtaatgttatgtgtacagagtgagtggttgcttaattaagtgctttaattttttttggtcatatatacacgtggtgcaaaatgtaaaaggcccaaaggaggggacagtgaaaattatatctttctcccacccagttccccttcccaaaggtaaacattattgccagtttcttttgtagcctagtgggaataatttctgaatagttatccatactttataggtaactctatagcgatagaactatatgtagttctatacagtatgtatgtagttatatacagtacatatatatgtctacagtatatatgtagttatatacagtatatatgtatatatgtactatatgtaaatatatacatatgtagttgtatacagtacatatatacatatctatagttttcttctatatagttatctctacatatacatacatatatacacataactatgtatataaaactatacaattgttacactgttgtgtaacatggatgtgtatacaatagcgatatgattaaatatttcttattaatgatgatttcctgcagcctttcaatcttgttaaacacaaggaaaattagaaatggaccgaacagaagtggcatcataaaaggcagctactgtttgggagcaagggacatgccgtggagaggaaatgtgtggtggtctgaaattgcaccagtttccactacaattttaaaaccatgcctagccttgccaaaggacctcgggggcaaaggttaagccgacacaccctttaggtcatggtacacagtatctctgggcacatggtggactctggtttgtgctggacccctaaaagttatttccttttatccctggttccctccctcccataggcaacattctgatatgtatacaatgtatcatttagatttgtgtgtattcttgcaatggatcttgttttgtgtgtaagtatttttaatttatgcaaatggtatggctatctcattctgttccttagttttttttactaggctttgaaagttccatccattttactaggtgtgaatccacttcattgctatctgtctttgtagggccaaactgagatttggaaaatacttgaagcaatctttgtgactttttacccaggttttttcacatgttgacacacatgacaaaaagtgcatgtacttttgtgttactgttttactcactttactatttcaactttcctccattttgctaatttgtcataaatattaatggctgtatagtattccatttatataatcagttattacttcacactctctcctgtcatcagacatctgagttttttatttttaatatcattgtggttacatgcgtatcattggtctttgttgattttctttttcttaagccagaacagatgcccaatagggaattattgagccagagaaaaattctcctatagcatgtgatggaagtggccacattttacctcttgctttatttccagaaatgaacacaggtgtctatatccatttaatacacccctttttggccgggtgtgttggctcacacctgtaatcccagcactttgggaggccgaggtgggcagatcacttgaggtcgggagttcaaaaccagcctagccaacgtggtgaaaccccatctctactaaaaatacaaaaattggtcaggtgtggtggcgtgtgcctgtaatctcagctattccggaggctgaggcaggagaatcctcgaacctgggaggcagaggttgcagtgagctgagatcatgccacagcactccagcctgagggacagagtgggactccatttcaaaaaaacaaaacaatacaccactttttatttgtagtgcactatacttagagctgttgccataggaattgatataccaggcgtcatggtggtcagcagacaaataggaaactcctgttatgtcgtcagaatgagttgcagagagtaccatctgctacctgtattgtacatctttctgttcctctgtcacgcctggcacaagagcagcattggtttaatcatcagcagcccttctgctctctgtagtcaggattggcagtaactcattggtgggcaacactgccttggtcttgccgcttgcactgtgaactgtaactacggacacacatgtcaggaaagaatggtgcttgggatgctcctcctatctgtgcctcaaacgttttcactcgagggatattaaaaagtggcctactgcttataaagactgtgtgtcagtgaagaggaagaggtgggagtggagagtgggaggcatttgcaagaacatatgttggattctttttttctcttcttggtgacaatgattgacggcatctagtgagtccctgtttgtcacttccttggtacagctggtagtggaggtgggggaaatcaataagggctggacaaaggacatagctagaggaagaaagcactgcaaatatggtattaagatgacattcctcacagttgaatttttcactgtgctattacttcacactacctgctgcgagctattctcttttgatcctttaggctgtagaggaatcagtctgtgtaactctccctcattcaccacctccaagaaagggttaactttggacataagataactgtagtttaaggggaggaagagaaggaaggaaattcatactggatacagcttttgccagttttgtttcttctatgttgaaatatgggctggctttatggcattctcttggtgttctggaatgtccattatttaacaattccatattgaatacttgcttggggcttagaagagggaagtcaagtgtaggaaggagttgtggcaatttaagtaagtttacaatgatcttattaagcttgttgctttcattttcctgcctacgttggggcaaagacgtgttaaaagtgcaagaacagtgattattttgtggttagagcatgtgcacagtgtagacaaacccaggaaggagaatctgcttcatcaagtcttaagttgttatttagaccaaaatgtatgcgtaagcctcagatgactgttgatgtgccaggaaacttctgctgagtactttcggttctttcttctttactttacctctgcaccccagctcatggttatcttgtaaaactgaaggtgctttgcactgcaaacagacatgacagctcagtctcccctgtagcaagttctagggaaggcaggttggcagagtcccatttttgagctcagttctccaaggccctttggtcagcttattttcctgcagggtgtcacatcccacagtagtctccacctggaagacattggatctcatatgttcagatcagtgtagccacgctgctctgtggagaacagtgtgataaatccttggtagcattacgctttaaactggtggccacttgcctacctccttttaatttcattttgttaacaattgtttcttgaggacctgttgcatgctgggtgcttttttcctgggtgatttcacatttagcatctgttttcattctcatgacttctctgtgaggtagcaagtattgtacccagttttctgatagaggaaattgtggcccagagagattgttgtaccccaaagtaatgaagatgaatacagttgcagaaccaagttagaagccagatttttggagatccaaggtccagtgaacacagctgtacccccacagacacttccgaaagtgaccacagcctcttcagccagtcctgaagagtatgttcaccttcatctgtcttaaagcacaggcacacctggctttgggaaagcatagtttatcaagatctgaattggctcattttagttttagaaaaggtttcacctaaggcttctgcttaagaagagagcattcctaggaagtgagcttaagccctgttcaccctattaatcttaagtgatttgtcagagcagagtggcagagaggtgtcctgcagaggtgacaacctgaatttaaatcacagctcagccgcttactagctgtgtaatcttgagcaaattacttaactctctgagcctcttcttccttctctattaaaggggagtgatatcaatctcatcagattagtgtgagaatacattcatataagtgccaagtacctgctaagtgctagtccatgtgctaagtaaatgtgagctgcaattgtttgccattggcattatcagtagagtgggagtctcattatagcagaaacctggctctcctgaacatatgtaaatatttacatagcccctactaaatgccatttaagagtgtatctagtgtaaggcaataggatgtgtttagcaggaggagtggatttgttcagggggtgcaacagactgggatgggagaagaaggcatgtttgatagtcaaaatgctggcatacttcctgcgcaaggaagtctgtatggctaaacagtgctgaactaaacaaatactgctgaaggtcaggtgtgaacagtgaatcatattggcggggcatggtctgggatatggtggtgagcagtaaaaactacaatagctaccatgaaaggtacctactatatgccaggcactgttctagtgcttttctcctattagcccttggaagcagttctattattatcccattttgtagattaggaaacagactcagattaattcagttacccaaggggcacgtaactggtaagtggcagagctttggttcagtctcaggcgtcgagctctggagtgtgtgtgtgtgtgtgtgtgtgtgtgctttcaaccattgtgttagatgcctctcaagacagataaggtccttgctattgtagaattcacagtctaactgagtgagccagtcaaactaataagtattatatctagtctgccaggtagtaataaatgcagtgaagagaaaattgggtgaggaattttagaggatgatgggagttgatgttttagctagtgtattagtttgttcaggctgccataaacaaaataccacagattgggaggcttaaacaacagaaatttactttctcacagttttggaggctggaaatccaagagcaaggtgtcaatgtgtttggtttcttctgaggcctctgtcctcggctttgcagatggccctttcactatgtccttctgtcttccctctatgagcgttcagccctgggagctctctgtgccctgatcaccttttcttataaggacagtagccacacctaatcacctcattttaacttaaccatctctttaaaggccctgtcttcaaatacagtctcattttgaggtattaggggttaggacttcaacatataaatttggggaggggaacacagttctgaccataacactctgccctctgcacccccaaaattcatgtcctcctcacagcaaaatacattcacctgcattcaacaacctaagccttaacccattctagcatcaattctaagtcccaaatctcatctaaatatcatctacatcaaagtgagagagactcaagtatatgattcatcttgaggcaaaaattcttctccagctgtgaacccgtgaaaccagacaagttatttgcttccaaaatacaatgatggggacaggcttaggatagacatttccattccaaaagggaaaacttggaaggaagaaaaaagggtcatgggtccaaagcaagtccaaaacctagctgggcaaattatgttcaattttaaggcctgaaaataattctttttacatgatgatctgtcctccaggcccattgggctggcagaattttttttttttttttttcagtatttattgatcattcttgggtgtttctcggagtgggggatttggcagggtcataggacaatagtggagggaaggtcagcagataaacatgtgaacaagggtctctggttttcctaggcagaggaccctgctgccttccgcagtgtttgtgtccctgggtacttgagattagggagtggtgatgactcttaaggagcatgctgccttcaagcatctgtttaacaaagcacatcttgcaccgcccttaatccgtttaactctgagtggacacagcacatgtttcagagagcacggggttgggggtagggtcaccgatcaacaggatcacaaggcagaagaatttttcttagtacagaacaaaatggagtctcccatgtctacttctttctacacagacacagtaacaatctgatctctctttcttttccccacatttcccccttttctatttgacaaaaccgccatcgtcatcatggcccgttctcaatgagctgttgggtacacctcctagacggggtggcggccgggcagaggggctcctcacttcccacacggggcggccaggcagaggcgcccctcacctccctcccggatggggcgactggccgggcgggggctgccccccacctccctcccggacgggggtggctggccgggcagagaggctcctcacttcccggacggggtggctgccgggcggaggggctcctcacttcccagacggggcggctgcggggcggaggggctcctcacttctcagatggggcggccgggcagagacgctcctcacctcccagacggggtggcggtcgggcagagacgctcctcacctcccagacggggtcggggccgggcagaggcaatcctcacatccctcacatcccagacggggcggcggggcagaggcgctccccacatctcagatgatgggcggccgggcagagatgctcctcacttcctagatgggatggcagctgggaagaggcactcctcacttcccagactgggcggccgggcagaggggctcctcacatcccagatgatgggcggccaggcagagacactcctcacttcccagacagggtggcggccgggcagaggctgcaatctcggcactttgggaggccaaggcaggcggctgggaggtggaggttgtagcgagccgagatcacgtcactgcactccagcctgggcaacattgagcactgagtgagcgagactccgtctgcaatcccggcacctcgggaggccgaggcaggcagatcactcgcggtccagagctggagaccagcccagccaacacggcgaaaccccgtctccaccaaaaaatgcaaaaaccagtcaggcgtggctgcgcgtgcctgcaatcccaggcactctgcaggctgaggcaggagaatcaggcagggaggttgcagtgagccgagatggcggcagtacagtccagcctccgctgggcatcagagggagaccttgcaaagagggagacgggagagggagacggagagggggagggggaggggagggggaggggagggggagggagaggactggcagaatttcttcaaggccccaggtggcagccttgcttttgaggccttggacaatgacagcctcaccctctcacactgagacagagagagcctcaccctttgaaatggaagagagccttcctcgcccctgggcctgaacactttcgttgtggggtgagagtagtagctttagggaccattcttcctttttcttgaaggataatacatgctcacacccagagccagatagatctattgtcccatcctgtagcatctcagaagcctgctgctgttgtgtcctgtctctgtcccctttagtccaagtcagcagtgtttctgctactggtagaaccccgtctctattcctggcttctgttgagatggccaattagatctgtgagtcccactgtcactctttagggagtgattgtccagtcacactgttggtgccctctccagaacacattctcatttttttgcaatatggataagctgagaattttccagatctttaagttctggtttgtttagcctaacaattttttctttaatttctctcacttctcttgcactttaatagaagcagtaaggagaaaggaaagtggcaaggaaagcacaacaggctttcaacacttggcttagaaatctcagcagaatatccaaggttgtcacttacaagctctaccttccacaaaacacaaaaatgcaattcagcaatgttcttggccattttataacaaggattgccttttttcagtgtctaataacatgttcctcatttctgtctaaaatctcactagaatcacctttcatgtccatatttctagcaacagtctctcttagcatctgagacaacgttctgtggaacacagtttggggaagcttgccaaactcaacagattatactatatcatctccccctgaaagagaagagtgagacataagtcctctgcagtctgttccactcctactagatcttgaagtcatatgttgattcttttcatggtattgtgtgcctgtgttttaaggaaaataattagcattcttaaagcaaagcaaaaattttactaaagaaaataattagcctttcatgtcactttcttagagtgaaccaaataagttttgtatgagagaaagataggggcccgtagatgcccactttagttttgcagggtgggttcctacagccacgttcccctgggctaataaggctaatggaatcatggtggcagttttgcattggcctccagctaatgaaaagttttgccatgagaacttaacttagtccttctgatgcttttactgcctgttgacacagaaggtggaaaatgaccaactatgctatacataaaaacaaagtccagatattcttatattcttttagaatatgtcttatgtgctgatttttaaaatattaagggaaaaattgacttgtgatacttgaaagttcatagaacagggcactgcattaaaacagggcttatgcaaataaaacacatttttctgttcttggccagcagttctaccgtcaggatacttattccatacagcactgtatgatacagaccaagatttatagttggtgatttcctgagtaacaactcagatagcaaatgcctccacaaaacaactttcgtatgttctgcaaggcacaaagtagtacaatagaaaggattgtttgcttcaggatttttgtggggtggtttctttttctttttcttttttctcccacaagacagaatttttcttcttgccctaaaatttgaaagatttctcctttctctccccttctgccacaagtagtcccaccctaaaaaggaagatgaggttctctagcaacccataagatgctcataagaaatagcttaaacttttgctttgaaacaagacattcacatattggggttgtgggccaataaactagtcaatagaaagaatggggaagaagcagtgaatgcaaggacagtgttggtggggaagggggaatattctggttttcgtttctgtggatttttaggccaaatttgaacacaggctcttgatgacacatgaagtatctctaacttgattttatgtatgcacactttatgtactatctgtacataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacagaaagtagttcaaaatggatcaaagacctaaactatgagataaaagagaagaaaacataggtataaatatataacatataaaataccaaaaatataaacaacaaaagaagaaatagataaatgagacttcatcaagataaaaacatttttgcttcagataacaccattaagaaagtgaaaagacggctcacagaatggaggaaacactttcaaatcatataccaaataagaatcttgtatactgaatatgtaaggaactcttataactcaaaagtaaaaagacaaataattcaactaaaacatgagcaatagatttgaaagacatttctccaaaagtatataaatgggctatatgcatataaaaagaagctgaatatcattagccatcagggaaatgaaaatcaaaaccataatgagatgccactttgcatccactaggatggctgtaatcaaaaagacagaagaatattggtaaggatgtgaagaaattgaaatcctcatacactgctggtgagaatgggaagtggtacagctgttttggaaaacagtctggaagtcctaaaaagatgaaacatagagttaccatatgacccagcaattctactcttgggtatatacccaagggaaatgagaacatacatcagtgcaaaaactagttcacaagtgtttacagcagtatcattcacaatagtcaaaaagttatgggggaaaataacatgtccaaaaactgatgaataaataaataaatgtgatatatccatacaatgaaacattattcaagaaaaagatatgaagtccagatacatcttacaacatagatgaaccttgaaaacatgctaagtgaaaggtcacaaaaggccacatattgtatgagtctatttatatttacatgaaatgttcagaataggcaaatctaaagacagtagattagtgtgttaggggcttgggggtaaatggagaatgactgtttatggatataaggtttctttttcggtgtaaggaagatgttctaaaattgataatgatgatggtctttcaaccctgtgaatatactacaaaccattgcattatacgtgttaagtgttgagtgtatgatgtgtggattatatctcaataaagatgttaaaccacacacagtcatattacataattacacagtcatattgaattccgttataatttcagatttatggactaacactgaatactcagagtattaagcgacctgttccagtgcatatagctggtgatcacagagccagacttcctgaacatcaggccaactgtctctccattgtgattgttacaggaagtttgaccccaacataccatacaagtcacacttaaaatttgtattggtgtggccaggtaccactcacttgttcatgtaacagatcagcaagcccctgaaaccgaggctggcaatagcagtttaattcctgctcctgtaaggttcagtagtgtaggctgggggtgaggagacacaacagctgctgctgcttttcttttttttaaccaacaagaatgaccttgaaaacatggggttctttaccacacaattattcagggaccctgtctgatggaagttcttctaccttctccagccagcagatggggaggagagagaggaggtttatccatgggaggttttcctgagccacacttaggggtggtgcacctctcacactcatttccccacaccttctgtggttacaacccagtcacttggcaccttacagatgctgtggggctacgaatgcagactctggtattgaaggagctacattgtctggggtatataccctggggtttgttgtcgcctgccaggaaaatttaggacacatacacaaggagtttaggagcagaaggttaataggtagaagagaagagagagaaacagcttcctctgtaaaggagggggtctcccagcagaaaggacctgctggtggtgaatgcctcgagtgttatagtagggtttcaagaggcagtgtctgatttacctagagctcatagattggttcaatcaggtatgacatttacatagtgcggggaaggctggtttccccaccctaatcttcttatgcaaatgggctgtccagttagggccatcttgtctgctcctttacagtacaggtggctggcagagaagggaagatggagccgccatcttgaacatgtctactccttagttcccgctggcattcacctgtgcaagctcccagcttgctggctgctctttgatagaaaatgatttggggctgcttttcattaaaaagaagaaccttaccaaggactcccatacccttgctatctgcctgcgtgatttcttcttaactcctatatccctatctgggcttgaagttttctccttatacttaaaaaatcaatccaaaggctagtcagcccgcatgatgactgggcacaagtttagaagtttcatatcatggctcctgcttcattgtgagggattttaatacctttagagcaatgttaagtacccagtctgactggttattctgtcagcagagtctgtcacctgtcctagaagaatagtcttgtttgttgctcctagactggctgatgattgataggagtttccaagttgtatcttattggaaggacctttgagagctctaggcctgtgggccttcctgaggaggtgactgcatttgaataggctctaagtttcctatatcttgcctctgccctgctacagcactacaaggggaaacctggaccatttaccctgcctgttgcaaggtaggtgacaaagaggaagttctgagagaacaaatgaagccccaggaatctactcaaccctgacagtgaatatactatcttctgacctcatactgaaacagtgacaacatctatgtctccaagccgtggaactctaccgctactctggaagcagccctgcagtgttttgttatcacttttgttttacactaggctagaggattcagtttggtgagttgtgagaaattaaaagttggaattagaggagcagaggctggcccctgtcagcttattgagctgggtagccttagccttttctgagctttggaaaacctcagatatcatgtcagaaaatcaacagaatctgagaaaaacaccggaaaatcatcagcaaatggtgattctgatagcatctcttccttatggggtcatcatgagaagattccatgataatccccataaagtatcaagtccagattttggcaaaagatcatgctcaataaacactagttgtcattgataataatagcatcatcttttgactttcaaggcagagaaaaagaggtatctccattgatgcctaatgttaaaaaaagtaacattttgtaaatctttggcaatatcttaaaatattttatgatgtaactgtgatgcttggaaaactttctttttagcagtcagaatctttcataaccatatgttaagtacttgctttgtgtaaacaggttgccaggcacaaagggattataaagagaaagaagaaatggcctttgcctttgagcagttcataatgtcataagaattagccatggctatattttaaataggttgtagctaacctaagtttttgctatcagtgttttatttatttatttatttttaattttttttgagacagagtctcactctgtcgcccaggctggagtggagtggtgcgatcttggctcactgcaacctccgcctctcagattcaagcgattctcctgcctcagcctcctgagtagctgggactgcaggtgcccattacgatgcctggctaatttttgtctttagtagagatggggtttcaccatgttggccagggtggtcttcaactcctgacctcaagtgatccgcctgcctgcgcctcccaaagcgttgggattacaggcatgagccaccatgcccggcctggtatcagtgttttaaacctactgcacatatatcctaatatagacaaaaatgtgattacctctttttaaaaacaagcccaactctaaaatatcatacttcggggagcttttatttttgcctcctgccccttgctcccaattgtcaacttatctccccctactcttgctaccaattgtcagtttacccccagcccctacccctcacacatataccccaatttccaggttgttataaagcattcatatatttttgtgtaaaaaatgatttcttgcatttttccaagataattatttgaaaatgtaattatttgaaaacagattgtgttttaatgtgaaatcacctaataccctaattagtttatttagcttagaaacttggtctagagcagtggctcttaacttggccatattttttttaaggcggcattactattgatttcttctttacaaaatttagcaagtccatggtattcttacttcagtttatttgacacaaggcccacatgagatgtgaatgatatgcatgatatgtgaaaaggaagttcatcatcatcacatcttacctgttccttgttcttccagtttcacagccgttagaatgttagagctggcaaggactttatcaccaaattcttatcaccaacacccctcctttagcagaggagagaaactgaagctcagagaggtgagggtacttgcttgcagtcacaccaccactatgtggctgactcctggtgcagaaccctcccttcaacccagtgcctctccctggctggtaatctcttgtctgtttttctttttttttttctttttgagacggagtctcgctctgtcgcccaggctggagtgcagtggcgcgatctcggctcactgcaagctccacctcctgggttcacaccattctcctgcctcagcctcccgagtagctgggactacaggcgcccgccaccacgaccggctaatttttttgtatttttattagagacggggtttcaccgtgttagccaggatgatctctatctcctgacctcgtgatccgcccgcctcagcctcccaaagtgatgggattacaggcgtgagccaccgcacctggccctctgtttttcaactcccttttctgagctgtcaccaagtcctcttactgtttcctggaactgtctttcggttgtcttccttcccgtttcttcctggctgatcccgtccctcaacatctcacaatgggaaaggcctgacagaggagtcggtctctgaggcgtccattataccatattaattttctctaattaccactgtcagcacattactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtcatttcctcataatgttgatgaagaaaaagaaggggccactgtggagttcgtgtggtctccccaggtctgcgtgggttttctctggggactcgttttcttccacgtcccaaagatgtgcatgttaggttaactgatgtggctacatagtccccactgagtgtggtgggggtttgagtgtatcctccaatgggaacgcatcttgtccagggttggtgcccacccccctacctctgagctgctgggataggttccggccacccaagaccctgacctggaataagagggtgaagaattttcttactttttttgtttttccagtcccttcattatactaaaagtttatgttaatctttcttaattgtatgtatagctcacatttatttcagtgtttaacatagaagtgttttggtctttatttagaagtttgttgatgtttttgtgaccagaaatatgcaataggaacttaattattttttagagacagagtcttgcactgttgcccaggctgtaatgctgtggcctgactacagcttactgcagcctcaaactccagggctcaagcaatccccctacctcaaccccctgagtaactgggaccacaggtgcaaaccaccatgcctggctctttttttttttttttttttaagagagccagggcctcactgtgctgcccagcctggttcaaactcctggtctcaagcaatcctcccacctcaccctcccaaagtgctggaattacaggcatgagccatagcgcccagtgtaacttgtttatagaaattagcctatggtaaaattgattttgttatacattattttgcttaaattcatagttcccaagtaggtgaggacttactgtactccattcttcaaggccaagtccaggttctaccacctttttaatgttttccttgattgctgcagtgataacccaattattcccctttactcccaaactttttctgattatatcctaccatgtagcattgcacatcatagcctctcatatggttctctggcttttccttagaattgtgttgccttcttaattatatttaatgctctttgaaggcaaggcttatgtttatatttttatcatatatactattcccctcccatccgttggaaatatgttcaaagaccctcagtcgatgcctgagactgaagatagcaccaaaccttgaatagactgtttttgcatatagatacatacctatgctcaggtttaatttataaactaggaatagaaagagattaacaacagtaactaataataaaacagaacaattataacaatatactatgataaaagttctgtgaatgtggactctgcctctgtctcaaaatatcttattgtactgcacttacccttcttgtgatgaggaagggatgggagtgggatagcatgagatttcatcacactactcagaacgatatgcaattaaaaactcatgaattttgtattcctggaactttccatttaatattttcagactagttgacctcaagtaactaaaactgcagaaagtgaaaccttggataaggggggtctactggattccaattttatagtgcctaataaatggtcagtaataaccacttattaggggcttgttgaacttctacaagttgttgttcagagctacaagcagttcagacatattacagtgttggcaacttgggttgggatcagttgttaatattggggcacggtgctctactgtttaagtgttggcaggatcagtggctactgtgttaatgatcctctagggagactgtctatatagatatggtgctcacgctaatagttggatttgtagatcagtagctgggtggcagggaggctgggggctccctgctgagaactgcacaccgggttcttgaatcttgcagtaggtaatagttacttgagaaaggagtatcctcatgactctggcagatcctcagcacaccattgtgacatgtgaactggcctgtctcctctcccactgtaagtccttgagccagtaatgaccttggtgttctcttttctacaatactggcacaacatcttaaggtttaatctgatctttgtctaaaatatttttttcagaacccattaagtacggtgtcttcccaaaaaagataagtgtgttgtcataagttcctggtattggaaaaaggagtctgtgttatttaaagaagccttgtctgcttccttaattccaatgccccttttccatgccttcctacctttcctggtagtcattcctggactgaggtaactgcagattttatagtacttgggactatgcactccctaaggcacagaccgtataagaattgcctctgccaagggctcctaaacttggaattattttttctttaatgtcagcaggactaattccacctatacaaaatggtttggccttttccttctttggcacaaaagagacttggcagaggctcagataaaggtgaagttgacgagctctggcatgggagtgagctcagcgcttctgggctttcattccccctgttcgtctcatgttcaaaatccccattccacccagaaagtcttcccttcccaccagtgacaccgaaagatgtttcagatccttcttcctttgtctccaacacacacagcgaaatgctgcatgccttcatttgcagaaagttacccaactggaatcactttaatattttttttttaatctctttaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataaggtaaccaagatctaattggttttggcttccagctaaaagtgaaagtttggtatttcatatcctctcccttcttttactcttagtgtttctgtaaggatttggggggctgggggatgtctttggagcctgttaatagcattcctgaggcagcagcagttttaaaaagcaaagtgtttctatttctggtctgacactaagagacctctgacttatggggcttcccaatgcctcccccaattattccttcagggaagtcactcttgactttattagtgccagtaaaggtaaaagtgggggcatgctaccactccttttttcacttgaacttgtggccctaaagagttagggccaatgtgataaaacaagtaggaaggtcgaatgatcagccaagaattcttttccatttcatgtttaaagcaagatacgactaaccactttgtgtacaactagttttaagaattgtttcagggctaatttgggaagcattagaaaataaaaagctattgtagcccttttagaaacatcacaacagctgagtgtggtagctcttgcccataatcccaacacttttggaggccaaggtaggaggattgcttgagcccaggagttcaaggctgcagtgagctatgatcacaccactgccctccagcctgggtgacagagtgagaccctgtctctaagataataatagcaagaagaagaaagatcaacaataaaaaccgcactgttatttaaatttagaaggaggagggagaagaaaacaaaattaaaataaacatcaattttatagtaataaaaatcccgattttttagagatacatatcaaagtatttacagatgaagtgatagatctaggatttgtttcaaaataattgaggggaaggtagacagatgataaaaagctggccatgagttcataactgttgagttgaatgatgggtacataggagttcattatactattctgtctacttttttacatttgaaattatatattcagaaggaaaaggaaaaagcaaacgccaacctaaaaggctcctccattagcaatgtatcttcaaaacagattttttaaatgtctggtgttctattctgcaatatgtgacctcttgtctgctgcaggtcaaggtttctaaagcttctttgaaacttgatctttatttttttaatgcattcagttctttatatcaatattttttatctgcagattttccagtattctgaacagttatttctcttacagctgtagggaatatgttgcatatagttggaaaaggaatgatttcccatttattgcatgattcatagtacccttcacttctttaggcaaaatatattctttaaatatgtatattaaatacagatagaatgtttgaataatcttcaaggttaacagtagacaagattacttgtcaaatttattttgagtctgtttttctagtctggtcaaaaaggtcactgagcaaaagtttttgccttgaataatgttataaataaaaatgtttacatttattaaagtaaatttgtgttcatgaagtttcactccagagttccagctcattataatcttccacaagactttaataaaacaatcatttagccggctaaaattgaagtttagaaaaattttttgagaaatgtttttagaaattcagagaagcccagaaaaagaccatctgtatcctctctccacaaaataaatattagtccacattttagactacagcttgtctttttttcattgcttttattttggttataatcaagatctaggtctgtcagtaccaacacgtatgtagatttgatgatagagttaaagcgtagttggggtaggctccagctccactgaaagggaattacagattttcttttggctttcatgaactgtgagaatcaggctgggaagacgggcccttcatggaagtgagcctcagagcagtatgtgtgctagttcttttctcttcctggaatgttgtataccttgaatataggagtgtccttcctgaccagctcagggccctcatggcagttgcctcatggcaacttaaacaggtaccttctcctcctggcatcagatatcctattatttaaatgaatagcaacttctctttaggatggggacaggggaaataatattcgcaatttctggttatggaataaaatacttgcggggcgtaggcaggtgatgacatacatccccaagtgaaacatcacaagagggaggccacccctgccccatcagatccctggaaggccgggtggcacagaggtgatgctgggagaggagcaggaaggagggaggtgcagcaggagggagatcgtggccagctgtggcgtgggagcccatccttgctgagctaaaagaaaaaaacataagacaaatggaaaggacccctctgtggattgactacagaaaagaggtttgtttttttctttattaaatccctgaaagtgcctagtgttcttgatggaaactttgagtgatttgccatgtaatcataaaatcttattttagcgccttttcatctctcatacgaaaatgaaaggagataaatattagcaaatagataatgcaacttcctgatcttgtgttcttcaggactgaagcatgtcacatagccctttgcaaggagagctaaatcatgggactaaggcaaagatgttgaagcacgagggaacgctcaataacccagccccagcccctcgtgccatctggaaaccatgaattcagtgaactcgggctctcgctgcagggtctgcctagactgcagccataaaatatgtcagccttggcactggcagctttgatggccatcagttaggcagacaggagcttttgtgctacccccttctctttgtcagcttatgtacaaccctagttcctcattaatttagggttggaaagatgtcctgagtattagagttcaactttccagttataagtattttttccatggccacctccgccctccacaccaggtctgagttacatgcccacgccatgtgcactgcagctcctgacacagtctctcttgcacatgccatagtgtattgtaaagtgggcaggcaccgtatgtgcctctatgccccatccccagcaaatggggcagggtcttatccacagtaggaacttggggaatagctgttggatgaaggaatgaatgacaatagtttcacataagccaaaggattccattccttttcttaccttctgtgctttatttggtacatactcagtatgctgagtgtgatactcttcctctaagaacggtgctcaagcctcctgcagaaccacctaatgggtgtgtgtaaaaattggattcctgggtcccaccccagactactgagtcaggcagcatctcttgacccaggaagcggtactcttaataaatcacctgcaggtgattcttttcttctgcactttgagttgagaaccactgctctaacaggtgaataaacattaatataacaaattgcaatacagttgtagggaaggaagataaaggtatgccacgatagaaatacatatagggtagaattcattcatccatgcaacacttatgaagacccattgcatgtcaggcactattctaggcactaatggcagaatagtgagccaagcagacaagggcctggtttcatggtggcggggaggcagactaagtgaatttatagctgtgaattgtgataagtgtctgaaggaagacacgaaagccagtgttatgggtagatagcaacggccaggagatgggcttctcagaggaggagtttactctgaggatggaagagtgagaagaaagtcacctgtgtgcagtcaagggtgggcactgggaagaactgtccaaagagagggagctcatttgtgagagacttgccacaaggaggaaaagagcttgtccgtagcagagtggttgaaagggacagtggtggaagatgaggccaggaagagcagagatgagattgcacagccatgcaggccccatggagcacctgagatttcatgctatgttgaggggacagcaatcagaagccttgtgatgccatatggtgcagtttgcgcttcagaaacatcagttgctgctatacagagaacaaaccagaaggaggataagaggggagacagagtccagtgaggggataactcagtccaggtggcagtgacctgcacagacaagaagtgaactgcttcaagagggaaaaccaagggtggatcctgaaaaggaaatagaaatggatggagggccatgagaagacagctgggtggacagtgggagatgaccaaggaggagggagcagtcccgtccattctaaatggggtgtttggtggtgaagggccaggaaggtttccatggtggggacttgagagattagagagtggtcccaagcagactggggcaggcaggagaaagaggaatggacagaagggccttccttggagaggtttcagtctgacaaggttcaaagatgaatagtactctgaacagcaccttgataattgtaggtttataataaattcttgtcaaataggtaggtgtgccttagatagggaaggcatgcacacagtggttagcagtgtgaactgtagaatcaaaatacttcagcgtctagcttcgccattaactttggctctctgagcctcagtttcctcacctgtgaagtgggaatacagattgaatatccctaatccaaaaatccaaggtgttccaaaattcaaaactttttgaagaccgacatgacactcaaaggaaatgttccttggagcatttcggatttcggattttgggattagggatgcttagtcagtatgtctgatgcaaatattccagaatttgtaaaaatcagaaactcgaaacgcttctaatgccaaacatttcagataacagatcctcaatgtaataacaacagtatctgcctttgtggagatattgtgaggcacaaaatgatccatgcagggcacttggcatggtgcctgacagacatgagcatctagtgaatattggaggcagtgcttgttctaaggtacttgagcagtaaaatgagtataatatttggacttgaagtccaaatattatgggattctgcaagggagtcttaaccttgagcctaacaagttaggtcaactcaagcatcttacttatttgtgccatcagtttcctcatctgtaaaataagcaaatttggataatgttatttgtttctaaactacctcctggttttaaaatgctctaattccaatatgtagaatgttagcatccaatgatgacaatgtaattcctcatctatgcagtttaaactagatgaaccatgtttgctggtgtaatagctcagcagtggaaaaacagcatatacttcctggtctaatacctgaaagaaattaggtgtatggataacagcaacccttggctaaatctgactgtagacatgtcacctcatctaatagtaatatacaggactggagcgggaagaaaagacttgttaaagatgattatagtggactgggattatttcaagcctaattagaagaccattttcattctaagtgaagcaaactcagtatgttgacaatgttattgctgcaattcactaacgaaagtgtgctaacatgaatcacaggattctgaagtcagcattctcaggtagtttaaaaggatgaaggatttgaaatctgtcatttcatttgttgcagaaatatgaccaagataaccacccttttcttcagtgcctcttaacatgaagcactgaaattttttctgaccttaaaggtaaacgaaagttccaagcctaatcttgtattgtaataattataatagctaatatttactgcattcttaggtgcactttgcaactaaataccttccatatattctcagattaatctctgcaactcaaagaagcattttgtggctcaggaaccaaggttcagagagatttctatctttcctgagattactttgctaacaagaccactaaacacatgggtgtctttgttacataatttgggattgttggagcccaccagttttggacaccagaagccctctgtggtcaaacaagattaggtttatttaacttgttgggcaagaaaagtgcatacccatattgccacagtgaagagaaatgagtagatttgggcttgtgctgggtggttctagtagggatttagggaagcaagaacccattttcttttgggtgtcatcagaaagtgggatcaatttggtgtcttggtaatttttatctaagaggtgggaagattgaatagggacttagattgtcatcagtaaagaaagcagagtacctcatattagttggaagagggggacattatttattttgtggcacagagggttctcatacctgtcttggttcagacttgattgtggattgtttctatcttgttcttccatggtcacagagtggccttgtctgaaaattatttgcataagcaaatttttgctgagttataaacactcaaacagtatagcctgacctgtcaactctctgggctctgtttattccttttccttcttcccttccttcaactctcccttcctctatctagttcattagtagttaatttttgccttccaaagaataatcaaacaatctaggtccttcattcttctctgatagagtgttagcatagggaaggttttcagatccggagagatgtagtcttgaatcctaggtcagtcagttgacaactacttgactttaggcaaatcacatcatctttttggtctatctttccatatctttaaaaaatagaaatttattccattgtgtgaatgcaccagagtttatttaatcttattcacccactaaaggacatttccattattcccagtttgagtctattaaaataaagctgttatgaacactgcaaaaaaaaaaataggaatgataattacctttcagggtgttttgaaaattagggttaatttacatgaagtgattggaacacatggttcaatcacgaatagtggccaccattgagaaggcataaacatttgtcaaatgttaatttgcttatactttatatttctaacagcaatgaaaatactttttatacaacaaattattagattgtagaaggtaacagaaggtggggagagccaaactttctgaatgtgattatctactactgaatgttagttatatggtaaaacttgctatagttattgttttgtacatttattaaaaattacaataaatagataacatggtgctatgcatttaattagtgaaaagcacaagatcattttaaagttcttaatggttcattcctgataaatttttatgagatacaggcaagaatgctatacttacaggctgtgcagaaggaatgactatctgatgagggctataaagaagaaatggaagatacacaaaagctatttttattgtaggggtagaaaaagatcttgttaaatatttctgctgaaggtttgtttcttatatacaaggccaagatcagggttaaattagaagaatcaatactaaagttagttctgaattgtgggatggtttttgttttcatctttgtattttgctatattttcctattttccaggttttctgcagaaatattctattcatgattagaacaaaaaaaaatgtagtcttctaaaaatcctgtctttttctgaagttgctaggcctctcagccatggttgccaaaatctggacaccatgcatgtgtgtgtatgtgcgtacacacccacgcctgtgtacatgtgtctcataaaacatccttaagcatgagctagacattaaacagtcttggagattctagttcagaatttacctcaaacgtgtgaattatggaaattcatggttcatcacagatggttgggatgttgccaagatacatcctttagcacgcctctgtttgctttatgtgaacattaataactctgttccaggagaaatacaattgaaaagcatcctgtacatgaaaaaagttattgcaaatgactcactttttgtgtggttccttctctccctttttccctcctatcgtcactttagaagtctggccttcattttcgacacacagataataccgtccagtggttaagagcgatggagtctattggtctacccaaggtaagccttcacgcactggaatctgaactagaaaggcaaaggggtagtacacaaacatctctttatgagcaatgactttggagactgggttatgttaatgtagaaatgagaaatgtgaggactaaaaaacatggaaagacctatccaaagtaacatatggcaagaactcagaatgagggatgtgcccagattgagagcagccaggtaaaattgtgcacaaaataaaggcagaacaagctatagctggtagataggtgagctatctaaaatagccaactccctttcttgtgttgctatttgtacataaagattctaagtctcagccacttttggtggctcatgcctataatcccagcactttgggaggctaaggtgagagaatcacttgaggccaggagtttgagaccagcctgggcaacatggcaagaccctgtctctattaaaaaaaaaaaaaaaaagaaatctcattgtattagtatacactttattactgtaaattattataaatttattttttgtaaattattgttattattatttcaagacagagtctggctctgtcgcccagtctggagtacagtggcttaatctaccacctccgcctcccatgttcaagtgattctcctatctctgcctcccaagtagctgggaacacaggcaagtagctgccccatgcccagctaatttttgtttttgtttttgtttttgtagagacagggttttgcctcgtcggccaggctggtctcagtctcctgagcccaagcaatctgtccaccacggcatcccaaaagtgctgggattacagggatgagctaccatgcccggcgtataaattatcattataaatcataatatcacttgtaaaggctagtgggttatagctcttactcctaaaatagatctcctaaatataatttaactcagcaaacattcagtgcttgttaaatttgaagagcaggcatcctaaagtctgtgagagaattaggcaagtggaggaaatgaggaaataattacatttgataaaaattgtagaactatttttttaaacttgttattttgaaataattatagaatcacaggaagttgtaaaaatagtacttctatgtttatccttcattcagctttcccctagtggtgacatctaactgcagtacatgttaaattgacattggtgtattagtgtaaactagactacagacctttttccattttcaccatttcatatgcatttatttgtgtaagtgggcatgtgtgtgcatgtatgtgtgattctgtgcagttttatcccatgaatagatctgtgtaaccaccaccacaatcaagacacagacacacagaagagtggtccttctgattgcatccctcccccagccctgttccctggcaaccactaatatgttctcgatctctatagttttggcattttgagcacaatatataagtgtaatcatatagcgggtatcctttgagtcacatcgtttccactctgtatatggtccttgagacccatctgggtcaatagcttgctcctatgtgttgcttagtatgtacagctattttttttttttttttttgagacagagtcttgctctgtcacccaagctcgggtgcattggcacaatctcggctcactgcaacctccgcctcccaggttcaagtgattctcggggttatcacttacaggcatgcaccaccacgcctggctaatgttggccaggctggttttgaactcctgacctcaggtgatctgcccacctcagcctcccaaagttctgggattacaggcgtgagccactgcacctggcctgaaatctgtttcttatcaggctgttagtttcaagtttaagaaaaagagtaagaaatagtatgtaggataaccccccgagttatcaagtgtaacctcccgagtagctggggttacaggtgggcaccaccacacctggctattttttgtatttttagtagagacagggtttccacatgttggccaggctggtctcgaactcctgacttcaggaaatctgcccgtctcagcctcccaaagtgctgggattacaggcatgagccaccatgcctggcctgtacagctatttttaaaaaattatttaggagtggtctcgctggaggtcaagaggataagctactggcttatgaagacctctgttgtgccaggtgtgcagtgaaaaacacccactgccacagaaacagaagattctttaaatgtaatttattaatgcccatttttaatataattgtgctcatatctgttttaggtcagtctcattttatcttgaaatgatcagtgtttaaattttgttctgccatttttaatcaaactattttctcttctcctaaaatgcccagaacgttaaatgctgtttccttctaggaactggctgtaatacataattcatatttctggattgtgatttagcaactactaactagaggctggatgataaaccgattaataaaaaacgaatttaaacagaattgttttgtataaggcaacatcaaattcagataatttcattggatttgatagatttgatgtaaaccttttcaaattgtatgtatttagggccaaacaagtggtgttatagagcagattttattttaacattggtttttattatgaagtcattgatatattgcattgcaggggcaagagactgtactgagttgactttgatgtatcatatttaacttgtattccttcatttatcaatattaagtgcttactctgtgctcagtatcatgctaggtgccagaaatacaatgctgcataaaacattctggtgaatgataaattgatctcatctccttgctgaaggaagtcatttataatggctttccaggagaaatataaatataaaagattcttgtttaaagaaaagggaagaggcaattgtagttattctctgcttacataaaaaactttaaaccggtaatactcttttttgttgttttttgagacggagtctcgctctgtcgcccaggctggactgcagtggtgccatctcggctcactgcaatcttcgcctcctgggttcaagtgattctcctgcctcagccacccaagtagctgggactataggtgtgctccaccatgcccagctatttttttttttttttttttaatttttagtagaggcgaggtttcaccatgttggtcaggctggtcttgaactcctgacctcacgtgatctacctgcctctgccttccaaagcaccaccatgcccagctaatactcttctgaatttagggatcctcttctcattgatactttagtagcaaatgcattaaaggaaagttggaaaggctttttaaatttcttaggctactgccatttctttaagtacttagtaattatatattttgtagctcaagaaactttgcttctttcttttctcagcttttctcagtgaccaataggaaattgcacttgagtatcacgtactaccatatgatgcattattttagtttttgatgtcagtttttataaaatatttacttaaagtaaataatgtctaaatgattatcttaattttaaaagcctcaagcttaattattttttgtgtgtgcttaggaacagagaagtttggtgcctcactctgaaatctgtttcttttgttgatttgtttgttcgtttgttttgttttgagatgaagttctgttcttgtcacccaggctggaatgcagtggcacgtgcttggcttactgcaacctccacttcctgggttcaagcaattctcctgcctcagcctcccaagtagctgggattacaggcatgcaccaccacgcctggctaatgttggccaggctggttttgaactcctgacctcaggtgatcgcctgcctcagcctcccaaagtgttgggattatgggcgtgagccactgcacctggcctgaaatctgtttcttatcaggctattagtttcaagtttaagaaaaagagtaagaaatagtatgtaggataacctcccgtgacacacatttacctatgtaacaaaccttcacatgtaccccaaacctaaaataaaacatgttagaaaaaggaaaagagtgtgaaggtgtattcaaaactttgatgttcagacctttcagtctagtaatttcatatttagatgattatccaaaataatcagatgctcagaaaatacagaaatattcattgcagtggcttataatagggaaaaattagaagcaaaacaaatgttcaaccatggattaactggctaagctagggttcaaaaatataaacgaatcatatacatctattaaaaataatcttatagtataatgaaggggatgggaaataattgtgttctgtaaagtgttttaaacaggttacactaagtacaattttgttttcacatgcacacatatatataaacctaaaaaaatcagagacatacagaaaaaaagaccagaagaaaaatagggacaaaattgctaatagtgacaatctgggaggtggggtcatagatgtttttccttcataccttatatactttccagattttatttggtgaaaatgtcttactttaaacagattttttaaatgtgtgtgtgtgtgtgttgtatatgcatgtatacatgtgtacagagcacatatgccaagtttttaacaatgcaataaagtggctaataacaaggacacccttctcaggcccatgggacctctgggaagtcacaggagtgtgaaggctacaggaggcagagcccacatgtgctcatatgccctatgaaatgaaacactgccactagcactgtggacacagccttcttggagtagctggctggggaccccaccatcctcctgtggaccactaagaggcatgctgtcaggcaggggtccagatatggtgattggtctatctctacagcaagatgaagcaatggcagagaggttcctctatatttaaataattataggatagcaaggacaatcaaaatagggtcattttgggaagttaaaatacttgtgagaagcaaaacatataataaatattgtttcttttgttttccagatattttatccagaaacaacagatgtctatgatcggaaaaacataccaagaatgatatattgcattcacgcactgaggtagggggaaaatgcagctaaaaggtgctctaagaagtagatttaaataaaactaaaatttcaattttaaaagaggttttaagttactttaatagtttgaagaactttttattaaattccattgttttggatttgctggtacaaaattaaaataatggtcacatataagcaattcttgaacttgaaaaatgtttttctgatttttaaatctaactcaaaatagaaaaccagaaaatgattgaaaaccattaagtacaataaagagaaaatttaggttgaaacttctagaaatccaattgtaatgtactactatattcttgagttatgacctagtttacaaatataatgcagatatatcaaatgagcaactttaatagtcataattttggtttaatgagttaaaattataatttagttcaattcttacaaattaagaaaatagaggtaagaatggtttcttttgatcttctgttcaatagaatttgtaccctaaggataaagaagaaacatagtagtttggtgtaaattagtcaaatcaagacacattcattattttaaagcaattgttcaataacttaatttttgaaaatgctgaaattctgctagttcacagattacattttatcttattggcctggaagaaatgtgatttttagatggtaacaaagattattctaaaaatccagtttgtggctgttgtcttgaatgtacacaggtaatggttttggaagacttcatgtctgattaaattttaaattacttttagaacatctgccttgtgttttcatcactagaagtcattttcctggcagagtactctgcctagaggtttatgttgacttcttcctggctcttttcctctccaaaggaaaatgcttctacaataattcatggtggtgttggctttctagagaagaaatttgattatgtcatataatttgactttttcccccagtcagtacttatgggattgctttggaagatgacagttgctagaaatatagaccaagtgtaggtgcctttgctatgatttttttttattctagtaacttagaacaactggttaaaaaaagaaaaacagcaacagtaaaaacaaacctacttcatgctgccttctcagatgtggcgagagtatcattatgccacaggttttctaaaagctccttgtgcaaaagtgcttatgttgaggaatattttcaacttgtgttgcctgatattctttattaaatatttttctgatcttagaatgataacactatagttagtactgggtctatgagctgctaagccagccacgactagttaatgccattgctacatgtgtgcatcacagtgctaatctctagttctgtcgcatgctcgtgggctgtctcgtataagtttcaattgattttctgaaatagacaactgggacattcatgttaaggagcttataaacaaatggtatgctaagttcctttctggtgatatcatggttctcctaaaggagctatctagagctgcacttagacttacatgtgtatttgccatggttttaacaatggcttgaatagcttggtaaacaaagaaaaaacaactttttgtttattattaccaattgtatacaaatattgatgtgatattttccaggactgtgtttttcagttattcatcatagacatctccattacttttactcatcctggaggggattcctgttgggtcatgtcattcaccagatctgatcttaagtaggatattttatcttcaaaagcaatatttatttagtaaatagcattctcctcgcttttctttgttctaaattattgtatagctgcctctcactatggagccgagaagtcccaagtgtatcttgcagctttttccaccaaaacttgttcctgctatgatttaaaatgcagtcagtcactcaaaggaggctgatattctgctttgttgtgcaagacacatttgaaagctgaggaacaatcctctaataaatacagtgggtttgataaatactcttgctgcatagttagaaatgatgatggaaatgaactaacatgtcttcagcttttatatcctggctgcaaatacagcactgctgctgtatttgagagttgttattacctggtagagtaattaggcaggtcagagattctgattataactcagaagccagcaaggaagtttccctaggaagttaagcttgccaggcgctgccttcttcctgccccagcctgtgggcctgacttgatctaaaaagttagctcttagccctgaccaaacttgtctcctattccctgtcatcttgatttgggcttaacaacctaacttctgggtgcttatgcttgcttcctgtttgtatctgtgttcccctttgctgcctgcccctcaccttatcattttatttctgatcccagtctcgtgtcctaccactcaccaatccctgtgtcagtttagcttggtgttctcaagccagactccatgaacattaccacagcagcaaagggaggaaattctcaagcttcacctaatgtagacagactcaccttagcggtggatggcatcttttttttttttgagatggagtctcactctgtcaccaggctagagtgcagtggtgcaatctcagctcactgcaacctccaccttccgggttcaggtgattctcctgcctcagcctcctgagtagctgggactacaggcacgcactactatgcccagctaattttttgtatttttagtagagacggggtttcaccatgttggccaggatggtcttgatctcttgacctcgtgatctgcctgcctcagcttcccagtgtgctgggattacaggcatcagccaccacgcccggccacatcattctttttctaaagaaatgtttgtctttttctcattttttcaaaagtaatgtatgctcattgtggaaaaaattggaaaatccaggaagaatgttaaagaaaaagctaaaatacccactatctcaacaccaagtaaaaaccactgtaactattttgatatctttgaacttaaagtgtatactgcgtatggcatgttttacttttgtggcttcttttggaatgttataaagcctctgccttgaaaaggaaccagtttaagagtgagagccttactaactagttactatactaatttttaaaaaatatctggaggccttttacgtaagggtaagaacacttttttgacatgttgtttagtgcccaccttattaaagatgtataataaatgatattaaacaactgttacttgtttaaacagtcataaaagtgagttccttgaaagagttggaataatttagtagaaatgatgttttgagtacttcagataccttaaagagcaggtgaaatgcccaggtacgttattacaaacttactacactggaacctattctgtaagacccatactacaagtttcactcattttgtttattatttataactagttttgagttgtccttggctattatattattttgatacctacccagaattgacataatcttcgtggcaccagaaacaaaagaataccctttcaaacctgccatgattacagatctgggtttcggatggatcacttgtgagtcagaacatggcgcaactttgggttcttctcccatggcgagtcagaccctggccacaggcatcaggctaaactttctttgtttaaaaaaaaaaaaaaaaaatcagaccgcatttaagtacccggctttcaggtaggtctttatttacaatctggtccccacccctgccccccttccccattaccctgaaataatttactttcttaagtctcacttgaccagcattgtataatccattgtcctgtcataatgatgtattggcctgatccattaacattattaaaagcttatgtatgccttttaaatattttttttttaattagttgggctttctagaggttttcatcccctgggagacaagggattgactgtacccagtgatccttaggcttttgggctgatttatcatctcagatcatgtttctagtcctgcctccacttagttagtggatgtgaccaccagtgctggaccctctttctacccggtgtttctgtcaccacctatgctccttggttcttccttatcttggggcacttcctttgttttctgggactatttagtttactcaaagttcttggtctttattctttcatgtagtataaatagtataaaaatatctatatataaacaaatataggccaggtgttgtggctcatgcctgtaatcccagcactttgggaggctgaggcaggcagatcatgtgaggtcaggagtttaagatcagcctggccatgatggtgaaacctcatctctaccaaaaatacaaaaattagccaggtgtggtggcaggtgcctataatcacagctactcgggaggctgaggcaggagaatcgcttgaacctgggaggcggaggttgcagtgagctgagactgtgccactgcactctagcctgggcaacagagggagactccatctcaattaaaagaaaaaaaaaaaagcatggtggcacacgcctgtagtcccagctactcgggaggctgaggcaggagaatagacccaggaggcggagatcacaataagccaagatcgcgccactgcactccagcctgggcaacagagcgagactccgtctcaaagaacaaaacaaaacaaaacaaaacaaacaaacaaaaaacagatatagaagaaacaaagtacttgtgttttaataatgctccccaacttgttaaagtcaatataaatacacattcgctatttatctcttttttttattacaacttcctttttggacactgtatattattctcttgattattgttttgaacctgtggcctttctcagacttaaccaagattaatatctctttctttttgatgaaccagattgtttcagcttggtcagtctgagctctttctggcccacttccttgtccttctagcaccgtccctgacattctttgaaatatccttgctcgtggtcacaacaggatgttccagtcctatcctgattatttctgctttgagatgtggaaccaccactctctagggattcctcttaaaagtcatgtgtttatattaatttttcaagtttaaccttattagcttactggattctgcttttcttgctgtctagttcatttgaccattgagattcttctacatgggcagccacaaacggaagctatgtctgcctctcctctgtgataggattactcttcccgctgctgatactgtagctgtgtcgcagcagccatgttttcaggtgcaatggtgatgccatggctctggcagacccacttctggttcaccagccgtccaggtactctgggagctttgtggagtagagtttgtctagccagctcccacacagccaggtggctgtcttgcttaccaggtggcctttgaacctgctcctcaggcattaatgcataactttccttgtcttaacactctgttcccttagaaccttttccttccctaagaaactgattgaacccttatatcagattgattatatctctaacagtgaacatatttgcatttataaataagatttccaaagacagtttcttagctcaaaggacaggctctaatcctaggttctcagaagggatatctggagatggcagtatttggaagtaaggtgagggaggcagttgcacctgcttatttctttcaagtccttccttgctcagaattctctctgtgctctgaaccattcctttccctttcctcctctttctgtcctaaattagtatggtggttatgcctttctgtcttcctaaattctgagctcttaagagactatgaaccacatcttgttacttcatacagcttacgtgctattgattccaagttaaagtctctggagtttgtatatttaactcttcaggaggtttaattgaactaatttctctatgataaggctacctcaggattcctttggtttggggctgaaaattaggtatagaaccctggattttgatatgatattggcagtgatatatgtgactaagatggaaaaatttggttcagtaaataaaactatttcaaacatggagtctgtggtgaaatagagattcttggcattggaaaaagtaagaaaaccactttgataggttatcaataagtgtttgtatacaaaggacacatttatttaacaaagaatagtaagaacaaaggttaacacaaatggagcttttaactatgtgcctggcactgcacaaaatactgtactggtataatctcattttatcttcataacatatctgtgcagtggtcactattattactcccattttatcaccaaggcagttgaggcacagagaggctgccgaaggtcacacagttagtaaaaaccaggatatgtgagaactgaacctgtgctattatgaattcagccagccaatggcttcaaaagaagtcaattatttccctacttctaagaaaattaaaagaacactggtatcagacttgaacttcagcacaggcctctcagctattatatttaacatgttttaaatgaagaatcatggaacttgagaaggggaagggccttgggaagttattgtagtctaagtcattcatttcacagataagggaactgaaagcttgggttacgtgacttgctcttagtcacacactgaggttttaccagttttgggaccaggattcagcgcttctggattctagtcctgtggtctttctgctctaccatgaggctttgatatacaaacattcattccacatgttatagtacaaaatgagctacacataatgtgatccaagaaagctgaaataaatttagctcctgccttttaagtttgcatttcattacgatagtaccttttagtgtatatcctgaaagtatagaaaaaactaataccactagttttatcttgaaagtggtagaaaaaactaatgccatgtgatattggcagtaatgtatgtgactaagatggaaaaatttggttcagtagataacaactactactactactactactatatactactttcatgatatacactaaatggtattttttaaaactttctttattgcttcctggactttaagtgatattatttgtacaagtaggagcacatgggtcaatgagtcggtagctacctctgggcaacccctccgttgctggcctcactcagctgcacaggtgtgctgtagcttttggtgtggtaggaggcttgctacctcacaaaaagtgctctcttagacatgagaagcaaaggtgacattaattccatgacttcctttggaatgctctcagccctttgacttggctgttaggtaccaaacggtgcttaataaattaactgttgaagagctacatgagattggcactttttctattcgatgggcttttttgttttttagattaagacttgatttcctatatacttcaggtaataagcagcctcatttgaatttaaatgcttgggaaggaagtttgctattgctgtttcttttcagcatgggaatactgggtaaacacagtttcctgataaacatttgcccgtttgagtaatcagctgggaagcacctcccacacagagattaggtgtaaaacgcccataccatgaaaagtgatctttccaaagctaacagtttaaacctcaacatcaatgatttaaaaaaaaagaaaaaaagttgaaaattgaggccaaacagaaactatacaatattttttttaattttttagtaaatgagattttttgatatatgcaaatgagatctttacctgatcaatattagcttaagaaaatatcagacttaaatttaaaagcaaagattcttccatgttcagaaagctaacttctcagcaccaccttgtggtaacttttacttaagccaggatgtttgtttattgtaagatttatattaatattacattgtacaatggagaaattaaaaatgtaattggaaatagctatctaacttctttatcatcaaaggggaaaattaacagtttagtataaacattttacttcatgttatcatcaaacctatattttgtggtagcctaagtaccttaatttagggatagcatggtagagaaaattttttttttttttgagacacagagtcttgctctgttgcccaggatggagtgcagtggcacaatcgtggctcactgcaacgtctgtctccctggttcaagcaattctcctgcctcagcctccctagtagctgggattacaggcgtgtgccaccgtgcccagataatttttgtatttttagtagagatggggtttcaccatgttgaccaggctggtctcgaactcctgacctcaaatgatcgcctgccttggcctcccaaagtgctgggattacagacgtgagccactgtgcccagccgagaaaaatatttttatataggagctgttccataaatagtaattaaatgaatgaatggataaacagagcataatgtgaaaacagttgcatcaagatcattgagcacagctgtcttatcccctttccaaaactaacatgaaattaactacagtaataacttttaaaaaatacatttgcgataaaaatgccatctactaaccagaaatttgaacaacccctaacatgaagtaaacagacagaattcgattgactgagaaacaaactgggagaagatcacagcccacaaaacgctgggggttgcagcagaggtaggagctgtcgtgaggtttgctccaagcaaaggggacagcaaggaaaagaagagcctcaaagtgagcaatcgtcagcctaggaccagcagaactatatggcccttccctaaagcagcaagtgtagatgctgatagcgggatagcatgccggtacccaagacagctaatgacctcaagaaggaacagagagtccccagtctgagaaggaaagacactggttcccttctggcgtccgttccattgctctctacagcttcttaatgctggctcctgacatgcggatctgcagtgaatgaccaacaaacagcaagtctcaaacactaagatgagtcccagatcagaagatgtcagacatttgaaggaaactgccactgaaggaagcattagattcaccaaacagaaccaagacccaaggaacaaatgaaaatattaaaatatgtgcaattgatgattcattcaatttatgttcaacaaatatttattgagcacttacatttatacacagaagaaccaaagataaaactctaagaaggaaaatttggtatagataaaatcagaaaaacagttaataaaatttgtagatatctaaattattggtggatataattaaaaaagcatgaatctaaaattctaaattatctcaatattccacaggtgggaaagttagaggtggaagcatctaaggataatagataccaattagtttaggctttgatagaaaaatgtaaaagtatattaaaacttcagcaggatattagtataggtaatatatattaaagatgcagcacattaagtacttgaaataagtataaaatttgttgcttgaagacattttatggatgtctgcttacattttactgtataacattttctaaatttcactttttttatagttttctttgtaaattaggtatatttttgaatttgtaaaaagaggaggaaagtgcaaatcaggtagtatgaaagaaattgaagtgatacaattatacatttttgattatttgttcatctattctcatttctttttttctttttttctttttttttttgaggtggactttcactcttgctgcccaggctggaatgcaatggtgcaaattcagctcaccacaaacctccacctcctgggttcaagcgattctcctgcctcagcctcccgagtagttggggttacaggcatgtgccaccatgcccagctaattttgtatttttagtagagacagggtttctccatgttggtcaggctggtcttgagctctcaacctcaggtgatttgcctgcctcggcctcccaaagtgctaggattacagtcgtgagccaccgcccccagctatgtattctcatttcttaaatgatggcttgatctccattcaccccccaaattcttttgcagtttatcttgcctgttaaattctgtttaattttgtcgttcccattactagaaaggagcaagtgaagaggttgacatttcattgttccaagtaatatgagcacccttttaactggaattttttccctatgtaataatgagttgagaattggttcataaaatattatggttttgaaaatgtcagcatggtatcttaatgatctagctttaattataatgacttgttggcatgaacctttggtagtaaagtcttcagaggctgtgtaaagtaaacagttttatatccatgataatgtctaaagacctagaactttaactaaggaatgtatcctctcttgctagtttgggattatgaatacataatggctatttcactttgaagaatgttcaaagtctaatataaaactttttcctctgtggataagatataaatatcacattgaaatttagtattaaaactaatgttacacatatggtaaaaaaaaaaaaaatgttctttgtcctttgctatggttttaaaggaaaagcaggaaaataagaggcaaattcttcccctaaaaattctttaaaattcgaacattcattaataggcatttcgtggaagacatatgaatggccaatgcatgtatgaaaaaatatttaccctcccaaccaccataaggaaatacaaatttaaataacatcttgttgctatcagttgctagtcccttgaaagactttattgataatatcctgtggtgataaggggacaaagaaaatggcattcagatgtattcgtggtctagtgggccatgcccatcggggttcttaggtttagctaaatattcagattgacccacctgtcataagccacatctggcacctgttgctcagaagagaggtagctgggatagccagcatgctggcaggtgttgctcttcagtgggagcctgcgtgacactccacttagttgtccatacaaccatctggaagccaccattcttggtaccccaagatacaactttgctgctaagaagtgggtttgagccttcctggcttgtaagcctcgtgcccccaggagccaatatctatagtaacagctgtactgcatagcttcccagttctctgcaaagaacataccagttataaaagtcattgaacccaggaaggcccaaagatatggtacctattaggtatttatggttttttctctcaagatacaatttatcaattgggttattttttcctaagcaatgatgcttataacactgttgacagtataggttcctaagagaacagagctagaaagttaaccaaaggtcaaattctcatataaaaggaaaaagggtgttttttaaccctttactcataaagaataaatgagcataatctctttttaagatcacatttggacagtaaacattgaaaacttttattgtgtgtgtaccctttcaagctggcaattttgttttcatggctttattgtaacaaatacgaaatatgcacaaagatgtgtctgtgtctatatgtaagtaggtttattaagcattatttgccatagttattaattaataacaatctaaatgctcagcacttgcttaagaaaattatagtacattcatattctagaataatatatacgtttataaaataggtatgtccagaaacaactttaaaagaacatatataccaaaatatttagtgtgtaactgagtggtgattttctgtgtaattttttaaaccataagccactaattttttactttgatcatgtattacttttctaaataattgctcttcataaaaattaccagaaaattggccagacacgatggctcatgcctataattccagcactttgggtggcagaggtgggtggtcaggagttcgagaccagcctagccaacatggtgaaaccccgtctctactaaaaaaaaatacaaaaagtagacgggctctgtggcatgcacctgtaatcccagctagttgggaagctgaggcaggagaatcgcttgaacccagaaggtggaggttgcagtgggtcgagatcacgccattgcactccagcctgggcgacagagcaagactctgtctcaaccaaaaaaaaaaaaaaaaaatcagaaaattattgtcagttttaatgcaagctacttacattaaatgactaatcatacattttaagagtttgttttaataccattaaaaaagcttgatcttgaactttcttaatgcatttaatgaaattctatgttctataaactatggagcttcatctcacatcaacatctgaagtgataattttgaagtatttcaagccataaaaatcattcagttcactttctcatatatactattacttgaaactatgactcagtgataaaagtggggaaagcacatatattttttatagaatttagatgccagctctcaagttcttttctcaggttatgggtaggttaatggatgccatcattactaccttatggatttgtttttaaatacatccaatttattctccatcttccacttgggtaatatacacacatcatagtttaacattacctcacccactgatagtcttgccactctatttattggtttagaaaatgtaaaacaaatatttcctcaaggggtatgtggtacttggaggaatattaaaaagcaaaatataattcatgctgtaccttcaataaaataagaattatgtgaggaatattcaaagaaatgtttattgcatttgttacctgctgttttgtattagctgtgtttcttgttctccatacaaatggatgatgcagagttagctggctctgtagaagtgctgtagaagtggattacagtagaagaccagtctttgggacacagattggaattctgatcctggcctcaccaagtactctgttacccagagactcagtttcctcatttacaaaatgaatagactagatatctcttaggtcttttcaactgaaaaaactattaagaattatgtaatttataacattaagacttatgatgataaaatttctgataattttgtgtttttttctttcagtttgtatctgttcaaactaggaatagcaccccagatccaggatttgttgggcaaagtagacttcacaggtactactctttatctttgtaattttttacaatctagttataaaaagtaccaatacctggccgggcgtggtggctcatgcctgtaatcccagcactttgggaggccgaggcgggcggatcacaaggtcaggagatcgagaccatcctgactaacacagtgaaaccccgtctctactaaaaaatacaaaaaattagccgggcgtggtggggggctcctgtagtcccagctacttgggaggctgaggcaggagaatggcgtgaacctgggaggcggagcttgcagtgagctgagattgtgccactgcactccagcctggacgacagagcgagactctgcctcaaaaaaaaaaaaaaaaaaaattaccaataccttttttccccattttgatattattgatttcccttattcctgtatattgatgagaagagaaaacagacctatcttgtttgttcttgactgagttctccttctccatgtttgtgaaatgagaaacttgggctaggttcttcctaaggctcttgtttacaaacaaccccacttcctgatgaagacatttcttgatatgattgtactcattcctgcatccatctctgtctgtagctttctctgataatgattatgattattttgttctttgttagaggaggaaatcagtaatatgagaaaagaacttgagaaatatggaatacagatgccatctttcagcaaaataggtggtattctggccaatgaactgtccgtggatgaagctgcatgtaagtccattcaaaatccaaacttgccatggatgtgagacttacctgtactttacctattgattttgattactcgaaatagaatatttagaagatactttaagcaccctaaaagtttttattatttgttttatagatgattaatttgaggatgtcagaatataaccaagtaattgattttggtctttagacttctacttgtacaacatgaattgaggttctagaaataccttcattgtccatagttctctactttctgtgtctgtagattttagtggtagagttcattgttacaggtcttttagtattgcaagctaaattgcaagtatttcttggaaccaacatgttactttaaaattacccatgtcgccctgaccagagggcaaggattgacttaccttctaactcctgtggttgacatagggcttgcttcattttagccattcagtgatgtataaatgagtcagaattacttaacagatgctgagatcaggaccaaagacagccatgtggagaggttgtcaggtgctccataatatgtctcagttctctttttgacatatttactggaagccaagaaagaaagtaaaactgcttgagtttacacagggtcaatgcaactgtccatgttgtcttttgctgataaaaacctttttctctctctctctttactttttagtacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaaggtgcttagattctgagtaataaaaacagtaatgaatgtgcttatgagttactagtttgaaaagccttaatgttgaaagcaatacttttaaatcaattggctattttctctatagccgtagacaattgatttgaatgaaatgtagcatacaagaggaccatacactaggtaaggcaattagattatatccctatataaggcataaaaaggaattttatagtccaggcatggtggctcatgcctataatcccagcactttgggaggctgcagcgggagggtcctttgagtccaggagttcaaaacgagcctgcgcgctatagtgagaccctgtctctaagaaaataaaaataaaaataaaaaattagctgggcttggtggtgcaagcctgtagtcccaactactcgggaggctgaggtaggagaatcacttgagcctgggaggttgaggctgcagtgagctgtgaccctgccactgcactccagcctgggcaacagactgagaccctctctcaatttttagaaagggaattttgtgatggatgttatatattgacagaattaaaagtcatgttgcaaacttactaatgtccccaggaagtgtagaagtagcaactcatgatcatcccttgttagacatcaacagaccttacattagccaagttacttttacatttggtagtagaggttaataattcagtgtggtgaagttcagagaggatgtttttgaatctacagtcttcatattttcccaatagtcaatcctttatatttgaggatgtccctcctgtacaagacagcctgctcctaatcgtaactccatttgtaaccacctttctgtgtagtccattattgaaaaatttgtctacgctgagagcttctacttcctcaccagcttgtctctcattaagctcttgccatgtcagtttcagctccatgactgaaagtaaccactttaggttttggcattttctcaactggtggcttccaccagcatctggcagggttggcctcctaccttgagattctctgcttcactagcttatgtgcgtccttgctgccacagttctcctctgtgcctctttctcctcttccttctccctctcagtatggggattcttcaaggtctgacatggaatcccttctctgttcttcttccattgagctcatccacttgttgaagaaatcagccatcagctttatgccagcccatcccaaattggcctctctcctccttctccagataactttgtctgtgtccctctggctttgtaccccattatatcagaagagttccccttgctgacttccctggttcagaatgatggccgggtttgtctcagaactctttttatgccccctgtgtcccatgcattgctagattctgctgcctactcttgttggagttgaatctgtcgccaaccttctagtctcaccagtcttgcctcagtcctgccccttctgacctcattgcatgactcttctatcaagcaccttccttgtgggtctctctgcctcctgttactctctaagccaatccctcttaaagctagaggttacaaaactgatctttaactacaaatcttgtgttaacccaccagagacatgccccgattctctattacctactgaattaaataccaaatcttagcttagccttcagctgaccccctcatctttttggctcaccatggacacactccaagctgtagcctaatgtgctaagctttccatctgtgtaaccaaatcctgctgtctgtttcctattcttgacattattctgttgctcgaagccctcattgattatgatctctttgcaaaattttcttcccaactaagtatgaatactttcttaaaaaatgcttatagtacttctcttatagaacctattctgttcttctaggtatatttattacttgtgttcttgattttattagatcaaatcaaatgaaattggcactattcaactgtttttgatctaaaaaaagggcaataccaagtggtccaaactaatgttttccacatttgaaaattagcccttttcaaagagtcaccgggtctgtcattcatctttgtagtctttgccagcattctcccctagtcccctgcacagagcaggcactccacaaatgcttgcaatgaatttaaataattagggaatggtttttgtcactcttcacatttttccatttgaatttcgagttttggaaatattttatttaacctcagaaatcagtgaagactttgttttgcagaatagctgtatttcagaagaagaaagagatgcttatgaagaactgctgacacaagcagaaatccaaggcaatattaataaagtcaacagtaagtaatggatcgtatgaaggaaattgatatttccgtaagatacagactttccttgccagaatcccaacacaactctcaatttgtatacttggaaaactgccttatacaatgaaaaatctactcagtgtcagtgttgctcttaattatggtgcagcatttggcagtttcccactgggctttttttggtgatctcagtccacacaaagtatcctgaagctagtttgattctaccttcctgtttcattacattccacattttaattctgtcacttttggggctaatactgaaggtcatttagtaaaagattataatttacagattgtagttgcttgcccatgattatgcgatgatgttctattggaattgtaaaaggtactattgacaccactgctctctgtgacttcccagccattagtctgttgtttgtaagatttttcttacacttgtgtaactttggtgccagtgaatgggactatggacaggccagatgaaatctcatgatggcagctttgagtcccacacccctgagcctctgtggagtcaagcagatgagttcctcttagtacctggctcaagtgtctgattgtaaagaacagcagactcaggtaattaaaataagcgtatgcaggttgagatacatcaatttttttattagtcttttctcccctctggcaaaacctatttttacttgagcatcagaagagtcagtaagaaatttcatttgatgtttatttttccctggtcaatctagataatccatatatacccaaaaaactaatacatgaaaggccatttagcctgcttaataaagcatgtgaactccctgcgaaattaaaatttggagtatccactaattacaacagtcctaaaccttgccttccttttaacatcctcgttgagttttgaatattcttttttgcttgtaactcttgcaaagaagtgtacacccacggtgttactaagaagtctgctcctaaattgctggagagaaatatcctaaggggctcaaacagtaattaaggaaagccccagagggttaatgtaaatgtctaggagttaacaactgaatgtgtttgagaatatgcctcacatacacataactgggctgaaaactctcaattgcctttatttttttaaggtaacaccttaacattttagggtgcatgtgcctgttgttttattcttgtgaaatcttgaacatgttactgatgatacatgaagtacaatttaaagtttgtctttttgctctatgcgaaagctgagaacttcgtgatgcttgacagaaatgaattacaggaggaaattaatgttgccagtgagacatctgaggtccataagcctagagaggaaatggctccatagcctttaaccatcctttatttttgaaatatttataaccatgaaaacagttttctttttcatgttaaataaaatgctttatataaatgttttagttctttactcagtgccataatttcctgaccgcaaatttaatgccaaattggctatactttttttttccatttttaagtaaaaggcattggatgttttgcactaatggtaaaaccggctgaaaatatgaaagcaaggtttgatggctttaaatgtgtagaacatgattattctgaagtctttttatctctccccatcttaaaatttatagtccagtagaactgaaagtaaccttaggaaaaaaaccctcattttgatgacatgacaatgagacaattgtacactttaaaatacgtaagaatcagctgggtgcagtggctcacacctgtaatcccagcactttgggaggctgaaatgggtggatcacgaggtcaagcgttcaagaccaccctagctaatatagtgaaaccctgtctctactaaaaatacaaaaagtcagccaggcgtggtggcgggcatctgtaatcccagctacttgggaggctgagacaggagaatcacttgaatgtgggaggtggaggatgcagtgagctgagattgcgccactacactccagcctggatgatagtgtgagactccatctcaaaaaaaatttaaaaaaaaaaagtaagaatcattactttgacaagattttcctcaaccatgtaggttattatattaaaatgttaaggcatccacattcatagcaaccatagtaatagcatcagtgacaatgttggtggtaatgtcaacagatctgttgttagaggcctcagctttgttcacattataaccctttacctttcaggttcagcaaatgcattccattcattgcatgatattttctgttaagatcagagctggacattttgcatttctttgcttttttttttttttttttttttttttttccggacagggtcttattctattgcccagtctggtgttaaactcttgggctcaagtgatcctccttcctcagcctcccaaaatgctaggattacagacaaaagctaccacaccctgcctggacatttcgttaaatgcagagtgtaaaagagtggttgatcttaccttatttttttagaagaaattgtttatttaatagtgtttttcaggctaggtgcagtgactcatgcctgtaatctagcactttgggaggctgaggtgggaggatgacttcaggccaggagttcaagaccagcctgggcaacaaagagagactcagtctttacaaaaaaaatttaaaaattagccgggtgtggtggcacacaactgtagccccagatactgtagagactgaggtcggaggatctccagagcccaggaggtcgagactgcagtaagccaagattgcaccactgcactccagccttggcaacagagcaagactgtctcaaaaaaagaaagagagagagagagagagagagagagagagaaaacagtgttttaaagacatgattttctgatgtttgaaatatagctgtacaaacccatataataaatttatcaaaggtaaagcaagatcctacctagagtaatccgagatacagctgaaaggccttggagtaactttagcagaacagcaaataccacaaacaaccactagccttcctttctgaaattttttggtttgtcacattaattttaaagatagaaatgctaaggttctcagggtcctttaggttaagtgtgagttttctgggggatgacttgaaggattccattaatcataagtatttcctgttattgaattatatctcttagtaaaaatattgagggaagatcctcgtgaatgtatttagagaagataaattgtcatcttgtcaaaaagggttagaagaatcttagctgcaatctagtcacgaattaggcagacaggctaacccttgaaaggctctaaaaatgtatgggtatgtgttacttctgctacccagatgccttctctataaggcaaaactctgcaatctctgtctgatttgctctttcctggtggcagagttcatcattcattctcccatttactcagcaatttcatttttgttctctgaaaactatgctgaatctactgttccaagcatctcagtttggtaaccaaaattcatttctttataatctgcaccttacaactggttgagagatcacagagtgtattagtccattctcacactgctataaagaactgcttgagactgggtaatttatgaagaaaagaggcttaattgactcagagttctgcatgtctgaaggaggcctcaggaaacttacgatcatggcagaaggtgatggggaagccaggcacatcttcacatgcccaaagcaggaggaatagagagaagggggaagcgttacacacttaaccgtatctcgtgagaactcactatcatccagggggaaatccgcccccatgttacaatcatcttccaccagatccctcctccaacattggggattataattcaacataagatttgggtggggacacagagccaaaccatatcacagagtttatggttgtctcagatgttgcagcaatatgtccgagtgcttgctgtaggcttaccgcagtgcttatgtgttaggaagatataacagtagggcaaggcttgcttctggtcttcttgtcacttgaagtctccttggggagacagtactaatgcacaaggagcacagggaacatgcctgctggaactacatggcccagctttaaataactatggtgttcacatgatgagaaatccttaaggactggagcaatctgaaggcttcagggaagaaatgagaccagagctggtcctataaggaaggattttggaaggaagtcatgctactcaggaatgatctcataccctaagctccatcaatgctaaggttcttgtaggcactaattccaaagattggattagtttgaattactgagataacattttcaaagccttacctaccctctgcctgcagcttttcagagttcatgaaaagtaactgcttaggttcaaatccttgggaagaagggctggttgggtgagactgcagtggaaagagcaaccattctgacaaaacatgaacccccatcctcagggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatggtaagtcagaggagaccccagctgtggggacggtaaccctgcgtgccatggcgcactagggaagcctagttaggaaaggggaatagggatcggggatctctaatttgtaccagtcctggtctcactggcccacctgtaccaattccaaggccttcttccttgttaattcttgcttttagtctacataaagaatctaagagcatagttaggaaattccagcagtggtctatacatatacctgtgaaaataggttgttcttattttctgtgtgatatttgaagacaccttggataaattttagctataccgatgtggtattttttttacaatatataatgtttttatgtagaaaataagctcaatctgcaattttagaaactgcaaataagaccattagcaccatggctttgatttttgtgaacttgtgcaccttaatatgacaacagcattcaacaataatttcatacaaggttacagtaattaagaacatgtttactaacactcttgtaagccaaacaatgaaacaaaatgaaaactactgaaagcagaaccaagaattcagcatataacaaggctcgtatttcaagaaggtggggaaacaactatttaataaatgatatccttgcaagtgtttaagctttgttaagaaaacattaactcactacacatatatcaaaataaattttcaacataaaatgttaaatataaaaaataatttaacaaattaaagttctaaggaaaaacacaggacagtcattggatctttaaagtcacaatcagcacttatccacacacaataaagagaggccaaaaacatgagcaggcaattcataaaacaagaactatacaaatgacaaacaaaaaaaaagtttaaactcaatcagaagtaaaaaatatataaattaaaacacagtacacttatgatttaaaattagattggtaaagattagaaagatttaacccagcgtagggatagatatggggcccaaacatctcctacacagctgctgggagtatgaattatacagattttctgcagggtggtcttagtaatacagatcaaaagcccatgatgctgacagttacgttctagaaaataagcctgaaggatatgaaccaaatagctttggccacagagatgtttcacagcattgtttagaatactgaaaaccaggaaacaaatgtttaattaataacagattgcctataaattaataacatttatggtgcttgtacatgtgagaaatatgtgcaaccagtaaaaatgataatgtaaagaatgactggaaaagatatccatactaatattaagtgggaaaaataagattaagatatatagcattatcttgttttttgcaaaaagaaagtgaagtcagttataaagacaaaacctctgcaaatgtatatatgaatttaaaatacataaaaggatatacacaaaagagcttgagtggtagcatttgttttcttattcttgcttactaagacttctgtattggctgagtgtggtagttcctgtctgtaatcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattcaggttctctcattaatattttcttccacttctctggctctgaagctcaaggctacttatgcttgaggacactcattcatcctcaactggccatagttaacctgtggctgtccaacctcatttcttcttcctctctccttatcctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgctctcgatggtaaccccttcttcccatttgctttgaaagattaaactatccctttttattctgaaatcagtttgctgcgagacttctgtggagatccagaaagatataataatgcattttaagatgaacattatgttatatattaaatacctgtaatatcctaaatgtaaaatatgtatcagcttttccttagtggttctttttcatgctcctgctccttatgtcccttcaatatgatgaaaaaaatattccttttgaagttgggccaagataatataaaatggttaaatggaagaagatattaaaggggaagggtgttctgaaatctaagacgtatttttttggataagctaaatccagattttaaatcatataaacctggagatctggccaggtgtggtgattcatgcctgtaatcccagcactttgggaggctgaggcagaagaatcgcttgaacctgggaggcggaggctgcagtgagcctagatcgtgccattgcaccccagcctgggcaacaagagccaaactccatctcaaaaaataataataataaaaataaagcaaaccaaaccaaacaaaaaaacctggagagctttacttgctttaccaaaagatcacctcagatttcttcaaatatcttgacctggtagtgtattttaaaatttctattttaaaatttatgaaaatgtcactttaactttttttgaattaaatcagtagtcttggtttgaagaccttgctttgtgcttcagattataacttttcagtgaaattctcccaaccttcccttaacccttaattcaaactggaaatcgttagctgtgctaaaatgttacctggcactctcagtcagtgacaatgttatctagtccttggcttaattatatggctggactgagcctttaagcaaccagtatagctaggagtagggatcagcaatgggaatgcagatatttgtggaatcgtaacttttcattgtaatcaacccagtcccaaaaaatgatcatctaatgaaagcccaggagccatatacctgttcttaaagccagtggaaagcaggtggccacgactcctctttctgctgagctatcaagttctttgactttttgttgtttgttgaaatgtgcattgtaaacctccatcatgcacatgaggtgtgttgtgtggggagcttatgttgccatatgttttccaacagaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacggtaaggaacattttccaaaccttctttcaatgcagaaatgcatgtttggcagatcttaaaagtgaggaatttgcctgttggtggagaaatccatataccatgctcatgtttcttgaaaactagtctgttttaagagtccttctaattagtatccttgtttacagtattccttctggggaacaagaagaatcagaaagtgatcatcctgtggcaattaataaatgactttgtcgttggcaaagattatttgataggctgaaaataaaggaactattggaaacatacctttccttgggcgtcttttggaaaccgcagaatgtagaagagttggaagcaactttaataatcatccagtccaattcttttatgtcactgatgcagaaacagaatccgggttatggacctaaaattgggcagttgggccccaaactccactcttctgattattaagccaaagaaatcctgagaccacagtgggtcatggcagtgggtaacaacatccatttatctttcatttcatgtttctgaagtgtgctaccagatagtacaactgatagcattgttataaaacactatagcggatcttgagagaaaatcaaatggccagaattgggagccagatgagagagtcgctgagataaaagccccagttaaaatgagtgaatcttggattcttgtaaccaccagggggagatgtctgcacagatcttgacaaaagctcttttcagctactgattttggaacggctctaataggcaggttggctaattctcttgggtcatgtacagttgccaaggaaaaaccagagatttcttaggttaaacaaatggtatttgaccacttgtctatgtagtgaatggccaaaaggtaatggaaggatggtgggttttccttgtttttagtctttttggagaaactaattctcttgttctacttaaatttggccatctggttcatatgactccttagagtgtgtttccaaggtaatttatatctaccaccactgtttctgttacttgttaatggcaccattctctcctgtaagcttagaaacctgaagcccaatttgagtttccctctgccctcagccgggcaccctcgtgctctaaagagcctgctgtcagtagccagtctatgtgccttatacctctgcaagatgtttccatttccctgcaaccaccctcacttagacttctcacttttgcttctgtagtaacccctaaattggtcatcctacttcttttctctccccattcattaatcattcctacctaaccaggctttgccatactttctcagtgctagagtagaagacagacccggtcaatcccttatgaagcttacaggctaatggggcatcttggtgagataactgtcaagactattccacatatttagcatccctggcaactgtcctccacatgacattagcccctgactcacccattctgattatcaaaaatgcctgcttcttcatttacaaatacccttaaagaagtggtcccattctatttgaaaaccatattcatacctgtagtttccagctgggacctacagatggagcctcacagttcgagtgttctgtgtgaagaacttttaaaatgttttgattttttttttttaatttaaatacattctggatctggaagacccagtactgacatgggatttaagggcccacttgggttcttgtattgacacttgtattggccccaaatgatcttctacagccttggcattttacttccaaagtcagcatcttaacttgggatcttggaatcccagttttgcagattatcaagtttgagaaacacggctctgtccagggcctctccccatagagtgcaggttcttcatagcacaagtgtgctgtgcatggccaccttgacaaattcatgcaaagtctctccctgttcaccgtggcttctactcttggggctgtgtttgcccagagagattcttttgtctaattctcacaaaagtattgtatgggttaacattagccttgggcatacactgttcccagattaactgttctaaaatgtaaccctattcataattctgtttgattgttccttgttcacatccgaattaagaacagacttctcattctaagcatgttgctctgaccttacctccagctccatccctactcgtattttgtgctttagccaagtccaagtgtactttctggtctctgtgttcctatgcgtggtcctctcaccatcaggaacttggtgcctttacccagctcagctaaacacagtattggagcttctgagccctgcctaccatacattatgttctgtgaggtatatccgtgcttctccccaccctagcatctgatgttatctctcctgggaggtagcatgatgtggttaaaggagcatatgccttggaaccaaaaatatctgagattgaccctccctaactaagcctttttccttcatctataaagcacaaaaacaaaagaaacaaaagccccactctgcatttgcagaactgttttgaggatttagtgtttggttcagtgcctgtcccagggagggtgctccaccaataagggtttccttccacttcttgctttgaaccccattatatctactcttatggactctttaatggtccttcctgtgctctgcttttatacctttttggaatttttgtcgtcttacccactggtctgaaagcataaaggctgcacctttttcctcctaatattcctgtagtgcctgccatgttttacatgtagtaagtgctcacaaacatctgctgaactaaattggattactgatcttctcagagcttcccagggctcttagattagtagactccttactagtctgtccatagatgaggtgaagagaactgagaggagtgagaggagaggacattgacctgtttggggaaactacggaatatttcccaaagttggtaacttcagtactggagagaaatactcaattggaaaagcctgtggagttctcttgtgttactttaaaaaaaatttttttttattattatactttaagttctgggatacatgtgcagaacatgcaggtttgttacataggtatacaagtgccatggtggtttgctgcacccatcaacccaccatctagattaggtatttctcctaatgctattcctcccctagttccccaccccctgacatgcctcggtgtatgttgttgttcccctccctgtgaccacatgttctcattgttcaactcctacttatgagtgggaacatgtgttgtttggtttttgttcctgttagtttgctgagaatgatggtttccagcttcatccatgtccctgcaaaggacatgaactcatcctttttttttatggctgcatagtattccatggtgtatatgtgccacattttctttatccagtctatcattgatggacatttgggttggttccaagtctttgctattgtgaacagtgccgcataaacatacaggtacatgtgcctttatagtagaatgatttataatcatataatgggattactgggtcaaatggtgttacttttaaaatcttttcctttatagcttgtttttgttcatttctaaagaaatgatgggtagttgtatttctttctgtgtttattttttactttctcatttcactcctgttgggtcagcatttagacgttaagtgtatgggatgcccataaggactttgcgcttttggaatggtctccatctgtgagggacactaaccagtgcaagttaccgataatccaaatcgttattgtggtcagtattatttattatacattactagtgtatttcacatctgcacttggcgaggcctcattcagctacagaaaataaattgttaccaccatttcctatttttgaatgtttttctctcaagctactctctatggaagacaccgcatgtcaccttgaagcatgcagaattttgaaaaagtttgtcacaaccaagaaaacagttttagacttcatataatgtttcttcttttaacctctgccattactagatccctagagactattcagaattcaaactgcagagtgactcattatgtacacagaagattgttcttcattgccctggtgcaaagacataaaagcacactaaactatctagttttattaattttcgctggaatagttcatgttagcctatggttgtaacattggttctgtgaaaattggaaagtgggaaaattgataattgagaagtaaaagtttcttaatatatcagtatgagtaagtttttccctgaaatttccccaggcagaaaaaaagtaattggagtggttgactaaactgtatcttccagagggctatgcacagtgagaagggtcattggtcataaacaatgggtgagagggccatttttaattttaattttatttttttatggagacagagtctccctgtgttgcccaagctggtctttaactcctgggctcaaacgatcctctcactcagcctcccaaattgctgggattacaggtgtgagccaccacgccaggcctaagagagatttttgagtattggctaggagcctttggagaaatgggcaggtgaaaaggaatttcagtatatcctggtttaactcatgtgccacctcttcaggacaacatacggtaaagattgtgctactcagcaaggtttctggaactgcatttgcatgttatctgattcctcagtgtcatattaggcctcaaagtggctctatattagggttgtagtagaaaaggtcttttaaaacttagattttggaaggaacaagagaaataatgaaaaggacacttgatgatagaaagattgagacccatagtaactctgaattttgccctgtaacaatcatctgaagactgagaagaaccaagacatacaaaggggaggaaaattagtaactagggaaaagtaatttcacagacttgaaagtttccagttttgcttgagttaggtatgagtttcgattttgaagagctttcattaacagaatttgttcataaaaatactttaagaaaacaccattagtacaagtaagcctggtatatgttgacagagctacacaagacaattttatttgcctttctactctttgtctaacttcataacaactatgtttgaccatgtgtcatagttgagaaacaacaggaacgaagaatgaatgtctctaattaacatcaagattattttctcttccacagttatgcaaacacactactctctgttaaactagaagttttatcccaagggcaagataacttaagctggaatgaaattcagaattgtattgatatggttaatgctcaaattcaagaagaaaatgaccgtaagtataagacactttccttctctagcatagtgggagaagaaggtatctggacaacttagttttctagattagggctttaagtttttgctcaaggaactttgtgagagcaaactccgctaatatgcatacctttatttataggtagattttatgcctataccactgtaccaatatgttataaacgttacaaagcctacacaagaattcataatataataaaatacacaagtaaaaggcctgatttttctggttatttgtacttcagagacagctaaatacagagacagctaaataactcatatttttaagcacccaattttattttgaccttttatttgggcatctttttttctgaaatatgacacgatttttctgccccacaaatggaggaattggaacacgatctaactgttgcttaatgatcacaaatcatggtgatttgctgtgtttctagaaattatgagctgccagcatgaaagcataccaacctcaggaagatatgccctgaaacatgctttcttgaatgtcagcttgctgctttatcatttgcatcttgcttatgaaaatagagtgaagaatgaggagctatgtagcttctgcagtccatacattcactgcttttctgtagtatgcattaccaaattcaagcttcgagctgtgttttccaccatgaaaacaaagcaacaccatcttctgtggcttatgagcttttgacttgtcagcaacagtgggtgagtgttgctaaaatcattgatctctcctccaccttccagctttgacttttctaactcatttgctccaagctcgcggatagagtgggcagatacttctctcacagtttattatgttttattttagtgtgtttgggtaaggtcttaggtctggtcttctaatgctgtatttaacttaggaatactaagatcactcttgaaataaaacatatgactttgttaattaattgcatttgcaaagttttcttctttttctttgctgtttcctgtgagtgctgggccaaaagtcaaggccagttttggttcttgttttttaaacatattctcactttaagcccctactataaaacaggatccaggtgtgctaccctatatacggtaccatggatgtaccactgttacactgatccctggacactttcattttgtccttttcaagttgtgcacaaatctaaatttctttcgagacggcacagcttccctgttgcctctgcatttcctttcagtgaagcatttaaagtctctgcggtgagacggcttgctcacaccccacttagctcttttctgatacttggcttgggagtttatggttcttgccagacgttagtcaagacgcaagctctaatttgagcagatgttcaacatcatcaggtgggggttgggggaccaccactgctcctagtgtcccgctacagagctcagtcccccaggcttctgcccttctccacaacctccgtcttaatgctctgaatctcctttagcagtggtttggttgctacagcaactgccacccaagaagtaggactcctttcttttggtaggcaaaacaaagactcacgtcccatctttgctttctaactttttccccaattcttggcaatacccatgcttcagttctgctttggttatttctgtatgtgctgcttacacaaatgaaggtatgttagttctcagtgctgaaagattgtagggttgacattgattaacagggggaaaatgccagttttgttcttggctatcaagtacagcctttgctttagttggttactggggggaaaaaaagcaagtaacatttgcataacttagaaaatagtcttttgtaagtagatattatttttaagcaaaaatctcatttgattgctgtggcttttatctatcaaggtaacagcactactaagttattctccctaggacatttcacacagccactataacacttctgttaagtatcttgtcataaaggacatataccataaccagaaaaggtatttcagacactaatatttcctttctggaatttgggaactttaatacagagtatttaatttatctgtgtcttggttttatttttttcttttgtcagaatgagttcctgaagtattgagtttgatatcatgtttaggcaattcttcaaaatctaaaatttctaaaatacaccattgtaaccaggcaggaattgctcagtatagtaattaagtcatctgaggagctgagaatttttcatggacgttttgaaggtgcattactcttgcctccccaccttattcttgccacatgctctgagatctaattccatatctgagttgtgatgtgggtgaggtaagcagctaatggaaaatgagaaatatagaaggtgaatttaatggagaagctagctgctgaatgcatttcctcaggctctgttgatttcttactgaaaagtttacttttcccagtagaaccataaaggagcattattttaaccttatagcctacatcaggaagttttcttctttgagtttttgctctttaaatttggtaggtacaattctgtgtaggttacctcatctgctgcctcaaatacatgaactctaaaagaacgcccactctcttgtggactagaatgttatagtaacatgtgttgatgtaaagaagtggaccgtgggctgagtgaagctcagcaatctttcttcaaataggatttcccttttatttataaacagaggaagtgatgcatatgttcccagagggcttctgggtaatctttcagctcctatgatgtcattcactatgacctcagcagcttgtattcttagaaacgcagcagacagcaactttagcaggtgatttcaatcaagtcagctgaaatgcactcacttccaggtgatcggccttggttctgttaagaccatttttggatggggtgttttaaaggtatttagaacagcttacccaaggggggtgaccagagaatggcactaaatattccatgcactccagtttataaatcctatagggtaaaacgacagtaccttgtatatagataatacttagactttccagagttctgtcaatgtttacagataatataacctgcacattagagaaatacttctgctttttcttcaaacatatttaagtattatagtctggaatgatttctaggagttttagatggtttcattcttcttacaggtaaatcttttcattcttaacgaagtggtggttatgggctcatctattcaagaaatatttagctaaatattttatctttacttgaatgtcaagctggagatactttttttaaaaatgagaagtactcattctatttcatggcatatcacagttgtgaagtgacgggtgatcattttagattaaatctaatggaaaaaatgagaaatatgaagtttgaccttaaaaatgcttatattctaagcttattgttcattaatatctagtttctttaacagttcttatccatcagtactaacctaggaagcaaaagctccttggcagtgtgtgtatatgtgtgttttatataatatatgtgtgtgtgtgtgtgtgtgtgtgtctgtgtgtgcatgtctatctaaatgcatttttttatgaatggatgatagtttattttttaataataaggtattgagaagtaacctccagatagatccgtttcattagaattgtaaaagcaggtttcatagtttgacttctgtgcttttcatttgtgaaccctatagtcagtcttgttctctctttctctctctctctctctctctctctctatatatatatatatatatatatatatatatatatatatttttttttttttttttttttttttttttggtggggggaacagagtcttactctgtcacccaggctagagtgcagtggtgcaatcttggctcactgcaacctctgcctcctggattcaagtgattctcctacctcagcctcccaagtagctgggacttgaatagacacttcatttctttaaagatgatgtacaaagggaaaataaacacatgaaaagatgctcaaaatcattagtcactagaaaaatacaaatccaaaccacagtatgataccacttcacacccactaggatggctgtaatgaaaaagacaataacaagtgttggtcagaatgtagagagctactcaggaggctgaggcacaagaatcacttgaacacaggaggcggaggtggcagtgagccaagatcatgccacagcactccagcctgggggacagagcaagaatctctcaaaaaaaaaaaataaaaataaaaaccagcagctgggaccttgatagaagttgcattgaatctgtaggtcaatttaagaagtatttccatcttaacaatactaaatcttccaattcatgaacattggctcttttcatttatttgtctttaagttttttcccatggtgttgtatagttttcagtgtacatgtcttatgtttctttcattaaattatgtctaaatatttatttataattataatgtatttgtagttgcagtcttatgaattgaatgtgttcttaattttattttcagattgcttattatgagcgtatagacacataattggttttgtgcttgcatcttgcatcctatagccttgctgtactagttaattagccttttgcaatcggtgatactaaagaagttataatgtactgtgacttaaaaggaaaactacttcttcattttctaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagtaagttttagtatatctgtttcttttaaattttacaggctgggtggcagagggagagaaggaggaggatttgacccatttacgttaaatctcatgagcttcttgtcccaacaattacccatgaatcagaatggaaataatagagctgttattttcctggtaacaaacattggggggaaaccagctccagagctatttattgctttaattctttgactaaaaactcagttgtaggtgagttcttgttcagagttcaattcattgactatttccttagtagatactatgtgcacacttcagtccatagcttctggtagagaagatggggatacagagggacacataataccatttgaatgttctctgaccttatcttcaaaatgcttagaaactgattgaggcagtggacattgtcacatggaacagtcaagtaatagtaaagataagggtgtgcaaagtgtcaaaatgagagatacacagattgattcacggatgtttgagattgtcggggactagaatcctaagagaagttggtgtggaggtagagcagaagctgtcctctcgaagactagtggctttttctgagtacagagcttgtaccgctattataaggagccccacaaagactggcctctgtgataaggccaatgggctgagtggtgaggctgatatgatctgtcacctaagagtgggagtgatgccacctgggacctagctacttatggctgccatgtcttcaggtgcaaacccaactgaaagggcggtcatctcctctgtctaggtctttagaacctaggaactgcctcattcgaaacaggaaaaacatccttggttaatgcaaacatttattgagaacctactatttgtcaggcatgatattagatactcatgtgtatcatctcatttaatcatcacaacaattcataacagccttctgaaccattttgccatcattattgccatcttacacataatgaaaccaagattaagtaacttgttgaaagctatctaaaatgtgaccgggcacagtagctcacacctgtaatcccagcatttcgggaggccaaggcaggtggatcacttgaggccaggagttcgagaccagcctggcaaacatggtgaaaccccatctctgctaaaagataaaaataaaaaataaaaaattagccaggtgtggtggctcacacctataatcccagctacttgggaggttgagggacaagaatctcttgaaccgagaggtagaggttgcagcgagctgagatcgcaccattgcacccccacctgggtgacagagcaaggctctgtctcgaaaataaatacataaaataaaataaaacaaaatcaagctatctaaaagataattagtcctgagactacatgcagctcaggtctgtctgattcggaaacattataattatgtattaaggcagatgggaaaagatgtttattgcagctttgtttgcaatcacaaaacatgaaaaacaacctaaatgttgttaagcaaaaaaaaaatcatgctgtgatgtgcacatagatggaatatagataggcttgtgtatgtgttgggggaggggcgcacacactcttacatgtgtctaaaatatttctggagggaggataccttctggaaggtgaactagaaggctagtatggatgggagatttattcttcactccgtttttgtactgcttggatttttaaattttttaaggagtgtgtgtattaaataattactgtttctaaacttttaaaaaccaatgtaaatcctatcctcactactccactgcctcattgaaggtggagaaatgtatcccccatggtggcgccctctgcactgccagccttccaacaggaacggcagtggcattgcctgaccctcctcactttgccaagcgcccccactcacatcagtctttctcatttaagcctcataccacctgtggaatgggtgctgtctcatctgatgtgaatgagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaaggtagacatcatttaaatcctggctttgccacaaattagttatgtgatcttggtcaaatcatcaaatctctatatgcttatttttgcatgtataaaattggaataatagtacctgtcttataggattatggtgagggttcaatgagaatatacaataagtaaatatatatcaatatataactataggtactattaatgaagaatatgtgcacgtgtttgtgtagctatagcatttagcatggagcctggcaccaaaaaaagggcttaaataatgtagctagtattattgtgggcacctatggttgcctcccaagtaaggggtgagtgatgtcagtatcttaaggttcttttttttgtgagatggagtctcgctcagttacccaggctggagtgccgtggcgccatatcagctcactgaaacctccacctcccaggttcaaccgattctcctgcctcagcctcccgagtagcagggactacaggcacctgccatcaagcccggctaatttttgtattttgtagagacgaggtttcaccatgttttccaggctggtcttgaactcctgacctcaggttatccacctgcctcggcctcccaaagtgctgggattacaggcatgagccaccgcacccggcttcaaggttcttactagacgtagagtctgctgaatttacacaccaaagtcaggatcttctgaggacaaatagagacagacctgggtccctgtctgcccacagccacatgggggtttgtctttgaggtgagcctgactccacaaacccaaggcctttcataggcaggcagtataggtcccttctagactgagcattccaatctagattgagatggaactccacaggcgtcctttgaaagaagcccctgagtgcccacaccatgccagctctgtgtcaggcatcctttctaggtgtggaaacagtagctttcatggtgtgattagagcattgatatggagcctagggatctgggttctagttcaggcgttaaaccactgttagactatagttagaggtttgaaatatactggcaattactaacagatttaaacagatttaaaatactgcaggtccaagcgatgaatcatatttggttaaattcctgtttttaagcagttttctttctctgttcattgactttgaaactttcttttctcagcctgttcttttttcttggaaaaatcctaattctgttgtttggcaatgtctttaatgtctttgtttttcccctctgctttttttttttttttttttttttttttggagacaggatcttgctgtgttgcccaggctggtctcaaactcctgggctcaagtgatcctcccacctcagcctctcaagtagctgggattgtaggcacaagccaccacattcagcatcctctactattttgattcctagaagtttccagttgtgtgtttatgatggtatttctgtgccttgtcttcccaaggtctggccttggaaaataatattagaaaattatattgctggtattatcagtataaagtaaaactgtgccaaaggctacagccattaaaggtcacaatgggtaacatcttcatagaatggctgcccagttttgtcaaaggtggaggacagtaatggaagttggtgaagattctgggtcctctttagcagtatgtcaagtataaccttgtgtagctacaaaattccttttgcctcttggaaagagacttgagtaatggtcatgttgactttaacactttttctatgtctgttcactgggtggtgtgtgctattttacaattgaaggttttgcttgtgaacatatgagttatactccaccaaaaagttctgttttgctccttgtatataccataaaaactgtgtgcttttaacgaatattgctgtattttttccttaggtaaaactgtgttgtaattgatgacttagttttcagaagtcagctccttccatttaagtttctatcttcttgaaacttactttaggtttgtttttcattctcactttagtgtttacctgagttttgctctttgcataaccacacacatattataaagggtcttcatgtggaagctttttacttaagtctgatgaaatagaaaactgtgtacatttaaaaatatgcatttaaaattgttttttattgttttgttgggcagtatgaaatatacagtcaaggcagattcgtacagacttgtaaagtcatctcaggaatcttttatgcttaaagtttcctcagccccatttatattcactactatcattcactctttaccactaatatcttccctgctgtctaatcactaatatcttccctcctgtctaatcactaatgtcttccttcctgtctaatcactgagttaagggaaaaatagtcatttacttacaggaatataatgggtattaataacaaaattccatttccccattaaaagctatgtctaagaaaaaaaatagtggaggcattatttaaaacttctaaatggcctggtgagtatagtcttagtttagcttccttacttttttgtatgcccaacctgaaatgatgtcatcccgtatcatcacagtatgttgctttttcagtacgaagttaatgggctttcctgctgtttaactgctttgagattttaaaaattcattcagccacatagtattcaaagcatggagctgggtgccacaaagacttgggcctggcatcacccagaagctcaaggaaggcagaggatgagcaccttctccattatacttggtacttgattgttcatggaattaaaatttaaatataaatgaactatatataaatgccataataaaaatatacgaaagtgctttggaagtacagataagaaaagtgacacttctagcctgagaatcagggaagaatggtccttcaaggacttgaaaaaatgaacagaattaaggcaaagacgttaggactagcttttcagtctgaggcagagtggagatatagcagagcaagaggtttggttggtgcctatatcataagcaaggtttaatgggaagtgtgattagcaagttagccttgaatgccaggctaaagatttatgatttattatagaaacagtggagttagtggaaatgttttagtgatgtatcctaactgatatctaaggaagattaatctggcaggacttgtgaagtggtggagggtaggctggcagtggagagaatggttagaaggtagaggtggcctgggcgtagtggctcatgcctgtagtcccagcactttgggaggctgagataggaagatcactcgagaccaggagttcaagaccagcctgggcaacagtgagactccatctctgcaaaaaataaaaaataaaattagttgggtatggtggtgcatgcctgtagtcttagttacttgggaggctgagacagcaggattgcttgagcccaggagttggaggctgaagtgagctatgatcaggctactgcacttcagccaggtgacgaagcgagacactgtctctattaaaaaaaggaaaaaagaaggcaaaggtgaaactagataaaagaccctggtgagggaccctacaaagatagaatcagttgatgaggcagccaccagcatgagagtcaaaagagaccaaagaataaaaaatgatgtcaaatgtcaaggatggcaataccactcacagaaatagggaagatggtgatttaaagagcttgaagtagcaataaggcaaatggaaatgtcattttccatagagttgtgatatcttttctcctgcattaacatttttaaaatactgataaagtgtttttaaaaattactaatgctggctggctcagtggctcacgcctgtaatccagcactttgggaggctgaggccggaagatcacttgaggtcaggagttcaagaccagcctggtcaacatggtgaaaccccgtctctactaaaaatacaagtatttttagtagctgggcatggtggtgtaatcccagctacttgggaggctgacctgggaggcagaggttgcaatgagccaagatagtgccactgcacgccagtctgggtgataaagtgagactcagtctcaaaaacaaacaaacaaactactaatgcttttgtaatgtttgacctttgaagcatatttcttaggagctcggaaatggagctccttgcactatgcttatgttgttcttgaaaacagacgttctctgtgatggctgtccttgttctctaagatcatttcactattttgtaaggtaagcagtggagtgatttctggtttttgacatgagaaaataaaggaatggatctaagcaactattaagactacccaggcacaaagctatgagatatataaaatataagccatcagtgttgttgtagtagtagttagcatggtgaataataagaataatattgcttggagcaaagcaaatggtaaaaatcacaaggatgaggagactcgccttaacataccacaaccatctatgatcgtatgcattaagtgtccggatgatggctgcatagcagtagatgataagcacaaatggaattaagaatccaaagaatgccaaggagatgaagtaatagagttggaagggagatgaggactcgcaagtgttgtgaacatcatggcaggtggtgatgtctggctgaacaagataatattcctgcttcagtatgaaaaatggcagcatatataagaaaactgttgcccacaccagtccacatgttaccaaggcataggtgtgcttgggcaggccccggtaggtgaaaggatggacgatggccaggtagcggttgatgctgatgcaggcaaggagcagaatggagcagtacatgttgccatagaagatgactgtggtggcccggcacaggacctctccaaatacccagttgttcccattgagatgataagctatcttaaagggcaatgtaacacaaaaaagaaaatctgcaatggccaggttggtgtagaatacagtggtacagatggatctggtcctgaagaaaagcatccacagggtcacagcattggccgggacaccaactacaaacaccaggaggtagatggcaggtatcagtttagtacttaaggagctggtcaggtaccccatggtagcatttttcacatggagatgtgaagcactttcttcagggcacttaatttttacagtaatcgtggctcctgtccagccttccaaggcagaaaaggggaactcttcaaaagaatttgggggagctccacgaaaggtcttaatgggtaaggttggctttgccaagttgtttgtatcattttccatgcctgtaattgaaagaaagtattaacataaatgtatagttcaagagaaaagaaagtgtgtttaattatttgtaaataatttctgtgattgtagaatttaagatcatttttattttaaaaagttattgtagattaggcagtcaacaagcatatatttaatacatatcatatgccccagaacaacactatcttgtgcggaaacaaaaactaaatgatcagtccttgtatgtaaagtgtttataatactattagaagaaacaaaaacagcccatcagaacattataggcatgttgactacaaactatacaggcattcagacaatacttaatagattcagatgtttgagcaaaatgtcaaggaaaagatgaacttgagcaaagactagcaaggttcctaaaaagatggaatttaatgagtaagattctgctggtgatgaatggacagaagcatagtgtgggctatcatgggatctgggaatgccagataagttgatttagcaaatttttattgtacattgatgtgtcagtggtgtaaagttttaaataaaatccatttctatctgtaagtaatgctactcgtggagaagatgcataaaaatgcattgtcttatgcgaataaagtgcagctgagaaaggaaattgaaagagtgggtgacagctaaattcctgaagggcctctaaactgtcctaagaaatcatatgtctattcacagatgatgggattgcacacacaattttgaacagaggaatgaccattgtgttaggcagaatagtagccccccgcaaagattctacctgctaattcctggaacctacaagtatattcctttacctagcaaaagggattttgcagatctaacttagttaaggatcttcctttttttttttttttttttttgagacagtctcactctgtcgcccaggctggagtgcagtggcacgatctcagctcactgcaacctccgcctcccgggttcacgccattctcctgcctcagcctccccagtagctgggactacaagcgcccgccaccaggcctggctaattttttgtatttttttagtagagacagggtttcgccatgttagccaggatggtctcgatctcctgacctcgtgatctgcccgcctcggccacccaaagtgctgggattacaggcgtgagccaccgcgcccggccagttaaggatcttaaaatgagattttcctggattgcctgggtgggtcaaatataatcataacagtccatataaggggaaggtaagagggttgtcaaagtcagagatttgaagatgctatgctgctggctttgaagatggaagaaagggtcataacccaaggaatgcaggcagattctagaagctgaaaaaagcaagatagccgattctctcctagagcctccagaatgaacacaaccccaccaacagccttgattttaagacgtctgatctccagaaatataatctgttattttaagccactcagtttgtaatgatttgatatagcagcagtaggaaacgaatatagccgttattttgacttgtttttaagatgacttaggtaatagtgtagagaacagattggaaaggtaagaaattacaggcaaggggacctgatttggaggctactgtcatcattcatagctcagtgagttactgagctagaacagtggttatggaaaggcagaggcgaacacgtgagactctgatggcggcttaaagggacttggttctgattggctttggggtgcagtgagggagaggcaggaagcaataatgactcaggtttctactctagatgacttggagggagaggatgccattaactgagttggagggagacaaggagacaggatcggggagaagctacaatctgtttttagtctgactgaggatgagttgctggtggaatattagtgtgtaaaatgtccagcaactggttagaagactggatgtgggtccaaaattccaggagcccaaattagaggcatgatttattgtagtctgcatggaggctctcgtttaatttaatgggagtggttgagatggcctagggggagttatgagaagaaagaatccaaaggtggactttaggggtaatgacagattttaagggaagaggaaacaaaggaggaaaaatcggaagatgaaatcggtatgaggacctaagaagttggaaatgaattctttaaaagatagaaacacatcaactatatgctatcaatatttggtgttacttggcatgttgatgttaataatcctaattcctgcaatttcaaaaacaaaatcttaaagctcaaacctgaacatttattattatataactttttgtaaccctttcacatgtatagaaaatagattctcccagatttctaatgttacctttaagatagacttctatgccaaatataaacctcattcttatcgatttaaaatgccagtactgcgccattatgtcttgtcccatggcctcaaaattcctccatattgaatacttgaagttagtgtttagtaacctatgtttcattcagagccagtttctcttcctgctttaatctctagcagttagctcccgggtgaaatggaaaccctccacgtaaacctgagattgcacaagctgaattcacggtgtaaaatagaggaggtgtgtcctagtaactgaggggtatggaggtgatcaggtatcatttaagaaaaggtagattaaagaaaaggaaagaaaaatttgggaggcagcattcttctatgcctgtatttagaggtgatcttagaagctgtgttgtgtgacacacaaacccttctgctcacttttgcattttggaaaagttcttgcatctgacttcacccaaagagaagtgcctttaaagataggcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgttaaatttttttattgtattttaattctttatagaggcttccattgggcataatatttcggaaatgtttttctatccgggaaaaggccttgaagaactaatccaaagagaatgaactccggcctctcaggggtgtccaagggagagaatacagtcatggattcatagtttctgtttctagttgagccagtaaagccccttcctcatccctcttttccatttacctctagagacagaaactaaaaaccatggcttcaggctgctaaaagcctaaaacaaaacaaaaccacaacgaaataaggcaggttggacaagcttgcttcattcttccttcacatttctcccccaccccatggaagaaagcaaattcactgcctctttgtttccttcagaggcccccgttttcacctccatcaaaccctattagcgtcttgaaggaaccacccccgaaaaccttgcttcttttgcaattctgcttctcaacatattggcccatctactcccagaaagagcgtgcacttattatattcataaatcccacatgtgcttactgctaatcaccacagattctcttagagctctctgcaaccgctcagggattccaaatgtgaatttaagcaatgttcctttagaaagcattgatttctgtttttgtttcccttgctatgtccagtctttgcctctcccactcctaacaatgttgactggagtgtgtgacctaacaaagagtaacaggtacagacctatcccaaatttgttatttttggaaaaagcaggaggtttcaggctaacattgtgatgggtaaagtggaaagtacattcaaagttgaataatagtatttgggagaccttatttttaaaattaaaaaatcatatatgagggtagggagaactccccacttaaagtcaaaaaaggtcattcatttcggaaatactgacttattagcattgccagctattgaaagcagatgactttctctttctggcagtattcttgtttctcccatttatgtctcaccaagaggtttaaacacaggatatatattttaatccctagaaaaagtgccatctttgcttaaccagaagagaaattcttacaaacacaaaaacgactttcaaaattgctccctgacttaattgtagacatctaaaatcttgaatatgccacacatttttaaacatcaggagggaacacttagtctatgaccaggtttgaatagagtgaatgaactatagatgttcatttccatgattctaccttttaataataaagatcaaactgcctttggggtttacagtttgtgtgagatgcaaagaaacctaggttcagttgactcttaatttgtaacagaaacccacatccccatcctaccccctgagaaaattgcttaccactctgacaaaaagtgggcaacagaagcaggaggccagcagctgcaaagatgagggctttcattttgatgacctgagtcccgtctcttaaacgttatgaaatctgtaaaatcatggagcacaatttcacctcagttccatgtgtcagcagcaaatggaagccttggtctgtctgtagaagtttgctctcctgtgccgtgcaggcaggaaacttgccctggtcctccgcagggaaaggatgtaatccactcgatgcttcagtaagcatgactcaggccaagcctctgaacgtgttacgttatccctggagaaaggcatttaactcttacccacccccaacaatctattctgaataggtgctgtaattctcccctagtagatttgcttttaaagaatggcagaaattacacaggcctttacagaactaagccaaaaacagatgttgaacagcagtaagttttgaatctgtcccacatttcatttcttatccgttttaaaaatgcagttccagagtgtaatttctacttaataaattatcctttcctttatcttcccagctatttcaaatcttaatccttaaacactttacataattataaattaatcatggaaaacaaacttttaagaaattcaaattgagcagtgaatcactttgaaaattttctatcagtgtaatattgatttcagtttgtcgtcagtgcctggccagaacctggcttttgagtggtggtggtttttcttcgccgggtgaggatggcgtttgttcaggctttttttttttttttttgccttatcttgatgtgttttgagccattcaataacccttagggtcagataactggaggaacctcccaaacaacgctgttcagttaaactaaaatcatagcacatcatgaaaatgaggactccctttattccatgagtgttggtgaataagtctacaataagatatttttaatagtggtaaaatatacgtaacataaaatttactatcttaaccagtattaagtgtacagttcagtaatgttaaatacattcacattgttgtacaacatataagcttttatgaattgttatattctgtagagtatgacttaatatacagtaaaaaaatgcattataacacatttttctgtagttaataaaacttaaacttgaagcctgaccatcccacagcctgctctttacaaaatgcagcaagaatcagaaaatacaaatttcacatgagacttaaaggctagggatatgctaggaagaaattgatctgcggaaacctttcacatcttgattaaattacattagaccaagatttttacaaaggtcagtgtttaatacttcaactacataatatatggttatacaaactgagatagaatgttattatattgcagaaatataaaacctaaaatattgacaaaggttttttttgtttcattagaacttttctgggagttatctaaattcaggaatttatgacttgatttgcacatggcctagtttctggtcatttaattcatttgtaactcttatgttgaacctggctgtttaactgaagtggaggtgtggccgtcccataaatatactattattttcagtcttctggtgaacaactgaaaaagcagacttggctgggcacagtggctcatgcctgtaatcccagcactttgtaaggctgaggtggggggatcacttgaggtcaggagtttgagaccagcctgaccaacatggtgaaaccccatctctactaaaaatgcaaaaattagctgagcgtggtggcgggcgcctgttatcccagctacttgggaggctgaggcaggagaatagcttgaccctgagaggcggaggttgcagtgagcaagcctgggtgacagagcaacactccatctcaaaaataaaataaataagaaaaagcagactttacattgataagattcagcttttacttttggttttacatttaactctagtaatcgttagttcaatgtttcataatttaaaccgttgacttaaattcatctgatttgtaatttctctcttcagtttggcctataagactaatactttaagctttgaagtaagattgttactgccttctcatctgggtagaaatctgtgtggtgtatcttctacagtgataagttatgaaggaaggcaaatacccttcaaaagaactgagacacataaatgaactcatagagcttagtttttaggttatagctggggagtgttgggttctcttagatcttgtaaacagagaaaaattagctcctgcttccctgtctctttttttcctcctctagtcttcccctttccacccggcttcctgtttgagcctcccccatccattcttgaaagaaatggaaaatcttgctgatgcttcccttgtagtctgccgcatagctagaggtgattgtggaagcaggcaccaacatttccccagaggtctcctttagcccagatgttgcacgatgaaataacagatagtttatctcattttcagagccctttccacatgcattatctcacgttaacctctgaggaaaatagtgttagaagcctgccagaggaaccagtgactatttcctctccttcctgcccccatccatcttaagttttaaatgacggagtcggtgccagatccattacctttcattcatcacagtcttgacttaggatttagaacacgacacttattcctacacataggtaaaatgttcccatttgttaaatgtcacatgtttcctgaaaatatctctgctgataattatttacttgccatctcagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaacttgacacctttaccataggttaaccctttctcacctatgtctggatcatgtgtctgcagtatatattgccctgatcacattgtattataattgtttttctttttttttttcttttcttttttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagtagagatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgatgatccctgtgtttctctcaaattaaaaatatcccatggtaccctgggacaccttgacacttagtttgggaaccacaataattgattgagggagagagtgtttgactagggtagcccgggaagactttttggagtaggtagcatttgagttgagacctgaatggtgagaaaaagccaacagccacacagtgagggtagagtattgtggtctgaaagagactcgtgtgaaggtctagaacaggaagggggaagtaaacgggtgtgaggtgcagccagagaggcagtaggcagggccatgccgttggagccccgccatccctgagaaggcaccctgtgtttccttctaactgccggggggaagcctttggggaagctttaagtagaggagtggtgcactgagctatctattttgaagggatcctctgggccctctgtagagggccactgtggtgagggcaagcttagatgcagcagaagctgctagggggctgatgcagctgtccagttgggagatgatggggggctggactaaagagtggtggggaagaaggaggaagtggtcgggtttggggtctgcttcattaggagtgtgtacagtatatggcagagctggatagttgctgattaagaatttgtgggaattatgattaaatggctcctcaaaagcagttattaattctgtttcctcatcattcactcttctttctttttattctgtgacattgtccccaggactctgagagtgtttccaaagtgctttggctggatgagatacagcaagccgtcgatgaggccaacgtggacgaggacagagcaaaacaatgtaagccctcacctcctttgctcttgaaacttgcctttttggatttggttatgtgcctgaagtcatgtgatttttaatttctgaaagatttggattcttaccaagttttagttcttggacacataattataccgaaattagttggttgccctattgtcagtgatttgactctatctccaacaaaatgtaacaatgttgctgaacaaaatccagaaggtaaaaaatagtttttaagctctcaaattgtataattgaataaaattctttttttctcttgatttttagagaactagaccatttctacttaataaatgcctttttctcctttccatggcctttatagttaccagggttttccgcagaaacagaaccaataggagacctatggagttggctagctgatcatggtgcaactagaagtgaaatagactggcagtctactcaattcttacttaatctgtacaactggatgagttttgggtcaagcaaacagaagtctaccttgaatcataaaaacagtcatggaccctcaatcaaatcccagaatggggccagtttacaaacccagaacccctcaaatgaagggaaggccaggccccttgaggaaaaactcagctactctaccaaaaatttatactgttagtctttcttccacccctcccccaaagggaccaatggccttttaccagggtgactgtacttaggagaaagtacataatcagacttttgggaattagtggacacttgctctgaactgacactaattccaagaggcccaaaacataactgtggtccaccagtcaatgtaggggtttgtggaggtcaggtgatgaatagaatattagctcagatccatctcacagtgggtccctaaactctttctgtggttacttccccacttctggagtgcataatcggaataggcataatcagcaactggcagaatccccacattggttcaaatgataaaattgtttaaccctctgtttttaaggaagaataacatgaaaattcacatgatagtctgaaatagcttctaaattgctatactaacattctccatatataaattaagattcctaaaaatatatttcactaacctgccaactgatggcataattagaatctattctgttgtatcaggtcagagaaggttcttaagatgactttgtcttactccacagatgggcttttcaacctcggaagcatctgtgagaaacatctgggctttatctccttagcttagaaaaatgtgtgtatttctctaacctgaacttttattccctaaggaactttgaagtctttcctttctagcacgccttaagaaaaaaataatgaagtggaggtgtgtatataagaaatttcaacttaaatataaaactgaaggaagccatggtctgaagagacagttttgagaaagtagattgtaatttagacattcaaatagcctaagatggttatgatttgtctcttagaaatcaaaccaatttagaaggtttttaaaatgttcttatattcattgttcttacatttggcctgcaaatgtcaagttgattctgtttttcacattgagactcatggttctattgactataaaagtaagaggatttctcaaatgtataattttgtactctgtattgcacatctataatcctatcttttcactctgtcctgtcccttaaagagctgatatactttcttttactatatcttaaacagcaaaaaagattttccaaagttaatgctacctatgagaattttctgactttcaacaagaatttgattaaaaacattcttcattatttgcatgaagacttgaaatagattctggtcacacactataagcatcacacacactctcagataatatgataaaagaaaatgtgttggcccaaatatgttaccaccagcaaaatttgaaagggcagagtaactcaagtccctttcattttggcccagtgttcacattcactggagtatcttgcttgcttaaagtagatttgcctctacttttgattccttagagcagtctttctctacctttttctcattatggcaccctaaggaatctttttagacagttttttctctaatcactccttaccatgaaattttaatgccacagatattttgtatacctgtttatgtgccatatgtagacctgtactttatacataaagagatttttttcactccctccctgcaggaactaatttttgccccgttaggggttctatcacctccactgtgaatgtgtgccttaagagagcctgctggtatatggcttaagatgtaaagcaaacattttttggatctcttaggagatttatggaggtttcttaatttgttccttggcagaaacatacctgactttctggagtgaaagtcatctatctgatatcttcaactatctggaacttagctacaactcacagattaagaaaaaaagcaatcaaaatagatatctcaaagcaagcgcattgaagttaatctactttattcactgagcacccctcagatagacactttgagcctgttgattcttttcttaggcaaaactctattatcttggtagtttcttttcctggttggttgtgacttagagcacatcagaagccacaagtcacaaggcagtaaagtgcttaagctgccataggcaggcacaccaatgtcagtaaaaagtgacagctgacagtgaaggaagaaggaaaaactaagaagcataggagttattaaggctatttcgtgcaggagccagtaagcccaaacacctccacagtccttgaaaataacactcaccggattatagcacagcacaattttaatgacaaggactcttctggcagctctcagcagacattaagcacctactttataccatagactttgggtaaaataaggagcaatagcagctgtcctgttaggattttctctaaggcatgttttagagtttcatcgaaaatggttctattaagatgagagttgatccataaaggaattagcttcagttatctggaaattgacctgtgaaccagctcatcgatactcaatgatgatatatccaagaaatgtgtgtcttttgtaatatcttttaaggaaaattgcattttattgggttagatgacactgtcacatgtagttcatgtgataatttttgtcattttcttgttcctattacttttcttggaccacaaacttctcaattgccagtactctattttctctatcctacaaagctttcctggagaagaggaaagggctatgtctacccatgttctattaacctctgttagcataagaacatgctgccataccttttgttcaacaaccactggagtttgcctgagaagttctcccttcatctatatgtgcccctccagatttgcatgactttgactccaggttgttgaaagtcaatctctgtttttctttctcctttaaccctcatagtgctatgcacatgtgaacataatttgatgacaacgaattgtaatttaatatttgtagagtttgatgtacgtgtaagaaaaaaagagaaagcatccgtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccaagagtttaatgtgttttgttaatgaggaggggtagaaatttgcaatgggataaaatgcttgttaggtctaaaatggttccagaattaagttttaggactccgttgcacatatccaccagctctgcctttctagaacacttgtttaggttgtttttgacaatcttgctaaatatattagcactatacaagagaataccaggatttctgtaacttaaaaaggattttgcttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgcattcctaaaacgttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtggtattatattttcttaattttaagacaagtattgctttcaaattaacatttctgtaattttttgtcatctatggctaaggaaattaggaaaagttttagatgtttctttttagttttagaaagctatgatgagctcagtggcaatatatggatggcattaagaaaatgtcatatttgaggagtctgtgccttatacaggtcatgcttattgattcatttattcgtgtgagtagaccagtgatataaacagatgtttacactaatattttctctcacctaatcctttgtgattgcacagtattaagtaggggtaaagagtaattctgaatatatgaaataaagtacaatgagccagcctgcaagggatcagttggcaaagctaggcaactagttatgcctactcaatccaatggcagagcctacattgttagctctggaaagaatctttgagactacacagtttgatactcatttttcagatttggaagttcacattggtaagatttcagacagagggaaagaatggtagacccaaggacaattaatttttattccagaattcctttagtagatttttattaagcacctactatttcctagtgtcaaggatcaaggtggctgtcaacttctaggctagtatttatttgtaccacattgtaggtcatctacaggatactattcatctttaagaaactagtgtgacagtgtgtggccttagaagtagagcttaaggaaaaaaaaaaacttttttagtccaacttgatgtttgtctagtagtaccctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattgggaaagaattgcataattgtataaatgagctatcctaatttcaaattcatcctggaaaaaacttagttcatcttctgtctcctaaacttgctatgtcgtttcccacatgtcatatttgggtgactatagtcaaatccctgtgtatccaattcagaaacctaggaagtgctttagattcattcttctgggaagaaaaaaatggcagcaagacttttgtcagctgagatcatattgaatctgtaggtaaatttgagaagtcttgccatcttaacaatattctgatccatgtacatgggtatctttccttttaatcaagtttaaaactctttcaacaattttttgtagttttctgcatataaggcttgcatttgtttcattaaatttattcctaagtattttatcatttttattttattgtaaatattgttttttaattatattttgggattgtttattgctagtttatagatatacaattgactttttattgagaaataatttatatgccataaaattgtccttttaaggtatgtaattaagaggtttttagtatattcacaaggttgtacatccaacacctctagttaattccagaacattttcatcacaccaaaacaaaacccaatacttattagcagtaaatccccatcacccactccccagctccaggcaactactaatctactttctgtctttggcctattttggacatttcatgtaaacagaattatacaatacatagccttttgtgcctggcttcttttacctagcataatattttcagagttcattcatgtagcattagtcagttcgtccttttttgtggctaatattccattgtatgaatatgccacattttgtttacccagccatcaactgatggaacctgtattctgcgccaccccctccccccaacttttggctattctaaatgagactgctatgaatattcatgtccaggttttttcatggatatatcttttcgtacaactgatttttgtatattgatcttgtatcctacaaccttgctgaactcattctaatcatttttagtaaatttcttgtgctgccatccgccttaataaataaagtttcactgaaatccagccacacattaatttatatatggtctatggctgctttcctgctgcagtggtagtgctgagtggttgtttcagagacccatagcctgcaaaactgaaaatatttgcctttttttttttcttttcgagatgaagtctcactctgtcacccaggctggagtgcagcagggcaatcttggctcactgcaacctcagcctcctgggttcaagcaattctgcctcagcctcccgagtagctggcattacagttacctgccaacatgcctggctcatttttgtattttttagtagagacggggtttcaccatgttgaccaggttggtctcgaactcctgacctcaagtgattcacctgcctcggcctcccaaagtgctgagattacaggcatgagccactgcacccagcccctactctctgactctacggaaaacgtttgccaacccctgttctagaaagaagagcatcccaagcaattaaagactgattctcacctccagatagagctatgagcattgttttcaggcacgcacaggatgatttattcttatctctttcacctctggttctaggatgtcttatcttttcccaaactgaaacatctaccatttggtggatggattactcagccttgtaactcagtttaacgcttctatatgttcgcgtataattttgtctgcaaggcatctaaaaagtatgcctccttgtggaatgttcatcacctcttaactaacggtaatcagtcttttttctaagtaacaaaccaactgtatttcttaggaaaactatttggagcccatgctggaaagtagctctcctcagcctctgatctaactacattcaaactagatgtgaaaaatgtaggaattctactttcctattacctactgacatcctaacccaagtaaagccttctaatgccattcagatctcttcatcaggaattactgtaatgtcccctgtctcatccttcattgggaaagaattacataattgtattaatgagctatcctaatttcatattcatcctggaaaaaacttagtttatcttctctctcctaaacttgcctgcttcttttcccacgtgtcatatttggatgagagctaaaaacacagaaaaatataagaagttctaacttagactaagctaagtcagctgctatcaagtgagctttagactcattgcctttccatgtaaatcaaagttcaagtgaattgaccattggtgattgtcttttaaccaactaacaaattttttacttctcagttcaagtgacgggagaaacattttcaccagctttgcttgctttctttccttcccactgagacagttgccttaagaagggtgattattcttctgaaaacatttatgaatctgacaactattggtaattgaaaatatcataattggctggttgtggtggttcatgcctataatcccagcactttgggcggctgaggtgagcggattgcttgaccccaggagtttgaaaacagcctggacaacatggcaaaacccatctctacaaaaaaatacaaaaaattagccaggtgttgcatgatcctgtggtcccagctactctggaggctcatctgagcctggggaggttgaggctgcagtgagccttggtcacaccactgttctccagcctgggtgacagagtgagaccctgtctcaaaagcaagaaagaaaggaaggaagggaggggagaggagggtagggggagggaaaggaaggaagaaagaataataattacttgtaaacatcctaacttgactgtacaatgtattttctagtagaccaatgtttctaaacagatgaaccagctgtctggctgcccattgaaaagagatacatctctcttcctgggcattgacaaacagaaagaacaggtgaggggcatttaaagccaaatgaagcatcaacacatattaaagagccttaaagttacccctgcttagttatttacatgcatttcaatattctgtgaaaaaattcacttgaactttgatttacctggaaaggtaatgagtctaatgctcacttgatacagttgacttagcttagtctaagttagaacttcttatgtttttctgttgtttttagctctcaggtctggggaccagaattgtaaccattcaacaaaataaacagatttctaaatatgaagtttagcccatggattcatgaggaggagagattcttgaccaatctaagtcatgactaccataggattttctaacaccccttccccaaaattaagtttcaaaaaaatttttttctcatttcttgtggttgcacagcacaaaatgagtcagaggaaccaggaattttctttttccccactttagttgacctttgtgttgtgcatatgccattttgtactttgagtaacgttgtctccaaaggttctgctttggtttaatgccgaacattggccgtccttaaataagggccacagtccttgtgggtatctccttattggagaaattgcaggtaaactttgtaagcaaagaggatcttgccgattggtctcctttgtctacatgtgttgtttgcatctacctgggacttataattattgtttgcttttccttctctttggctgcttttggccaaacatgtttttatcatcctcatgaaagatttaagttccagagctagccttagatatttgtgtctcttccttttctttgggttagcaggcatctgccattaaatacatcgaattcattccatgttagtgggtcacttctgatgcctttggctgtctgaaggtttggtgaaaaacatattcaattattttacatattaaagaaactacactaatgtttaagggttcactgtgtctgtgtagaatttaacaaacttttttctttagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggtaggaggttggtgtttgatggataactctactgtataaagttaaatttgactggttttctatttctgaatcatggaagtgatgagaggaactaactgatttatctgaagtctggatatgtaataaagtcttcatgaactgcagttgaatgtggctgcattgttactaatgtacagaattttttccatattggcttaacaaaaccaaatagagcagggggaagaaatatttcactatttatttgggatggtagattatcctaagaaatcaatcttaagattttccttgacttaattaagctcaattaatgataattcctgggttgtcaatatttaaaaggtatttctttccccccatctcagcctgcaacttaacattgtacctttcaaaccaaaatgtcatttttttctacaaagtgctggagagggcatctctgccacacatggccccagccatctccaggacagcttcggaagcaaagaacagagttgggcaaagagcaggatgggtaaacattaaatgtttgcttcttccgagatggtcatcttagcatgttttcattgcttaacatttctagagctctggatgtacccatgtccaaatgtaagtgcaaacatcacaattgagtgtatcttatactttgctttcaattaactgacataaaaattagccatgtgtccatgtattgtactaaccaagagttaaacaagatacattgaactggaatttctatttaactactaaaggtcccttttaactaatctgtgacccatatttgaaagctttcttctaccagattttacttattgaaagcaatttatccctcctctcatctctttttaaccaaactatataaatagtacctgtttgagcttcttgttaggagtaaagaaatagtgcattagtgaacatagtgtcattattgactattaggacgtttgttagtttttgtttctctttttgggggaacatttgttattttaaataaaagaagaaactcatttagaaaagtctgcattaggtgaaaccccatctttactaaaaatacaaaaattagctgggcatggtggcgggcacctgtaatcccagctacttggaaggctgcatcaggagaattgcttgaacccaggagatggaggttgcagtgagccaagatcgcaccattgcactccagcctgggcgacaagagctacactctgtccctgggagggaaaaaagcccagaaaagtctgcgttagaatctcaggttcagatgctttttctcgttataaacaagactggctggagtctcaggggtcctcctgattcccccatgtgccttgtccattgtagtcctaattccctcccaaatattcagcaatttttatatatataggagcccagggctgaagtatttacaaaaaaagataacaagagcaaagctaggagaaaaagtacagccaaaagagctattttcagtttcagttctaggtcactgaatttcattcattttttagttgcccctccctacatagaggaatgagaggagcactttgacaatagattatttgcataatcatggctttgttagatctgaatattttcttgcaacatgggaatagggaactaaatgcttggtgaggctttcctgaaacaaaagacttagctataaacaggtagtgaggtagatcttgccgaatggccttgtttgtgaggtggttctttgctttgtctgaagttggtgggcagccatgaagaaacaggagggggtaaagtcagaggaatgtgaaattggaatcaacccttgtagcaagatgtctgaaacaagttatggccaaaagtaacctttccaactggtgtctctacaaatacccaaagaatgtgtagaactgcgaatgaggtctcctgaaaccataaacatagccaagtacccctcattgtatggagtttcactttccaatgtactttcacatcactttgatccctaaattatcctctaagtagagatagagcaaatattctcatcttctatttttctaagtgaggaaattggggcacagagtaggtgaagcagtttgtactaattctgcaatttgtgtagattttgtcaataaacagatttatttccagtgcttccaacttctagtctagtatgttttccactttttgcattgtttttgacacagtcaccggtatctctgagtggttatatcatgtgcccattgctctggaattaataacataagttggtggcttaagaaatacataggtactttaaaaagtgagtaatgcttcctaggaggaatactcttgaaggaatattcaccaacattgctttggatttaaaaacaaaaacaaaagttggacccaaaggatgtgaaacctgctgataatggatccacgcgtcataatatgtttaaagaggaaatactgatgataattaagttctattttgggaaaaaacaagaacacatatcttatagaatcgttaaaagtcagcatcaaagatatcgcagtgtggcagtattgcagacagaatcaccaatgcagtatttactaaaacttagaggaaaaaaacatgatctgagtctgaccaatgctaccaaaaatacttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaatttatatgccatggttgaaaagatgtatcaaactataaagcagcagcatcgaagatttaaaatttagaataaaaattgatcatgtggcatcccaagatataccccaggtataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaaccaaccattaattccagttgtactagataagagtcatcagctgtagaagtgacagtccagtctttctttgcatctctcatcgggcataaaagtaaaccctgttcataccccacatgaaactttcttataacccccttcttccttttttctcattcttctagatttctgctctctatccttaatagcacttatcttgcctctcccacccctttgtcttttgccccagagcatcattctgagtttggccacagctcgttacaggggtctgcctactctggcctggggaagaaatgggaaagaagtctgaggaccttatggccattgcagtcttttccttggcagtccgagggaagcgggaggtgatgcatgtttttacagcaagcatccttgtccctttacattctgtggagctcaggcctcatgcctggtccttgccagcatcatccatacatctctgcctccaaatcctgagatcattgagctgcattctcttgccacctcagcaccaagctcagagattccaaaatcatattgctagaaagaagttaagccagtttcatccctcagctctgcttaaatttgtttttaaaccaagccaaaaggagacatccatattattttctaaaagataaaatatcagaagctattctatgtgtgcctttcagctgatgtgtgaagtgtaaccataagaaatatctcttgccaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggtatgtggatcacctaccactgtttacacaaaactgtcatatcacctgaaaatgttttatttgataatagaatagtcaactaccagcattcctataaacaaatctgactgcatatttttacataatcagtgcccctagtctacttcactaaggctttaaaataggaagcattttgatgatgaatgacttaacctatggtcttctagagagcatttaggagcaccgcagatttgcacagatccacctgctgccaacctagttggacccaaagggatataccttggatcagagttgaaatcatacctgacttggggactttacaatttggcttttttgtggttagtagatgttgagtggcgtcttagtttctgtgctgttctagcctgaaagaacaggagaactaatgaaataaacagatttagcctctctaagaatgtcttctaccttctgtaatctgtcactcttcatttaggccttcaggagaaaccttcattcccaatttttttgctataaattgttcttaagtttgcatgacttgtctaaactttctgattggcaggagaatttgccaggtttagatgtttctcttctgtattcctatagcgccccctaccagtcaccacactggtttgtgaaaggctgtgagtttgttctttttattgtgagttcaaaggggtattattaacaactggtaaagtctgatgctgatgggtttttactttgaagtttcctaaattgaacatttttctgttgaagaccttcttttttgtgtggtcactggtgaactcatctgcttttcccacctaactgtaatgtccaaggcagaaaatgaattttacaaacatttgtcttcttgtatcttgcacatgataggtgcttacatatttaaatttgcttggagcttaagatattattagcaaagcagaaataattaattttataaaagaaatttctactataaatctgacactcaaaggatttttctaggtgggccaatgagtttacaatgtattcctttaaacaaatagtaggcaaaacacacaggaagtgaacaaaagcctaaaaatagtcatctacactgatgagactctaattttgcacaaatttcacgtgtcagccaatataaaattgggaccccacactctccagtctcaggtcacacagcagtgttgcagttggaagatataccacagagcccaccagtacagaatccctctatattagaaaccagggctgaaggatgagagaaatggggtaaggacaggaacgatcatttggagcctttttcctccacctcagcagaggcaaaagaattgacgaagcagccatcaaaccatgaagtcacctcaccacgcctttttttcagtcttctgacaattttccaaaacagagggcatgaggcctaaaggtaagcctactttacagatgtggaccagaagtgaataatacagttaataggaacctgctgacccataaaaccaagagactgtgaaccaaaaggtgtcatgctaatctcatttctcaccaaagtggctggttcaccttcaagtaggaaaatgttctgatatctgagaaggtcccctacgtaaaacactgtgagcttcctagctggctgaactgccccccagacacagtagtcttaacacatttggagagaaatacaaaggcaaaactcctaggccgaggccagctatactccggctacaccaccctccctgccatcagtggtctgccaaggaaatgagtagtggtacagagaatgtgcagcatgatcaacatccagcattctgtctcaagtgcttatggagttaactgggaggtgcccaggtcaatatagaggaagtcaaggagaatctacatagccatattatttttgagcagttagaagtccccgataaaattgcctgagtgagccagaaaaaaaaatctgttcataaacaaaaaagattttatatcagaaatagaaaaaggaatgtaacttgtaaaatataaatggagtagatatctagagttactcttccagaagacaggagaaaattttatactgaagctgctttatactgtcaaggaatttgataagacatggacttaatgaaataagaagacaatagaataataaaatgaaaagacagctgacagctaaggagaggaagagaaataatgatgttatagaatgtaaatgaatttataactgcagaatgcaaattagacactgaacataattggagcagacacaaaaaacttcagaaaaatccacaaaagatgagagaaagaatagatgactaaaaacacactttctcatctgaaaaatataatgcccattttattgcagggtggtgaagactgactggaataattcacataacagatgtttcctagtatttgcttctcaagtgcttgataaactttagaaatggtaagatgatagagataatgactcagaaggcagataatggggatccaatattgatattgttggtgtggcacaggaaaacatcagaaaaaaatgaaataggattagagtaggtaactacaggaggaagtttttttcatgaactgaagaaagctagtatactactttttaggaaaggacataatagtggcaaacaccaaaacttagccctgagaattaatgaattattgaacttcagctcagggagtgccacaagcatcctggtgaagaaaaacaagctactctgaaggaacttcacttcgccaggagcagtggcagagtctgtgggccaagaggaaggggatggcctgggagagtcggtcctcagttgttttaatgtaaccgactgctcttatagatggctggattttttttacctttgaggagagggagaagaggtaaatgtttagggctttcttggctaaccgagatcacgcaagtattctgtgcatcagaagttggcattggtaatttgaatatctctatactgagtgtccagttatcaagcatagcagccagtgtatcaagccagatttcccagagagtaatagttaaagtctataaaatagagcaatgacctctgaggtctaagcgttttgacagacttcttttatacagatactctgcacagaaaatatatttatggtactagaaaacaaaacaaataagatggctattataaattttcccacaagttcccataccaggcaggagaatgagactgccattttttttttttttttgagacagagtcttgctctgtcgcccaggctggagtgcagtggcaccatcccagctcactgcaacctccacctcctgggttcaagtgattctcatgcctcagcttcccaagtagctgggattactggcatgcgccaccacacccagctcattttggtattttttatagagacagaatttcaccatgttggccaggctggtcttgaactcttggcctcgagtgatctgcctgcctcggctttccaaagtgctgggattataggcataagccaccacacctggcctgtaaatcccatctgtctgtaattttcaaagtttctttatatcaactgtatacccatatttgcttataataaacagcctctaattagagaagagattacaatgtcatggctatgcacaagagttctgttgttaggacataataggaaaagctcatctcaaaggaactaaaacttacagactaaaaaaagaaaaacagaattttggcaaatgaaatatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagattaggtatttctcctaatgctatccctcccctagttccccaccccctgacaagccccagtgtgtgatgttcccctccctgtgtccatatgttctcattgttcaactcctacttatgagtgagaacatgcggtgtttggttttctgttcctgtgttagtttgctgagaatgatggtttccagcttcatccatgtccctgcaaaggatgtgaactcatccttttttatggctgcatagtattccatggtgtatgtgtgccacattttctttatccagtctgtcattgatgggcatttgagttggttccaatcctttgctattgtgaacagcactgcagtaaacatacttgtgcatgtgtctttatagtagaatgatttatatcctttgggtacatacccagtaatgggattgctgagtcaaatggtatttctggttctagatccttgaggaattgccacactgtcttccacaatggttgaactaagttacactcccaccagtagtgtaaaaagcattcctatttctccacatcctctccagcatctattgtttcctgacgttttaatgattgccattccaactggcgtgagatggtatctcattgtgattttgatttgtatttctctgatgaccagtgatgatgagctttttttcatgtttgttgactgcataaatgtcttcttttgagaagtgtctcttcatatccaggagcaaaaaaattatattcccagccaagctgcctttgtttggaaacgtaaaaaaactcataaatatagaagaataccagaaaattttacataaatagttatgagatgaaacataataatgagctctcaaggtaaatagttaatccttagtatattaaaaaaaaaaaacagaatggacgaatggggtaattttgccaatgcaggaatgattcaatattaaataatctgttactatgacaggtcacttattcagaatgtttgcgaatctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatataggaactgttaagatccatcacaacacatgttttactggttggactgccatggaatcccagtgacccacgattagggtccacttcccctagtttctgttgtgctgttgggccacttttatgaacaactgttggtgacatcagagaattttgcccatctcagaattgtcacactgtgacaaatcccatggggtagcattttctaaacggataattaatttaaaattttttattttggttatttacatttttatcatttaatgtgtgaacacatacccaatgctctctttgcctggaagattggtaaaagtacaaaatctcaagccttccccgaggcctactgaatcctaacctgcattctgacaagatcctcggatgattttatattcacattaaagtttgagaagcaccgttaagatcactccagtttcaaaactccagataataattcatcttcctgtataattctttatcaccataagagcttaagggagaaaaacccatgtgctcttttcaatagttactgcaaaagcatttgatagaattctagactcattcctgtgtttttaaatgattgcattgaagtttaaggtttttttttgagggcaattggcatctttataataataaactttacagttcaggcattaatctttttccatttattaatctgttccaaactgtaccattataattttattcctttatatttaagtttactcatgtatatttttctgctattgtgaataacatctttattctattgtgttgtttattcttgacatgtagaaaacttatcaattttatattcattttataactagtcaccaggatgaactcttagttctaataaatttttagttgatcctcttgagtcataactaccattgacacttctgatttttttttaaatctttaattttgtcaaggaatagattcacatagccttaataatatagtaagctttaaggacttaaaaattatttgggcttgcctctgcttctggggaaatggaatgcatgttcttttccctattcttccgtaaatacaactaaaagcctccaatattatatataaacaaacataacactcttaaaagtgaagagaaaaaagtcagactaagtagtgaaccttgggacccaaggaatgacatagtggtgagttctttgagttttctttttgtttatatttttctgacctggagctggagaggctggccacccagaaatgccaatgggtacaggctctgatatggtttggctctgtgtccccacccgaatctcatcttgaattgaacttccataattcttgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatcaagagaggtccagtaggtagctggaccccctcccagcaataatgaggaggccttccccaccttagtagtaaggttccttgggtcccaagattcactagcctcctttttttctcttcacctttaagagagttatgtttgtttatatagacagaaaccaaatggagaacctagccttctcctcccacctcctagtaatgaggcagtgcccccactttttccttgccaaaacaatgtcaggaaaagccacctaaaacagtaggattaaataagatccaggaccccaaactaccgacattacctaaggttcaatcacttgactgtttggatattgcaatcacaacaatcacttatgtcaagaaccaagaaaatcacaacttaagtttaaaataacaattcctaggtgcccacacagaaatgacggatgttagaattatctgacaaggatttttaaagcagctatcataaaaatgttaaaataagcaattagcaattactaacatttgaagcaaaagaaagaacatctcaggaaaaaaactaaagcctcagcaaagaattaaaaggtttataaaccacacagtaacttttagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttgacatttgtgtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggagacagttctaatgacagaggatttttcataacctaaggaggccagaaggaagtacaacatttttcgggggaatcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgttgtggctctgaatgaagcctgcttcattctctgtggtttctctcaagggatggcgttcagtgtctgtggcttttccaggcacgtggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggcttacagcttgcaccctctgaagcagcagccttagctgtacctgagccccttttagccatggttagatctggagcggctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccatcatgtccagttcacatctttatataagtttgtatttgtatttgtgtgtacaatgatggggtatgtgtgtttacacatgtgcgtatttcagaagatacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaacgtgcaggtttgttacatatgtatacatgtgccatgttggtttgctgcgcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaaaattagaaatactaggtgaaaggctaaataattttaaatttgatactgctaaattccctccccaaaactatacccttttgtagtttcctcgagctcacacttcaccatctatgctttctttgtccaccgattgacatatggataaggcaagaattttcccaaaattactctgactacctcaagcttaaagccataaaaaaaagttttgacattttttatggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttagtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggagcaagtgcccagttcgtcattttgattccatcctgactaaattgttttgactcattacaaaaatattatttttttgaaataacaaaatttcatttaccctttttaaaaagaatgaggtaaatatatacagacatgaaaagaagtttataaaaaaatttgattttttatatttgccctttttaacaaggaacttttacttcctaatttgaaaaacggtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgttgatgaagcgttgtttaactttatgtggggatatatgaaatgatggtcagttgcagcaccagtgttttcagggatccaagggattcagggccacaagttggtagagcatcctcctttccagtcggggccacagtgggccacgtgttgtggtaaagatacttaatattaggcattattttcaagcattttttgttgttatcaaataccactagcacctagttaatactgtttatgggttttggagaaattccattttattactcctttttgccacccagggccttggtaaagttaagctttccagcaggaactgtgcttctccatgtaatttatcacccttactctgctgtcctaagcttagaactagtctcagctgtgagctgatgtgctctgctgtgtttaactggctacccccagagagggtgtccagatgagatctgaagggagggtgcctgacagtgccccagctccatgcggcctgagatgtgctctgctcttgcacttcctagataaattgggaaacttgctggtaaataattctataacccactcttttccttaggctttttggaaaggatataaacaacggaaggagtatatgcacaggcggcaaacgttcattgataatactgattctattgtgaaggtaaataccctttcctaccataccaagtgcttggcttaaacgtttcccctcatttcatgtttaatctgaaagacagctatagaaagggagggtacatgtgagccttgaagtcagaaggcagtactggatttgaatcccagctctgctgctcatttacctaatcatttttcaagcaggttggttaaaccgctataaaacctcaagtcctttatgagtggttatgagaatcacaagtgaaagtgttctataaccaataaatgttctttgtctagaaagttcaagttgattatttagactttaggtagaacccagctttttttcatgtttctctttccacatttgcttaagcatatttagaatgctcagacataacagaacaaaaccaatgataagaggaagtagagctaatttagggcctatatttgggagctgaattagtcgaacccaggtgaatagctctgggtgagaaagaaagggtactgtgatgtccactctcatggatctgaaagccagaggactggacaaaaatcaacttggaaatctacaacttggagatctacaagtctccagcttggaaatccagatgagagtggaagcaatggaactggaaagtagaatcagattagtttaaagatctttcaggccaggcttagtggctcaaacctgtaatctcagcactttgggaggccaaggtgggaggatagcttgagcccaggagttcaagaccagcctgggtaacatagggggacctcatttgtattttaaaaaataataataaataaaaacaaatttaaaaaacgttttaaactgtgaagacagagaataatgtgacccagatccattgtgcagtagctccttgatgaaatagcatcctatggaacatatgcctattctgtcaaaaaccattggtagcaattggtccctcatgagacctcttcgatgttttcctgtaaaaacttaaaggatattggatgcatttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaatttagagtaacatgtaaagcgttttgaaccccttaagaaacctcagtgaaagatgaagagtaggctttagagattgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaatgaatgctttattgaaagttagcattgaatgatttttattgaatggtgaacatgaacacttaagaaataatggatcttagaacttcatatgataatatttggaggcttactgttttcattcagaaatcatgttgagagttagacttcaccagtcaggactcgatagaaaatgggtgaggggaaaactgtgggctagtaacaccaaagagaagactctagagaaatattttacagcattgcatatgtagttttttcaactgttaactgcttactttaaatagaagcccctgggagggatttcttcctgaatctttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttcttaaatgttctaaattcaaaaataatggagtaggtgggactctgggagatcaagacttgtcttaatcttttgcagaataatgaaattgtgaaaatacagtcactgttgagagcgaacaaagctagagatgactacaaaacattgggtaagtgagagctttctgaaacaaagcaaggattttttataaaccaggcaaggacatattggtccatattggtcacttcagaggctgctctaagaacagaggatacccattgtttccagtagattttgatcatctcaggccccaggttctaaaccagtacacagaggaacacatggtgaaaggaaatgggccttcctattaaatggaagggatcagccacatggtataatttcttcttcaaagagagtggagttggcataaatgctgatttttttttttcaatctaagcgagagtcaaaaatctaatgcaaaagagttagccagaaaataaccttatatttaaattgtttaatttgttagacatagtctcatctcccaaaaatgacaactgcaaatatcttcctacaatttcattttgaacttttcacagaataatttttaatttttgtttgtttttgttttgagacagagtctcacactgtcgcccaggctggaatgcagtggcgcaatcttggctcactgcaacctccacctccccagttcaagcaattctcctgcctcagccttccgagtagctggggttacaggcaccagccaccacacccagctaatattttgtattttcagtacagccggggtttcaccatgtgtgccaggctggtcttgaacccctgacctcatgattcacctgccttggcctcccaaagtgctgggattacagattaaattttttaataaaaatttgtagaaagtttgaaaatagcaaaataaaattcacccaaaaataacaatcacattttgtgctatctccttacagtcccaactttgcctatgtttgttattttggttttttacagatcataagttgattctttatatactaaatttttaacattctaattatcacgggaacatgcacagtcaaggagagcttgatgataaatttactagtacttacagtgcctagtaagtttagccagcaccttttattgtctaaagtttgtctgaattaagggatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggggttttttgttggttttttttgtttgttttttgttttttgttttttttttttcttgagacagagtctcgctctttcgcccaggcaggactgcagtggcgctatctcctgcctcagccttccaagtagctgggactacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgtttttggtttttttttaaagaaggctaaagaggatttttttttctgagccctaacactaaaatatgtttgctgttgcttttatatatgaaagatgacttcaaaataaattttccaaatgaacacaggctagttttcattttattcaaggtaaagtgtttttttttaagcagttatagtgatgttttttgtttgtttacttttttattacaaagacaaattccaattttaaaatctaggcaactttatattggggcataaaaggtaaatagagaaaccatctcggtgagtgagttagatctaagcttctctgggcttcagcaaattgggtgcttttatggtaaccaaaacataaattttcatttctttcttagttcagcatctttagaaaactaaggctttgggattttctaatttaaaaaaaaataacttttctaagtttgttatcatctgttctcacccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatggcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctggccacagtgggagggctcatgttcccctaacttggctgcatggatgagcggtggtgcattgctaaggccttccctgaagtggtcatgtcagtggcagcatctttgctggaaatagaaggaaaataaattgatgtgcttcagtggtcaggaaataaagggtcccatgatccaaggaaaattctccaataaaggccatttatgcagttgtttgtggtttatgcagttgttttggtgttagttttcttactcctttagtgtcaaaacaccacagaactaaggtggaagtaaaaggaagactgtcaagggcctaggtgtaaaggagggcaactaatgagatggccatggctggactagctcttccaagtcatctttctattactgggtctaatcattcgtcctcaatggaccagacaatttattcttacagtttacccagatctgatctccctaagcatgttaaaaatatttttccaagagtcagagtgccaggaaattaaagcctaaagttccaggtactaaggggaaaacccttttagaatttatgtgagaatgtccctctcaataacaggggctgacccctagattctgagcaccctcccttggccggtgctcaaaggacaagggccaagtttcaatttctaaaatctttttatttcagctaagtagaacattcgttttacttatcattctgttggttcctgtttggcttttacagtcctcccttcctggcccttttctaattcagctttcacctacttccggctccttcccaaagatcctttgggctgggagaaaccactttctgcttcctgcagcaagaatgtaagtcacttatctagctcaagcacaaggtctcagggtcgaggtaacttatgttaactttctttcccaggttcctgaggaatgaggcacagataggactatcttcttagcgcatgagtccagggaacagtgtgagagagagctgataaaagggataaaaggggagttgataactagaaaagagtggggccagatatctgttttgtgcgtttatttattgatcagtttccttgtccagattttaaattgtgtgggggtgggtagaatgattctcaccctagaccaagtactttcattggtatatttttctagtaattatttaagaccttgtttctttcctgttgataatcattccaagctttcctaattaaagtatacctgttcctgtcactgcagttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggtcagtggggtttttgggactgtcagctcccagaagagggaagacgcctacatacagtcaagagtcacttaatgacagggatacattctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttataggacttatgtcttatatgaggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatataccttcagaataagactagggcctttatatgaatacaaaagagatatttaaagagtaattaataataaaagcacacattttattgagaaaatgtatatgcctgatgacactggaagacatgatacagttaccagaggtgtagacctcttcacagaacagctacagattatgagggcttcagtggcaaatgaggcaggaactcattttccaaaatggagaacaactatttgtaaagttcaacattagccaagtgtagtctccacccaatttacatagcagttgcaattctagaaaatcctagcttttgtgtggggaaaatgtattatgcatctacataaaacaattagattctaggctcagataattacaaacagaatcttgacccacgtaaatgaccagtaagacattcaaaagttctgtcatgcaaggtgagggcaattatttacacaagaccatcccacaaattgccagatcacagagcacctctcatccccaatccctgctcactagaaaccaagagtgcccttcaattgttaagatattaaaaaacacccctacgtatttccaaaatgtgactccctacaaagacacactgcccccgttatgcccccattgataacttctaaataaattacggtgtggtttcacatctgtgtgaaacctgccaacatcagggctcaaaaaaaaaaaagtataaaaagtgtcatttttacccaagaacagatgcctaagaccactctccctgtccctgttcccttcctatgtgccacatcagttttcagaaaactgataggtcaaagagggaaactgatcttctggaagctctgagaaggctacagtggctcatagagcgccagcggccagcaaccaagcgaacgttctggacaacggggagatgagcagccacaggaggctgccagttacatgggcatgtgaatgccccaggctggtcctccagacctcataaagacaccagggcaattgtggaggagaaaataagaaaaacagcattttataaacagaaataatcatctcttctaaatattcaggaataaaactacagtttaaatgttctacatttaactctacttttattattttatccagaaaaacaacagtactttttaaaaaacaatgttatttgtattgtttgacatccatgagaacttttaaagtgtaatatattccagaaggattttcagagaatgctttttatagccttaaactgctgtttcacgctatccccataaaatcataaacaggaaatgtcttgccttttaaaataaaggcttagttgcaaatcagtacatagtttaaataatatgtatcttttggaaacacaatcatggcaagttatcagatttttatgaatgcttgaggttttgtgggggttttttaaagccacttatcactaatagataacattgtgaagtttttcaacatatttgcaaacaccagatatgtatccagcattttttagcggttaaattaatgattattaaatatgtagctgttagccttgtcattgacagaatattagtagtgatacaagaacagagcaattgaagctttatttatagtagtgaaaaagtgggaaacgacctgaagcccaaagcaatatgcagagggcgatagaattagtttaatatggatgttgtatagccactaaaaatgatggtttttagactattttaaagcaggaggaaaggtttgcgatatagtagaggagaaaatagtgcctaaggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggcaaaaagaatggtttggagaaagaagacagagcaactgaaataagaggtttcctggaggcacaggagccaaaaaataaaaaataaaaaagtataggtcagcctagctggaaggaaagcctaaattaagagactgaagctaatctaaaactagtgctaaaattcccattcatgagtatgatgtatcatctaggagcccagatttgcaggccagtactacctgaaactcaggactgagatttttaactattaatacttaattatactacttcactgcttatattaacatgtggccttgagcatgtttcttaacctctctctgagtgtgttttcttccctggaaaatgttctaggtgatttacatatatttttaatcttcacagcaactcagtaaaattgctgttattacactcactctacagatgaggaaactgaagcttaggttaacctgtgtaggtttaccaagctaattatactctgcagatacccatatcttttatgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaagtgagttttgatgaataaaaagtatctgcccctgtttgttatccttgtctgggttggctcttgtgtccatcttcaagcttcccaaagcaaacctccattcacacaagcacattctggagcaagtcagaacctcacagggagaaggaagaggggctatccccattgctgtgccgggctctgtccttggagctccagcagacaggtgctgttccatcagcacagccaccggcccgtcctctctcttcccctttctgggttcagcattgcctccgttgcttccctccctccattcctctcattatcctgccttcaccaactctctctgtttctaatgcagaggaatttagatctgccccagatcttgctcaccacccctaccctctcatctgtatatggcaaaaaccattaaccagaagatgaagtctgcaacaaaacaaaaagcccccagtttctagagtgacctccactgaaaacacttgggagggaaaaggggggaattataggtaacaagactttcctgtcgtatatttaaaatcaaggtgatagatttattctgtgtatttgagggagttgaacgatttacatacatgtcgccagctatctgaagaggaaaaatgtggattaactggcactgtaagccacatttattctagtgatgtcttaggacttcttatagataaggattatcagacagccgcctgcctagattcccccttgacctctatctggtggtaactgcacttcctttctttgtactgaagacattttatatattggtaaaacaagggggaaatgttgcttttttaaaaatgttatcggaatgtaaatcaactcccctccctccttctctataaaagcaattggggtgacagaagtaagtgggtaagtcaaggctgcctctctctgaattgagaatgagaaagaataaaatcatggacctggaaggcaacagatgtagccacatggaactgtcttactccagagcttcctagagctctggaccccagctgctcaatgggctgaccccagctatgggagaatggggtgccaggaagtaaacagatttagagcttgccatttaggcaagacctgacggtggttctcatccccaggggcaactggaaatgggggcgggcccatgtccgcttgtgaaaatgactaggggcccctgctgatagccggtggtgggaaggggccagggtgatagacgctggtagtgcatgcagagcaaaacactgttgtccacactgcccatagtgcccctctaaggacactgggccagcattcctgatgtgcaaatagagtcctcacgtggaggtccagctaagagctcagtcaaaaatctgaaaaaagttttaggaaaagcaactttcttgccacttactctgggacagtgaactaatgttaagtggcaggggaggtgttctagaacagcgactttcaaatatgaaagtcgcatgccattagggtcatgaaatcaatttagtgtgtcacaatgagcaacctttaaaagtggaatagaataaaagcaaatagaaaatatcagcatgtaccattagtgagagagagggtgtatgtgtgttcactaataaaagatggaaaatgtatttcttactgcgggtcccagacttctgagttgccagtaccacaggcatgagccaccacacctggcttatttttaaaatttgtttgtagagatggggtcttgctctgttgcccaggttgatctcaaactcctggcctcaagccatcctcccatgttggcctcccaaagtgctgagatcacaggcatgagccaccacacttggcccgcttccaacttttcttccgaagtttcctggcttctcttaaggcctcatagaattgaagaaagttagggccttgctttggattaggcttaggcttaaaggaatattgtgctggtttaatcttctatccattccactcaaactttctccatatcagcaataaggccattttgtctttttaatcattcatgtgttcactgaagtagcatttttaatttctctcaagaaatttttctttgcattcatgacttggctgtttggtgcaagaggcctagcattacgcctgtcctagcttttgatatgccttcttcactaagcttaataatttctagcttttgatttaaagtgaaagatgtgtaactttcacttgaatactttgaggctatcatatggttattaattaacctaatttcaatatcattgtgtctcaggaaatagggggcccaagaagagaagagaaaaagggaagttggtgaagcagtcagaacagacacatttattggttaagttctatgggcgtggtttgtggcaccccaaaacaattacaatagtaacatcgaagatcactgataggctgggcacggtggcttacgcctgtaatcccagcactttggaaggccaaagcgggtggatcaagagggcaggagatcgagaccagcctggccaacatggtgaaaccccgtctctactaaaaatacaaaaattagccaggtgtggaggcgcgtgcctgtagttccagctactcaggaggctgaggcagtggaatcgcttgaacctggcaggcagaggttgcagtgtgctgaggttgcaccactgcactccagcctgggtgacaaagcgagactccatttcaaaaaaaaaaaaagatcactgataacagcgccccgtaatagatagtataataatgaaaaagttctacatattgcaagaattatcaaaatgtgacacagagacacaaagtaagcacatgctattggaaaaaaatggtgacaataggcatgttcaatgtaggattgcacaaaccttcaatttgcaaagaaaaaaaatgcggtatctgtgaagcacagtaaagcaatgcacaatacaatgaggtatgcctgtatttccaattacgtgtgtttcaatcctatatgtgaagggaggagataaagagtatgagaattaaaaaagcagtaatctcatcaaattttttacaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacaggtgagaacaatttatcgttcactctgagtttgggagtaatactatgttacatgtttgtggcttacagggagtattttgtcatgcttcagctataatagcatacatgttttgagcatctactaagtaccaagtgctgttgttggtgctttacatacattatctcatttaattcttaccataaccctgggagccgtgagagaatgagtactgttgttattcctgcattacagatgagaaaactgagacacagccagtaaatgataaagcaggggttttgaaacgcaggcagtttgacttcagagaccatgctctttacagtattatactacggttaccttcagaaacaatataaatctgataataacaaaacaaaaacaggtgctgtcatccatgaaaaaattaaaataactgtatgtgaaaaacagatatttaccagaaccagtctccccttctatgggggaagagccagagggtttgggatttcaaaataatatttcttttttcttgtattattttcatggcattactatgatctaaatgaatagtaattttccattgcttcctgagtgttggtgagaactgataagtttgactggttatggttggactttgatggatcacttattgttttgtttgaccattgattcagcccgtcagccctactagcacatacagctagtcacagaggaaactgcatgatagcaatagaaattaacaagcatcctcttcagcaggaaaagtttccccaaagaggtggatccatagttctcccttgtaagagtcagatgtctctcagagtggggccactgctgggattccttcaaagcctggagatgcttagatctttgtttgaggatgtcactggcagtagatgtatagagagcacattacacaaaccataaataagaggcgtggctaacctcatggagaaacacgatgttaattttggtaggtttgaaaattctctacttggaataagagattggagaacatcttcaaacatacgaacatcttcacacaagtggccaccacatggcggcacagaaggaaaaggttaacagtacttagaattgtctgtggaacccactgtttcacgccagcaaacctagaaagaaagggggctcactttaaacaggaaaggactttggtctgcctaatttagtagtcaaccaccagtttgaaatttaatcttaggcacttatcattttttacacccatgaaatttcaagcatattgaagattctttagaatttagttttctcaatttgacagaatttgtcataagttaaaatctagtcattgtttattatataggtggaggcacatttatgggaagaagaaaaagtgcaggagcatgtttagaataattccaccaaacttgatccgcaaacaatccaaaatgtacaaccaaagggtgcaaccattcagttgtatcaagtgaactctctcttgaaatcatatatttttcttctccttctcttcttttgaggcgttagcccaatatcactaaagaaattatagaaaagcaaatggcctggattccttcgacccgttggttacactttagcaagacttctttttttgtagagacaagatgtcactctcccacccaggcaggagtgcagtggcgcaaccacagctcactgcagccttcatctcctgggctcaagcaatcctcccaccttggcctcctgagtagctgggactacagacacctgccacaatgcctggctaattttttcatggtttttgtagagacagggtttttccatgttgcccaggctgatctcaaacacctgagctcaagtgatccacccatctcagcctcctcctaaagcactaggattgcaggcatgagacaccacacctgacctagcaaaaattcttaaccaaagccgcagtcagctagtataggtttttggggggtttgtctcttcagtatgaacctaaatttaaaatttttaggtaaccttaggaggaatggtgagtaggcatctttctttagttatagagtaagtttcctttctcctaattcctatatacttcacattgaaaaacagtcactacagagctatcaagaaaaagtactgagctgcttatttataaaatttcaaccaatcattatgaacttaaaagtaaacctaagtgataaagtaaaccagaatttaaggcttcttaaaagctgcccaaactgcttgagtatattagatgaataccagttttcaagtatggaaaaattttcttctcttgtcagaaagaagatgaagattaggagtattaaatttctctttgtacatacttcctctataacctgaacattattgttctctttgaacttctacctggtaggtgtagctgctggagaaaagccacatcaccatgaaggctggttctgtatccaatgggtccatcctcatcagagcccacagggttccacgtccattttaagttctttgttgttttttgctcatggtcttctggcacttcccttatcaactgtcctgaccttcacccctctcttcagcctccctacctcactcccccttctcactctgtgtagaacattgtggccattttgctgtttccacattgtaaatgtattcttttctttttctttccagtctgacaagatagtatgcatttctactcatctatcaatccttctaggccagtctatgtagccgggcccttagtccactttcttttttttttttttgatacagagtctgtgttgtctaggctggaatacagtggtatgatcacagctcacggcagccttgaaatactgggctcaagtgatcctcccaacctcagcctcttgagtagcagggactgcatgcgcacaccaccacacccggctaatttatttttacttttttctagagacagggtctgtccatgttgcccaggcttgtctcgaactcctgggctcaagctatccttctgcctctgtctcccaaagcgctggaattataagtgtgagccaccatgcccaagctttgccagtgtctttggacaccagattctactggctacccgccctgttttctgcgtctctacaataaatattaatatgtggttcaaaaaggtcaacagtgaaaagtagatataatatgttaagtgtatcatatagtgtgtatcatttaaatcctatcataattttctactatagcttcctatagtatgatatgaataatattaagtaattaatatttgatattaatattttaaaatattaatatatgataggaagctaaagtagaaagttatataatatcagtctataggaaactgtagtagaaagttacactatatactaatagcatagagatgagtacctggcatataaaaattattttatatactcatctatatgcttttagtgacattaagtcattgaagagcagggaatcagatactgctttgtgctttaataatatattaacttattgttttgtgggatttttttgttttctttttccttctttccttctagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaagtatgtatacaaatatgtatgtaaaaataccagtgaatcaatccttttgttagtggtggctgtctttgatttactaaaattatttttaaattcttataagttattcccacatattaaaatatatcaagtttcttgagaatacttctatattattagagctatattcaagtaccattttctcccaccagtgatactttctctagtgttaaattaacttttgattttgtatgcctgtaacaactgaaaatcaatagcatattgaaagtcagtgaaaacatttaacttaattaaaattctgagtagtaaagccattaacaggtgggaatgcagagtgcaatctctgcctaaatagtcttcccttctttctagaacttaaactacttttgctaatttattttctgactcagttaatgtaaaaattgtataggtagctataatgagtgggctgagaaacaagcatgagaaatgtccttagctcaggtggcctccctaacttgtggaaaccttaagttataccagttcctattggttttgggagcacgggagccaggcacctctgccctccaggtgtctgtaagcccacgagacatgtgattcgtgagaaataggaatgctatgcagtggaatgtggtaagtactaaatgaaggacgcgtctaaatgaaggacatgtacaatgtatcaggttagaggacaggaggaaagattccaactaggttgactagtaaagattttatagaagaggaggtgcttgacctaaaaccttgaggaacagctacaatttttataagaagagatagaagagggaaataaggcacaatggtggtggaaacagcatgggcataggtcccaggaggaaagtagattagtctagccagaaagtgacttaattactaactaccaggagatgaatcctgaatgatagggtagggccaggtagtgggagactctgagtaaaggcccagctgttaaggctctatttgctttttggggatctgtgaaatcttttttcttcttcttcctaggccggagtgcaatggcatgatctcagctcactgaaacctctgcctcctgagttcaagcaattcttctgcctcagcctcctgagtagctgggactacaggtacccgccaccacgcctggctaatttttgtatttttagtagagaagaggtttcaccatgttggccaggctggtctcgaactcctgacttcagggggataggtcccagagagatggcgggtgaagctgtgcatgcacgtgaggtctgaggggagaacatgggttttggttgggctctggtagaccagttattcttttgtttgggcattgattcaccctcattcgccttacaagcacctacaattagtcaaaaaataaacaaaaaggccgggcacggtggctcacgcctgtagtcccagcactttgggaggccaagacaggcggatcacgaggtcaggagatcaagacatactggctaacatggtgaaaccccatttctactaaaaatacaaaaacaaaattagccagacatggtggcgggcgcctgtagtcccagctactcaggaggctgagacgggagaatggtgtgaacccaggaggcagagcttgcagtgagctgagatcgcgccactgcactccagcctgggcgacagagccagactccgtctcaaaaaataaaataaacaaaactagcatttaaaggtgggaagaggagcacagcaaagaaaataaaaaggaatgactgggtaagataagaaccaggcattgtcaagctctaaaggggaaggatgtggaagagggagagaaagtggtcaaaagagaaaggggaggaagagaggagagaggccctaagaatcagcaaccataaatcaagaaaagctctctcagccatctgacgtggctagaagctgtattgcagctttgagtgggatttgaaaaagtgaaaacagttcattcaatcaagaaagttgtttttgaaatttgataactacaggggcatggtacttgtaccgtgtcacccagtattgctagtcctggtccattttcagctcatacctgccttctagattgaaattgaggctgtgactttattttcagatcctcaaattgctcatctaagaaacatacacgttataaactgggaacagtggctcacgcctgtaatcccagcactttgggaggccaaggcgggtagatcatttgaggtcagaagttgggaccagcctggccaacatggtgaaactctatctctctgaaaatacaaaaattagctgggcatggtggcatgtgcctgtaatccgagctactcaggaggctgagataggagaatcgcttgaaccctggaggaggaggttgcagtgagccaagatggcgctactactctccaacctgggcagtagagtgagactctgtctcaaaaagaaaaaaagaaatatacaccttataaatgattgcttgtttttaaagcacaccaacttagattttcatagagaaaagtataattccatgaagtccttgccttccagagggagaatacattgtttaaaactgtatccaggcccagaaccatggctcaggactgtatttccagcactttgggaggccaaggcaggtggatcacctgagatcaggagttcgagaccagcctggccaacatggtgaaaccccgtctctactaaaaatacaaaaagtagccccgggcatgtggtggtgcacacctgtagtcccagctactcaggaagctgaggcaggagaatcgcttgaacctgggaggtggaggttgcagtgaaccaagatcacaccactgcactccagcctgggtgacagagcaagactgtctcggggaaaaaaaaaaaaaaaaaaaatctgtatccatggaagcaaaccattttgttttgtcttgggcttttttagatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccaggtaatagaatcaggaaggtgttggtcttctgttatgttttatgatatttttacatgtgtatttattgatactcttaaactttgttaggcgaactgtacaaagtcagttatcaatccaaaatgttacctccctttaacatatccatgcaaattacatcttgatactaaatggtattttcacatttcagagccaggtgatccccaatgccacaacttccataattctctcccttgtttattttctttgtgtatttctaaacctagacctagagatggtgtagactctctcttcacctgataatacgtacttttctttacagttaccaggcaagtaactttaaggtgtaaggtttaacaatccaggttggattggcttattctgggtgggtggttgtagatttaagcaaccctagcttcttgtttcctgtaaaaggatgtctgtgaaataaagtgtacacagagaattatgtaattatgtgggtggttgttacagtactgtttgtaataataaaaagtcaggaaaagtcaaaatatttagctttgagggatttgttaaataaatgtttgtatagcacataatggaataagtatttggaatcgtggtatagatatacatttgttggcacagaaaaaaatgttcagggtatatattccagttggagttaggtgcaataacccatttttctgggaaaagaatgctcattacatacgccacacaggatctgtatagaatgtcgattacacaaattgcattacacccatcaatatgcgaggcccacagacatacatgcacagaggagattggacagttatgcactaaggtatgaaaattggttgtcccaaacaccgcatattctcactcataggtgggaattgaacacatggacacaggaaggggaacatcacactctggggactgttgtgggattgggggaggggggagggatagctttaggagatatacctaatgctaaatgacgagttaatgggtgcagtacaccagcatggcacatgtatacatatgtaactaacctgcacattgtgcacatgtaccctaaaacttaaagtataataataataaaataaaaaataattaatttaaaaaaaagaaaagaaaattggttgtcctctctggtattgttttagattatatgtgattttatttttctgtaatgaacatttgctttttataattaaaagaaatttagctgagtctaaattacctgggtctgcctcttatcttgccagaagagaccagagggaaggcctcaagtccttcctgttccaagttgcagaaggtaccctctgtgaaggtggagcctcccctcatttagtaaacattttgttactggagtcagtggcaaagtccaattcactatacaaagcttgactatagaaccaacttggcagcaaaattaatgcttgtacctaagcctccagttaatttaaagcctttgtgttttcagcaagttgccttatgatgtgaccacagaacaagctctaacatacccagaagtgaaaaataaactggaggcttccattgagaacctgagaagggtcaccgacaaagtcctgaattctatcatttcttcccttgatctactgccgtaagttgtacttgcagcaagtttaacattctttcctggaacgttcttggaatacgatgtaaaataagcccctgtagtgaagacagcagttttcccttatattgtgtttactattttaaaagattgcctacatttaccttttaaattcctgactgttctctaaagaaggggcaatacttcagtagcaaacacagctcagttattatcatcagtggaagtcctgtgattccattaccatctcatcttatgtttaatttttagaaaaactactcagctgaagttgactggaacaattgctgtgtgttttttcctcactccgccttttttccattattttcttttgtcatctgttttatatgtagttatggattgaggtatatagccaaagtactgaagaattcgatccatgagaaattccccgatgcaacagaagatgagctattaaaggtagattttcaagggtaatctcaccatagcttctcctgggggtatgaatcaaaattaccaacatataactttgtaagattattccccatgtatgattatttataataagctgcaggtcttctgtttctaatgactctcaagataattgattaagctgaggttaatttggagatcctagacattattgaaattctttgcattagagcattttgggggcaatgagcattttttcatcaaaaataactttgcaaattatgctattaataatgtgtgattatattcattgcctttattaaactccttgttaggatttacatcagaaaatgatctgctttctcttgggaaatgtaggagaatatatatctttaaaaaaaaaaagaaaactaaaactcttgagttttctctcttaaaaatggtcatgcacttctgcgtcactccagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggtgagaggggcccttagttttggagaaacgtgcaagaatggtaggcaagaataatatgtgctctgtgcccagagctagagtgggcatggaggacaggaaccccaggtggttacaagcatttcttctaccagccactggggaaagaggagagagggaagtgcaggcaagattgcctctgtctggcgatcctatcgcacccccaccacagcactcctattacactgagtcttttctgtgtgtattatttctgctgctgacaaaatggcatacttgttcttccttgtatgctacaggcttccagtacctagaatttaaaaatcaaaatagcagatttctgcttctttcaacttaagaagagaggaatcatttttaaaaagttttccggtgaggaagaacttgcttatctacgtcagatacatttgacccttgattaacacaggtttgaactgctcgggtctatttatatatggattttttcaaccaaagacagagagaaaatacagtattcatgggatgcagaacccacatatacaaacagatgacttttcacatacatgggttccacaaggccaatttcaaacttgagtatgcacaaattttggtgtgtatgggggtcctggaaccaatcccccaaacataccaaggaacgactgtagtaggaaatggaatacttgattttgaaaggttaggaaaacccagattttatatttgttgatgattgtgtatgtgaatatgttctgttctattctcaagcctttcttaatgacacatgtaagaagatttaattctattgattttgtgtttccaaattatatcactaatcattaacaagaaaggcatgagtctggtagtcagattcactcctcctggagctctgaggaaacactttcctcttgtcatgtttgttctcatgtctgccatttaatcaacaggccatagaagtgtaacatcagtttggcctcttttaatcctcacttggaaactcatttctcattcctcggtctcccttggagtgagtgacttactagaaaacaaaggtagttcatgattattcatttctatttagaatttgtggtcttttgtgagaaaattgccccaaatcctcctactacagaaagtgttgatttttcaagctaatttttcattctcctcactgactaacaaagtaatatccaggctgggcaacatagggagacctcatctctacaaaaaatttaaaaaattatctgggcatagtggtaagcacctgtagtcccagctactcaggaggctgagatgggaggatcacttgagccttggaggtcaaggctgcagtgagccgtgtttgtgccactgtactccagcccaggtgacagggtaagactctgtcacacacacacacacacacacacacacacacacacacacacacacaaagtaatatccatttcccacatttctcatgaacttttaactgctgttattcctatcagtcatttatgttcccacctattctttatttaaaaagaaacaagaccaaagaagtgagcctcttctaaacttgtcctttcttccactcatatttatcctttgtgtttctcagaaatctacaaaaaattataaccaaagcagcataggaaagccgactgttacatgggaacatgctccccacaacagggctctgctgtttaacctcccccagcctctggctgggaaagcagaggtcatttctggtacataagacccaggtgcctgtaggagagatgccgacaatgatttcaggcatatgaaacatttacaactttatagaataaaatgtatattcgacctgcacaagaattgtttaggcaaaaaatacatagaactattcaactgtgatcacagcatgcctcacttctcttgatctctgtcaaaacttgctttagcttaaaatagactttttagggtctgagtcctgggacatgttatgtatttgggtgtctagccttaacaatctttccatcggccagcaaatatttgcagcaacgaagaagagtagacttaatctcatttttgtcaaactggtaacagaagctctgaagggtgattagggtgatgtaggcccaggagcctgtgctgtttaaagcagcaaatttgactaattgcttttttttctattgtattcctcacacagacttgattcttagatcaagaattatcatttttgactttttaagtttcagggaccatttttaaaataacatttttaagatgacctacgcataggtcactatatcactaagtcacaaacagggcctgaggcccttgccactctctccaatcctgtttgaggagctgggtccaatatccagaaacatggatgcagctccgacagccaggagccagcctggaagaagctgtaacacgtcctctcaaggtttgagatgggaacaaagtacatgtcatcattcaaaatttcctagctattttgatgaaactgtttaatgcacatgtttgagtctgtcttaagacttttcccccctttattaggaaatatttcaaagaagcatgtaatgtccctgagccagaagagaagtttaatatggacaaatacacagacctggtgacagtcagcaaaccagtcatttatatttcaattgaagaaatcatcagcacacactcagtaagtggggatggggagccatcttagcaatggacccatgatttaggcatctgttatcttgaaaatgcttaatctctacaggacttattgtacacatgtgctaatactcatattcttaaccctaaaaatctcgcaattatttattccatgactcttatacattaataaaactccttctcccaaacaacaaaattctatttttacataattattccctgactcctagacattaataaaacttctccccaaaaaagaaagtgtacttttggcataatccatttacaaagccagattgtgactggaatggtggcatatgcctgtaatcccaacactttgggagactgaggcaggaggatcactcaagcccacaagtttgagactagcccgggcaacatagtgagacccctatctctactaaaaattttttaaaaactagccgggtttggtggtacatgcctgtagtcacagctacttaagaggctgaggtgggagatcacttgagctcaggagtctgaggctgcagtgatctatgatcgtgccactgcactccagccggggcaacagagcgagaccctacctcaaaaaataaataaataaataataaaaataaagccagattgtaaatatgcagtttaagccctgagccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatctggtttgcatgcagacatcactgccgtcagccattagcatgtattaagtatctgttgggtgcagggcactgtgctcagtggcatggggaaggaattgggaggctttagatgacttttcaaacattaaaattaaaaaaaaaaaagctaagcattgaggggtttgcattgttttctttttaagatcaattggaacttatttcatgaaaaaatcttggtttttaaaaggtaaccatttcaagaatagtttcagaccttgtgagttgaagcaaggtcctggggatatgttagcaatgcaccctggacctcccaaattagaacctgcattgtaacaagatcccagaggattcagatgcacattcaagttctagatgcttcagttaaggatgcacccaactttggattatacagagaaccaaagggaaagcataacaaatacacattctcaaaggttgtgctctagcccccatcaaaccagacatactgacaagtggcaggttagctgcttaaaatttcagtctattattaagctcttctaagaaactaaagcttgaatgtaggtttgaaggaaagattgaatctagtattgattttcttctttcagggttgaaacagggaacttccctgacatttacatcaagctctcaatacatactgattaaatgaataggctatccttcttttctctatatatgaacaccctagattacaaggaaaactgtccagcaatctagcaatgcattacttacagaaataattatctactggacagactcatttatatttgagcaatgacccatttgtctgtttttgtggtacattatctgtcttcaaagaatatgtacatcttgggtgcacatttgctgaatgcaatatccacatgcgaaaaaaatggtggggagtacttgtttagagtgagagattctttcccaagggtagcagagagaaaatgttactgtattaatttagaagtcttagaagtctttaaggagaaatagtctgttcttttgttaacaaaaattgaaaacagaattcaatcctgggaaagagagcttgtgactgatttggaattccttcctgtgttaggttagaagcagatgtaatgtggggaaattgtgtaatttcataggaagactgtcctgtttactgtctgccttctgtgtggaggcgtccgtgtgcagacacaagcacagcagtagcaggatttgccaagcctgtggccatgtgcttacccctttctctaaggaagatgcaagaacttccaaataagctctttaagaagacattatcaggaaatttttccgaataaagggtagaaggtggccacctaaataatcatttccaaagaaaacagccaaatcagttgccctggctcatcagagaagaagaacataaatttatccatcttgcatattttgttcttgtctcttaattttccctccaaaacatcatatgtaccgcctttccagattttgcccggtctttgtatcacctctattatttatttaatgcctttctttgaatcaactcacctttttaaaaacaacacgtaatttctttgctttaaaacaaagtacctctactatagtgaaaaactagcctgctttgccatacacagaaactttagaagaaaataagtgtaatgaaaacaaaatagttggatacagtcacttccttaccttgaagttatgtatctgaggtgtgttctctctttgttaacaactctccatgtgtcagggaaatgttaagaaaaatttagcatcaaacagatactctctccttcactgatcttaaagattagaagagaacggaaaaggcagtaatcaagacagtgctatgctggcataaggttagacataaagactaatgggatagaatcgagagtctagaaataagccatcacatttatggttaattcattctgacaggggactaagttcaatgggaaaatagtgtctccaaatggtactgggacaactggaaattcccatgccaaagaatgtagttgtgccccttccttccactctatacaaaaagtgaactcaaaatgggtggtagacatagatgtaagagctaaaactatagatctcttcaaaataagatataggagtaaatctttgtgaccttggattaggcagtagtttcttagatatgacaccaaacacataagcagcaaaggaaggaaataaactagacttcatcaaaattgaaaacttttgagctataaagagtaatatcaagaaattgaggctagacgtggtggctgacgcttgtaatcctagtactttgggaggccaaagtgggaggatgcttgaggccaggagttcgtcgacaaaataggaaaaaaaaattagctgggtgtagtggtgcatgcctgtagtcctagctactcgagagaatgagacaggaggatcccttaaagccaggagttcgaggctgcagtgagccatgatcatgccattgtaccctaacctgggtgacagagtcagaccttgtctcatttaaaaaaaaaaaaaaaaaaaaaaaatttcatccaggtgcagtggctcacacctgtaatcccagcatgttgggaggctgaagcaggtggatcacttgaggccaggagttcaagaccagcctggccaacatggagaaaccctatctttatttaaaaatacaaaaattaaccaggtgcggtgacacatgcctgtaatcccagctactcggaaggctgaggcacgagagtcacttgagcctgggaggtggagcttgcagtgaaccactccagcctgggcagcagagcgagactttgtctcaaaaaaaaaaaaaaaaaaaaaaaaaacttgagaaaaccaacagaatgaaagaaaataattgtaaataatgtgtttgattggggacttgtatccagaatatataaagaaatcctacaactcaatgatagaaacataatccaatttaaatattggacaattacacatcaaaggacataatcaactgagtgaaaagataatgtatggaatgggagaaaatatttgcaaatcacatgtctggtaaagggttaatatctagaatatataaagaattcctacgaatcgacaacaaaacaacccaattataatataaacaaaggactttaacagatgtttttccagagaagtatacagatggtcagcatcactaataattagagaaatcaaaactgaaactgcaaggagataccactcacacccagtaggatgattaatatcaaaatttaaaaaaaaaaaaacagaaaataagtgttgagaaggatgtgaagaaaatgcaacccttgcaccccgttggtgggaatgtaaaatggtgcagctgctatggaaacaggatggtctttcctcaaaaatttaaacagagaggctggagtatggcggcacgatcaattaaaaaaaattaaacatagaattacctcataatctaacagttccacttctggaagtatacccataaaaaattgaaagcagagtcaaagagttatttgttcactcatgttcatagcagcattgttcacaacagccaagcgtctatcactagatgaatggataaaatgtgttatattcatacaatacaatattattcagctctaaaaagaaggaaattctgatacatgctacaacatggaggaaccttgaagacattatgctaattgaaatgagccagtcacaaaaagacaaataccacttatctaaggtacctagagtagtcaaatacatacaggtatatttgtggtttctaggggatagaaagaagagataatggagagtgactgccaatgggtacccggtatcttttagggcagtgaaactgttctacagtcagagagtggtaatggctgcacagctctgtgaatacactagaagccattgcatcgtacattttaagtgagtggatttgatgtatctgaattctattttggtaaagctgttggaaaaaagattgaaaatggaaaaggaactagctttatcattatgatgcagagttttataaaatagttgctgagaacaacaaattttatctcctgtctccaagattactagttccgtactttggaaatgttgtttcaatctaattagaaatgcaagcaaaaacagatgtgtcgctgttcatgtgtaaggttgtaacaattaaaccaactccattaaaatttgtttaaattaaaaaaaaaaaaaaagtgttgtctttcatggtttcccccgagtgctgctacccctcaggagttaacactgtttcctgtaagacctggcaagacaccccagcagatgttactcatctttgggccttcttaggataaggaaaggggaaaccactcaggacatctaggtctcttacatccttacccatgagagatcttcaatgcaagacagattgaaacagctcatagtagtgattaagaagaagataactgtagtatttgattactgcatagagatgtaaatgcccttccagtttgctaccaatgttaactgaaagatctgcctcattctggactctttcccccaactttgactttttctatggaggaagagtgaagcacagagatcaggtggtagaaggcttccctttggcagaccttgctgaaaaagggtttatgaacacgtttcttgcaacaatttcttgatgtagagtaggtgcttccctctgagatacaataaaaactgtatctatgtctctaatttttataaatgtcatactcatatttaagatttaaatggtatgaggaggaaattatgaaaaatttcatataaatatggtacagttgagaatttacttttttctttgtgtgtgtgttgctttctacataaagctcctgttggaacaccaggatgcaattgcccctgagaaaaatgacttactgagtgaattgctggggtcgctgggagaggtgccaaccgtggaatcttttcttggtaagagcttgttccttctacttatcccttggtttttgtttaattgggtgggttggttggttggttcgttggttttcctatcctagataaaacaattattttggaatttaatgcttaagcatatttaaagaataacaactacacttgccccttcctacagtaagagttctgtaattaatggagtccgggattataaaataattcagtattcttgaaggtaagctccagatatgtcaaaaaggaattgtcaacctgtattatacagaaagaagccatcaataaagaaccaaatttattacaaaatgaaaaatacttttattaacagttatcctttttagtaatttgtatttgaaatacctatgtcccatgtcattttcatttttcaatcagatattttaaaagccactttagctatagtagaatgtgggttttgtaaagaccatgatctcccatttaattaccaagcctatctttcccacagaacctttatcttacattgttggtgccatcatcacaaagagtgaattggaaaaataacactaggttttttccctacaggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagtaagtttgggggttaaagggcacatgtctccaaatacacatcttaaatgatgcaaattcaaatgaggctaaatcccaactaatttatttaaaagtatgtgaacattgaaatctattatgtatatccatcaaacatctaaccaaaggataatagactctttagaatttaggaaggcattaaatattataatagtttacaacaccttccttggtttttagttttccatgtagtaatttgatttttttcctttgagaaatgattaactcagcttatgcaagtccttaggtaactgaagagaaatatctattacagagtggccagaagattagtgaggaaattcagttaaccaacgtttatttccggtataaaatcataatataaaaacacgtacctacaataagacattatgatagcatctgatttattggccttccttcctgttaaactgatcctggatatatttaccagctttgacttttatttgtaccctgcttcctgccgctaaagatttcaagtgaagcattcacactttaaataatactatcttttctccatcaaagaatcaaggatattccacatccatcctttacacacagagtaagaaagagaatgagattcatgatacaacaccataaatcaaaagcacccgctgaccaagcagtgcagttttcaagaacttatacaaacccaagaatgcatatcagtacattagaacagttatgtattggggtgagatggagactggaagtggaaaaatgaggacaaagggaacaagtatgtgttgaaacaatacgaaacatattacttccaagctacctgtcctgagttctgaggttttaatttgtggcaagagctttctctcctgccactgatgtgctgaagtgtgcttgaagtgtgaatgaagacagcattcatctccacttgatttttttttttaaacattcaatcatctgtgaaaacaacaggaagagcttcttcactgtgctgtgttgatatgttcctctcttaggcttgttgattttgtcctcagatcatctgaggctccattcggtcatgcagcaaatgcttgactacctactctgtgttcatgcgctgggcttgaggctgggatacaacagtgggtaagctggaaacagcccctgtcttacaggggtggagagcacagttcgacagtaggaccgcaaccaagttgcaggactaggactcacccttggcctcacaagagttgagggcggttctttttgactacagattaccaaggcagatgaaaatttcagggagacaattcagggcagggcaggagagaaagggggagaaagtctacaccctgggttcctctgaacaagtgccaattataaagataactggaaatacagattgtgtggttttgccatgtaaatgaaattaggccaagtatcccatgatctcataagctttgtcctttagaagtaatgggaagaaattttttcttaattagttttgtctgctatttgaacatcattttctaaatccagtcaactccaatgtctgcatgatatctgagaatcaccatttgagtagttcaaagtatcagataatctgaatatcatatatatttatacttattcctgaacatgagtctgcatgattctgcaaattctaggaaatcacatttaaagataaaaccataaaagtcaggcctgtctggaagcaatgtgtcttagcctgggaaacctgggacattgtcctgtttgccttacccattacccagcctctgcccttgtgtggctctcccccgtcccccccagtgtgttggaaacaaacactatccacttctttaatcaccacactatgtagagccagcagtgggtttattttttattgtggtaaaatacacataaaacttaccatttcagccattttaaagtgtacatgcatttagtacattcgcagtgtgcaaccatcactgttgtctagttccagaacatttttatcagatgtgaaccctgtacccattaagtagtcattccccattccccgctgctgcccagcccctagcaactactagtctgcactctatgtctttgaacttttgcctgaagatatgaagtcgtatctcactgtggttttggtttgtacttttccaatgaccagtaatgttgaggatccttccatatgtttgtcatccacttgtgtatttatgtattctttttggagaaatgtctatttaactcctttgtccattttaaaattaggttgtttgtggttttgttcctcagttgtaagagttgtttatatattctggacactggaccattatcagatatatgatttgcaaatatttttgccccttgtgtgggctttttactctcttgataatgtccttttccgcacaaatgtttttttttttttattttgatgaagtccagtttatctgtttttttttttgttgttgttgttgttgttgttgttacttgtgagatttaccccaatgttttgttctaaaggttctatagttttagcttttacagttaggtctattaaccctttttgagttcatttttgtgtgtggtgtgagacaggtgtccaccttcattctttcttgttgttattgttgttgttttttgtttgagacagcgtctcgctctgtcgcccaggctggagtgcagtggcatgatctcgggtcactgcaagctctgcctcctgggttcatgccattctcctgcctcagcctcccaagtagctgggactacaggtgtctgccaccatgcccagctaattttttgtgtttttagtagagacggagtttcatcatgtcagccaggatggtctccatctcctgacctcatgatccgcccacctcagcctcccaaagtgctgggattacaggcgtgagccaccactcctggccccaccttcattcttttgcatgtggatgtccagttgttctagcactattagttaaacagactattctttcttcatagaatggtctaggcacccttgtcaaaaactaattgacaatacatgtatggctttatttctggattttcaattctactccattcacttatatgtctatccttgtactagtgccacaccatattgatcactgtagctttgtaatgagttttgaaatacggaagtcctccaacttctttcttctttttcaagattgttttagtcttgcagttgaataggtctcttgcagttatatgtgaattttaggatcaacttttccatttatgtaaaaaaggcttgaggccagtgttttaatagaggccctaagtcttttatgctcaaaggccttcctcttggcatactgtgagatcttactgttggccgaccactttactaagcagcccagtgatcaatgtaggtaacaatttgaaatcaacactgactggttagccatccctgaaagtgaaatttggatattgcccaaaaggttcaatagaattagttctatgattttagccaagccctgcttctaaatatacttcctttaaagtacatatttgaaaaaatcttgatactaacagataattacaaagtgcagcattgacagggaacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccacctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgcaataataatagaaacaaagtgcacaataaatgtaacgcacttgaatcatcttcccgaaaccatcccccaccctgtccatggaaaaattgtcttccacaaaacctgtccctggtgccaaaagggttggggaccactcctttaaaatattgatttgaactctcatgaggatgacttttttgatttgaacactctcatcaggatgacttttttccaagctaataaaccgaatttgtaactcaagcataagatatagttcttgagattcattagagaaccaaatttaactaaaatcggacaatgacttttataagttatgaagtggacagacatgaaatgcagagcaattgggatgtgaaaatacctagcttttctctatcaaaaaactattctgcttttttgtgaaacagattgtgttcttaactttcagaaatgcccttatgtttaattacaatgtcactagttttccagtcatgagtaactcatcttcatggaggcccccacagtagcagaatttgaggcattgttaatcattatgtttgtaaatttaattccatgctagtctcataattcttactcatcagatgaagatgaagatgatgataatagcaaacacctatgtagtgcttaccatggccagggacagtttttatatactgtgcaaatgcaaagtgttccagaattccaaaccttttgagagctgacagtggtcaaaggaaatgctctttggagcgttttgaattttcggatttaggatgctgaagcagtaagtatataatgcaaatgttccaaaatctgaaaagataaaaaatctgaaacacttttgggcccaagcattttgaaaaagggacccacaatctgtaaagagagaaagagaataacatgtgcatatatatatattaaaataaacatgtataaaatatgtatgtaatattctcagcaaccccaagagagtggaggttattatcagtattttacagatgaggaaactaggcacagaacaggtataaaccttttcctgggtaacacagttactaagtggagcagagattcaaacccacatgatttgaaatcctccagggcccacactcttgatcataaagttttacaacttgtcgagggcaaggtcattgttctttgcattcttaggaatcttagaataaataatgagaattattagctgagcagttactgagtaacggaggctggagcatctttccaggccaaagaggagggacaaagggcacatatcggagtaggaagaaacatttatttctttttcccttgtgtatgtttatagaatagagaacctcagtttgggctattgctatttttctaatactaccaagcacagggatatttaaaaaaaaaaaaaaaaaaaaaaaaaaacctggtcgaggaatcctaaaaacctagtcgaggggtcttagggatgacatagggttatagcctcaatctatcacttattaaccatggaactcagcaagttgcctcgccatcagttttctcctccataatatagaggagaggggaaaggaagggctatgatgatcacatgaaattataattaataccacataaattatataaaactatgcagttgtcaacctttcattataacttatgattcaacttaaaatatgtgatccttatggccttaattaagcttagtttcccacaaaagtatgtgtgtttaagtagaaggcaatatttgtggtttttaatcatacttagctgcttgagtgcttaaattgtcatctcttaagaatttcctgtcacatgattaagtttaggttccatgatcccagctgaaagatttccttgttttttggtccaaactagcaggagcactaaatggctaaggtgatatttgaggtctggagctaataatgtaaattatcttgttaggatgttaaatactgaaaatattccttagtttccacaaacactgattgcttttcaaccttgggcacagtataagcagatgacagagggggagcttcaggaatgctactggtaataatagataccatatgaatggagtggccaaacccaaggggccacaccagcttacaagcgccgtatgggctcatttatctacagtggggtttgagcacagctatgatgaataaactccctggtgtatttctttctctttttttcttaattctttttcaaaattagatacctcctcattcagggagagcaagacccgtggtttggatcaacctatcttacatatttgaagagccctggcgccagtactctaagcagttgatttatgctggtcagaccatatccagaatgttatatttggactggggtgggaagggggatgcatattaaggtcattggtaactggaatgtgagcaggactgtgagctctctgcagatgccattgtgaggagctttaagggactgagtggtttcacttggaaaaaggaaagatggtggaagaggggatagaggaacacagtcttggcatttctctataggtttttcaggagctgctgatttggaaagggaattggacttgtttcctgcagctctagtctcttaggtcttagttgccacatttgtacaatcagggattggattgtttttcaaaggtctctctccgggccacagtcctaagactaaccaggtttcatgactgggtggccctggaaggcaggcctctcagagtgagctcctgtttgagaatggaatgtgccaatattgtactctccaaaagaaatttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattttacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtgagtgcttaccatgtgccagacctcacagaaggctttagatcttttcatccaatccttgcatcagtcctgagagattcctgttttataaacgaaaaaacaaaacctacaaggattatataacttgcacaaatccacatggctaatatgcaacaagagtccaagccaagacagatttggctttaaatctgtccgtccccgtcgtccttaagcactagacacactgtagtgggagggaggtgggttccctgtcatgggactggatggttacttatgtctgaggtagaactttggcaatgaattccacaggcctggtgtacagtagaagtccaagggaaacaggctgtgtgagcagtttgtcctccagcaactcttgagcaaataaacattctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatgccatcccccacgtggctgtaattagctgtgggcccacctttgagtctctgtggagtatttagctgtgcattcccagacagcctgtaaatccccagcagcaaagggtcatggggccagaggaaatggttctccaaaggctagggggaagggaggcaaggaagacacattgtgattgttcttttcacacagacttctgataaataggaaatgagaaaaatgatgtttacagatggcttattggattttatcctattttcaaaagtaatatatttgtaattaacttgaagggttttctctgtcatttgggagtagttgcccatatccttcaaaatgtgaaaattttgttctcatttctaaatttcatgctacatgaacatttcctgctagagtttaggaagaaaaattagtcattcagtgatatcatgtaatgactctgaaataactaaagttaaatgcaataacgggactacagtaaaagtgaaacttcagatgtcaattagaccagtgtatgtataatttaaacaaacttttgtctgtgtttccttttcttctttcttttctttctttctatctatctatctagatatctatctgagatggtatctcactctgtcacccaggctggagtgcagtggcacgatttcagcttactgcaacctctgcctcccgggtttaagcaattctcacacttaggcctcctgagcagctggaattacaggcacatgccaccatgcccagctaatttttgtatccttagtagggatggggtttcgccatgttggccagggtggtctggaacttctgaccgcaggtgatccgcccacctcggcctcccaacatgctgggattacaggagtgagccaccgcgcctggcccttttttttctttttagaaggaaagccttttccaataatactgtttccaccttatgtaaaagtgagcaaatttgaccctttagcttttatgttaaaacctttgtacgtaattacataacatgatgcctccctaggaagtggtggccaattgccataaagaacacctatgagagaactacggttttcgtacttccagaagaattttccagctctttactgtttactgagaagctcttctattctcttccacctgaagactggaagaagacctaacaaataggtttctttgttaaccctatttgttagttgctcaggcccttgaacaccatcctcctcgctgctgtgtcagctgacagaccaagcctccacagcccacactgaacgttcgctcccactggtcttcagactctttaatagctttctgatagtaggaaaggtaacagttggtctggctcctaaaggcttatgaggtattaagccagctcagaagtctaggtgctattaaagtcaggaaaggagaatattagatatcattcctgcactctgcagtagcaggccatatcagcagcacttgctccccctgcccatcaaaaagtagtctccgtctaaaaaagaaggaaaagtatttagagaggaaatcttgtgatacacttgtgcccatgttactgacagtataatgctacaacatcaagcacagaaagcccagactttgattatcaagcattcataaactttcaggagccttatagcagacctggtgaatatccgcaagaatgttttattttaaggtattatctttgaagcttcagtattgtatgtgtttgtgcactctcttaggagaaacagatttttgtgcataaggactacagtctgaaagtctgtctctttctctggtttgttaaggaccaagaagctgataattgatgtgatccggaaccagccagggaacacattgacagaaatcttagagacaccagcaactgcgcaacaggtaatttgactttaagtgtaaaataataatagacaggtgttgattttcttcataaatctttatgccatatgtttattatctcagagaaactgtatctgacatggtccggaagtaaggaattttatctattactgcagtggacttagttcagccatatataaacctgtatgaagtatcaatgggaatgaaatagaaaatacagcaccaaattcatgccgaatatacttttgtcttaacctaagatgatagttctgggtttttcaaagcccggaaatgttcatcataatgggcaaataagtcagttgagagagttctagctgacaggatattgaaaaatacctttcacattttatgtatttactaacttgaaacaaataagcgactcacatgttaaagatgttttccaaatgcttcagaagcaaatgttgagtccactgagtcaaagcatcattatgttagcgtaagtgaggtttcacaacaatcttgcatttagctttttattaacatctttgaaaatacgtcattgttcgttctaaaataaattcaaggttgttattttagtaccaataattgccgctccctaaacaaaagttaattatttaattaactatttcttagcacagctacacataattttcctggatcattcttaatttaattgattgccaaggaatccttgtaatagtttttaatttaaaaaatataaaaggctgggcatggtggctcatgtctgtaatcccaatactttggaaggctgaggtgtgtagatcacttgagcccaggagttcaacaccagcctggacaacacagtgagacccccatctctaatttttaaaaatttttaataaaaaatgtaaagcaaaacttcaaatcacacgtttgttaatatgtgggtatgttttaaacaatgtgggtaaaatattatactaggttagtataaaagacttttactccttactatttttcattttcccctaaatgtatcatgaataagtgactaagaacacagacttctgagatcaactatacctctgcacctcctaggtgtgtaactctgtgcacttagaagcattgctgtgccgcagtttcctcaactgtaaaatgggtataataatagtacccagctcacaggcaggattaagtcaattaaacatgttaagtgggtacatctgtatctggtgcacattaagtgctcaacaatgttggctgctgcttttgttatttactgctaacctggtaataatgttccaataatattgacctacctgtcctgtgtctaagattactgtccctaactaatagtcgtttccttagacttcatctattgggtcagtcaattgtctagtacaatgaaatgggaagaccaatagtctctttttgttactgtttccttgaacagactatccaaagagtattcattcattcattcatttactcatcgtttgggaatttataatgtgctagaatattcttattccctttggctcaaagaaactttgcaagtttttcagagttgctggtttgtgattcccttataagaataaagctctctgactgccttactgttggtttagtttaggactctccataaacatggctgatgtgtgagagtttagctgggttctgaacattcagggttctcatagccacatttcaataggtaatctagttttagtttcctcagctagcctatccaggaattgaaatccttccatgtggggaacaaagtagcagttatccattaaaatatgtccattactatagtgatttgtcaccttggcaataaagtagctattgagaatttttcccaaataaggcttgctatcgaaaagatgaagtaattcctttcaaagacctacttcaaaactcaggaagaacatgttctggttctagtctctgaactttggctggaggactactttcattttgacattaacttgcattgtgtagcttatgaactgtgaaattaggggatcagagaaaactcagcatcttgatattctcttttcaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggtttttggaaacagtattctttcttccttcacttagcagacatttgctaatcaccagtcaagtgctgggcactctgtgaggtggcattagggattcatggttgcatatgctgtggttactgccctcttcaatgctacagatttttcaaggtttcaaagcagttgatgactttttttttttttttttttttttgagttggagcctcgctctgttgcccaggctggagtgcagtggcacaatctcgactctctgcaacttccgcctcccaggttcaagcgattctcctgcctcagcctcctgagtagctgggactacaggcacgcaccaccacgcccagctaatttttgtatttttagtagagacggggtttcaccatgctggccaggctggtctcgaaatcctgacccggtgatccaccggggcctcccaagcagttgatgacttttaagagaaaacaatcacaacactttcatgtcattaggagagttgaaacagaccagaaataaatactaaaaaatgtacttgacaagtttggtctatacctttaaagttttaaaaataacactattggaagagttttctcctgagatgttagttgtcatatagctcagttgctcttagaacctgccactgagatggaactctgtgtccctgatcatttgtttttaagcaatttagcctaaatgcagttcagacttgaagattagtttctgttttcttatccaatatttttacacttgagaaacttcctgagcaaaggatctcaacttagtgcaatgaaacatcacaggaagtggctgagatctgtttgtcaaggataaggaagtatatatttgggttagaaggatatttcattctttttattcaaacatgcaaattaatatggatctagaggttaaaggcagttaaatgaccagaaaaaaaaaaaatttctcaccttctggaagggaaatgcgctcagctttgttctttgatagaaaattatgttcaattctggcagtaggcttattccttctagcccaagtgactcaagggaaataacatttctttctttagtttgggggtagaaatatttctatttgggaatatggggtagataaatatatgcttttgctttaaaaaagaaaaaggctatcatgaagacatgatattctatttaatgaatattctattatatgaagaatttctatttaatgaagaattctatttaatgaagaatattctatttaatgaagaaattttacctaagggcatggggaagttgtgggggagtgtatgtgtatgtaggtatttctttgaattcctaggggaatggtttttaacttgtttacaaaagaaaaataatattaaacaggcaccgttttcttaagtcaaacattttcataacttaccaattagaattatgaaaaaaacttatatctgcaagtttaaatttagcatagctcttgtaagctataagcagcttatgcaacttaatgttctaggaattctatttaaatccaagtaatagttatcaatgttgaatcttttcactcagtcttgacagcccagtgttgttttttcaaaccttgggaaatatttgtcagatgaaaaagtttgttcttttcttattttaaaaatgaatttaacaattaaatgtaaacttttttagtttaaagtactattcaaagaggaatattcaaaatagtctgaagaggccgggcacaatgtctcatgcctataatcccagcactttgggaggccgaggcgggcagatcacttgaggtcaggagttcaagaccagcctgaccaacatggtgaaaccctgtaactactaaaaatacaaaaattagccaggcatattggcacgggcctgcagccccagctactcaggaggctgaggcaggagaatcgcttgaacctggaggtaaatgttgcagagatcaggccactgcactccagcctgggtgacagagcaagactatgtctaaaaaaaaaagtctgaaaaaattgcatttctgctactttgtgccccttttaaaacgcaatttttccttaaactaaatgtgtggttattctaaaataacttctttgcctttccatccagagcaaaattaatgttaacaagtctcttaaagtgaaatatgtacactttccagttctgaagtaaaaagggatgggaaccctgtggtgttgagagtaaaataaggtgcctgagataagctacaagtcaagttacaaatagcgacttactactgcttgatattcttcttgtcccaaactggcaatatcataaagcaaacttctgcttaaatatgataccccttacttgttgttttaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaagtaagttaaaatcatgtcatgttcatttgtaatgtcatgatttctatgagatgtcaattctgtgtttctaggcagttgggttgggtatggaagaaaactttttgctctgtcttctaaccgaaaactagagtctcagttttattatttgccactgtgaactaagaagtcaggagtaagtgaaagcttttcaattccccaccagcactagaattaaagtggcttacctgttgtatattgagcaaatagcattagtaagttagggaagcactttcattattccttttgtcttttttagccaaagatttttttaaatactattatttttaaagtctcttgtttttggaatgtattttatataattgataatattagataatgccaggtgtttgctaattgcacagagcagctgaatgtttttaaattgcttcatggttttaaaaaattattgacacaactggcaaaatttggcagccgtctattatccattagcataagtattataggtttttatatacagtatagccatttttaatgaatatcctttgcttagtaattattcttatcactagactatgatcaatgctagttaaattttaattacccatttaaatatgtagtacaatatttttatataatccttgtcatcaaattggcaggaggaaatggtgctgtatggaaaaatctattgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactgtgcaatagatttcaaaaaaaaactgattcctcctaagatttcatatcctttgaccatcatctccccgtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgtgtgtatatataccacattttctttacctgttcatctgttagtagattcttaggttgatttcataacttagctaacgtgtgagtagtgctgcaatgaagatgggagtgcagacatctctttgacaaactgatttcacatcttggagtaaacacccagaagttggattgctgaaatcacagaagatttgataaagggatgcagccacatttaaaccttattgatttggctcccactagtcctgaattttagttcatttgcttcaggcttctctctgtttctctctctctctctctctctctctctctctctctctctctctctctctctctctcactctcgtgctctctctctctccatatatagttcatttgcttcaggcttctctctgtttctctctctctctctctcactctcactctcgtgctctctctctctccatatatagttcatttgcttcaggcttctttctgtttctctctctctctctctctctctctctctctctctctctctctcactctcgtgctctctctctctccatatatagttcatttgcttcaggcttctttctgtttctctctctctctctctctctctctctctctctctctctcactctcgtgctctctctctctctatatatatatatacaaaaatacactaaatatgtatatacacacactacatatagtgtgcatatgcacttataattacataaacatatacactatacactaaatataggaaggaaggaagaatatatacatatacatgcaaggaagaagttggtcaagcttactttcagtagaaatgagattgttagggatttactttaaggcatttcacacaagatccacagtcgggcgaattggatttgggttctgattctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccgggaggcagaggttgcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctagccacatagtgtttgttaaatagattaaaacagtcctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaaagtgtatattcagcgctctgagggccaggtatgaacagcgatgtcactctgagtatggtaatcgcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacacgcatgccatttgatttcttgtggccttggagagagctccatttggtctagcaaggcttaacctcaattactgatgggtgacaagggaagaatacacaaattgttatggctactcttcccttggcctcagcatctggtgctgtcagtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagcacctttctcatttaaaataggctgtgccaacccctggatcagagccatttccaaagcatgctgtgagtgtgtgtattcggtgtagtggaaaaaacaaaccctccttcacagccccacatcaggcaccatgtgctgcctccttttaaaggggtcatgagcccagtgttccatcactttcttgtcctaaaatctcaagggaagccagactcactggcatttgccttttctttaactcctgccttccttcaaagcctgacttctgtttatcccatgaaacctcctgacaacaccaactcagaagaaaatgcttcttccagagatggagtctcactctgcggcccaggctggagtgcagtggtgggatcttggctcactgcaacctccacctcccaggttcaagcgattctcctgcctcagcctcgcgagtagctgggattacaggcacatgccaccgcccagctaatttttgtatttttagtaaagatggggtttcaccatgttggccaggtgatccgcccgcctcggcctctgaaagtgctgggattacaggcgtgagcgactgcgcctggcctgaagtttctataaaagttatcatctgaaatactcaattggctataggtcaataatgttcatgttctgtgactcacatatttccaattatgttttatgctcttgaagagcaaggaccgtatcttctatttcttttgtaataaagcacctatgtcagaactctatgagctacagatctcaacaatagccatcaaacctagtgtttggagagcagaattgggggaaagatgacgtgaggtttttggtgacttccttaggattttctcaacaagccattatttaaaaatgattatttgagattccattagtttgtttcagctttaagcacatctgtatttgtaatttctcatgtatgaatgttcctttcttcacaggtttaagaatgttacatttgatatcatagctactgaagatgtaggcattttcgatgtaagatcaaaattccttggtgttgagatggaaaaggtgcaactcaatattcaggtaagctgctggaatttctgcacattgatgataaattttatatgtggatcatacattgctaccctggctctctctcttcaggacaacaataaagtttaacagaaaaccagtgccagccttatttgccaatatttgttaagtgttgatgatttttaagagctgtgacttttcaaatgattggaaattgatatgcttctagctggcaaaccatagcagtcagtttctctaagccatgtttccattttaaagcttagacaaaagaatataatttaaaagtattcagagctattaaataaatgctataaattttccttttattggaaacttgcatttctttctaagactatgtatgcccaggactggaactttcatgatctcatttttccctctctcctagaatggtttttcttttttgtggggggagggggtgggggtggggcattgagaaggggtcttgctctgtcgcccaggctggaatacagtggcatgtatgcccaggactggaactttcatgatctcatttttccctctttcctagaatggtttttcttttttgtggggggagggggtgggggggggcattgagaaagggtcttgctctgtcgcccaggctggaatacagtggcacaatcatggttcactgcagcctcaacctcctgggctcaagcgatcctcctgcttcagcctctcgagtaactggtactacaggcacacaccaccacatctggctaatttctgtattttttgtagagacagggtttcaccacgttgcccaggcttgtcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaaaaaaaaaaaaagagagcactgcaaacaaatgttcatctgcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtgaattctggcctcactgtctgtgcagcccagggctccatgcactggaattacttccccatcatgggagtgtgtgccagagcccttcttttctggcagcccttgtaagtttaaaagaaaaacgggagctgaatgggtttgataaggacattgagataatggagtaaattagaattcggagataagatgaaagctattatgtaattattgaaagtataattaagtaaacagtattgttttctaacttactttaaatgtcactaaatgtatccatttaataatttagctaattagggtcttcagttattttgtgtaacagataaatacaggaagagaaaagaaggtgcttgtggtgataccctttggttagtgattcctctgtagaaatagcaaaagacatatgtgattgccaagaaggaaattatccagggccagtcaatatcaactggaccaatgagtcacaagtgaccaggagacaccttatattgtgtttagagagaaagcaataattccatgagacttcctttgagtactggtataaaaaccaagcttcacttgttcctttgttaaggattctgtatacagtaagattagctgttcataccattcatttatacacataatggattgtgaaatgttaatccttagctatatgcaggtgaccagtatgtcctgggttttttaaatcagtagtgcataatcagaactggctacatccttagcagggctcagagcaaaataaaaatgcagtgccctgtttttaaaattattaaggattttaggatgatgacagaagagaataaaaccctgggcatgggaccctgtgcggctgcacagattgcatacccacggagccagccctgcatttgatagctgtcagatgtaaaggcagacttctatttatatatgcagctttcagtcaattgcatgaatgtgtaaattgtcaaagagaaatgtgatggccaggtccttactgtgagtaaaggaccaggaacaggaccaaagtttgaaaggactaaagaaagccccttctaacattacagctctatgtctcttggttatcttcagcccattttcccttcagttcctaaagaaaaccataggatagaattatatcctataattataggccatataggtaacaggaggatatgacttatgtgatatatattcttcttgtaaaaataatgtcaggtatttatcggggactgcagggtgggccttcttcctctcctagatgaagaactgaggttcagacagctaattatggaagataattagctgggataattatggaagataatgcagctgggatccaagttcttcatcactctagtccactgcctgtctcataggattccagttgatcctgcaagacaagagtagcttacaaagggtttgcatataccttaatctcatatctcattcccagtagcacccttgtgaaattggcagtgttatccccaatttacacacagggaaacagaacttcagagaagttatgtcatgttgcaaggtcttaagatagcaaatggcagagctaaaactaaagtctgcttttcaagtcatgagtccagccatgttttctctgctccctactttggggacccagctacttcccctacatatgccattccttttcaatctaactctattggtttaattcttttccactagactttgtttaacagatgttgcatttcccagaggaaaagtgaatctcctctacactctaaatagctaaaagtattattgatgaaaggacttcaattccctatagaattttagttctagaagcatatctgaataatgtaggggttttcttaagtgcagtgagaggtaattgaggaagtggaggaggaagctgccaagagtcagagttctctcaaagatgactccaacttctacaattgaccttgctagaaacaagaaaatgagacttagatattgggccaggacagctcaggaattatatcttccattgggaaaggcttcctgtacctatgttactatgaaatgttacagcttagtttcatgcatatggctggtgtgatccagttacttattttaaaaagagagttgatttcctttgtttatatgctggcagtgaaaaacagaatgacagttcgacttaagaatgagggcttgttctcagtacagaaacagaagtagcctagatcaagaagtgcggaccaccgctttgtacaatggtctccaaactttggtcacttcatcaggaaatagtatgagcacttctctccatacatagttatttgtaaagtatacatgcttctgctattgtactctaaaacgtgctgtattatataccaaaaaagtccaaaaaatgagaaaaaataaatagaaataggagttctaatattctttttgcttccccagtgaatgtcttgctcacttcactttaaaaaaacactgctttctgtgtttttgtttttgtttttgtttttgtttttgtttttcgggttttttgagacagagtctttctctgtcgctgaggctggagtacagcagtgcaatctcggctcgctgcaatctctgcctactctgttcaagtgattttcctgcctcagcctcctgagtagctgggattacaagtgtgcaccaccacgcccagctaatttttgtatttttagtagagatggggtttcgccatgttggccaggctggtctcactctcctgacctcaagtgatccacctgcctcagcctctcaaactgctggtattacaggaatgagccaccacacccagccagaaaacactgctttctaaagaatatgcatctagccagaactttgtgttttaacattttcgattaaaaattgaaattatatatctgacattaacttaatgatcatcatttactttcatacagcccttatcaattccaaaaagctattttctttcatctaagtcacaatcacttgggaatttattaaaatgcaaattgatgggccccaccagagagctacataacaagaaattcctgtgggaggagcccaggcagcctttattttaactagcctatgtttttaaccagatgattctgatgtacacttaagttttagaacccccatctatggcctggtgccatggcatgcgcctgtagtcctggctactcgggaggctgaggtgggaagatagcttaagccaggagtttgagaccaacctgggcaacatagttagaccccacctaggtgattaggtcaattgaatctgacttttgtcaacaaattcttctaatatgttttttaaatgcacaaaatgtcaaagttgagatttaatgatgctttttacaatttcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaatttggcttttaagttgtcttaataaatcaaagtcatttagtgggtaggggaagattcttggtcgggtttgttaggagagaatacatttcttgctgtactggttaaagtagagagcaagctgctgtaaggaaaagatacaaaaccctggtgtctaaaacaaggggtagaagtttgtttttctcaaattcagctcaacggtgagcagatccacaaggtaaagagtttccaggtgggtcagttggctctgtccttgtactgattccccccagccagatgaggaagaggatgacgaagaagtccagggcaagccttttcagttatacgcatcactttaacttccacttacattgtattggccaaaactgagtcatgtggacacagctagctaaagatagtccctaactaggcagccatgtagccagtgaatacagagaggtagagagggaattgggtctgttattaaaaggaagaaaaggagtgtgattcctgctgacagtttaggagtcttcaccacaaaaggattccagactctcaggctggaacctccctgccactttgttcatgcctgcaacaggctttattttttcacaaattgcaaaatattgagaaagtaggttagtttatgtacatgtggcacaaataaacttgaagggtaagaccaacagaatttggaaaattcaaattaaaaaaagtaaaatctgctactttagtgatggtttcaggctatgtatatttttttgacaaagagatgaatagcttaaaacaatgctcactatctcaacagtttgcgggtatgtatgttttgtaatgcattagccttaatgcaggctttggtagaaggaattaaatatacagttaagtttcacgttgaaaataaacctccctcttgccctactgctagcattggaaaggggaacaggagccaggggcaatgaggggtgggcagggtaagcttccttcttgctccgggcaaggcttttagtggaaatgtatagaaggagccaaaattagggagcaatgttttggaggcaaaagccagcctttcccagcatctctgaaaggagcttatcttaacttattgcaacactgaatgatatgcttgaatgttatttgtacgaataaagatatttgcatcatgtcaataccttcaaggaacgctgtgaatgatttctctgttggcccacaagatgaggttattgttgaagacatcaccaattgctatttgtgtgagatctttaagcggtatgaatgggtgacctgagaagaaggctcatgatgaaggaacaaaaccaagggccatcggggcctgggtgtagcagacttcagtttacagagatttgttggagccaagtcctgtgctactctttaagaggactaaactgtccctcaagccagaggacaattcttgataaccctgagcctgagccactaaggactccaacttcctcccagagcccatagatttttcttactcaatggaaaaggttttttgttgtttgggttttttgtttgcttgcttttttgcttttaaacactgagcaattggaactataacttatttttgcaaaactgactcctgtattttgattattttgattattttgatcttaaaagcaaaaagtacttatgcaacactataggtgctctcaaaggatatgctttagtggtcttcaggagaaggaaaatatgtgtatgctttattctgaaagttagtggtgaagaaagaccagcttggtgtgaccgttgtctgatatgaatgatctcaactataattatacgttagtgtttgtgtgtggttgggcacaaattagaaatgctattcatgatgtgatttttatgactttgtcattaagtagggatttgtggtattcctcaaacattccaagaggcaaaccacaaaactctgaatggtgaaagttgtctttattttgaaaaattatagtgagcactggatgttcttattgctggttagctttttgaaaaatctattgccaatgttactaaaaccaaacttggtaacaggttacaacagaggccccctaagctccagaggacagaatctgtgtttcagtcactctaaatccggagcctggcaatgctttgtaaataaatggcaggtgcagacaggggttctagcaatggaatgaaaagcagacagaccctaccacccccactgcccctcaggagtccactattacttcaggttggcacttggatgaatggggcttttacttattatctcagcctaaaaatgaatagcctctcaactcaatctccaaataaaatatcttatacagatttactatgttgcctcactgttttccttagagtataaaatcttttagctaaaatatattgaaagggaaatcaatgaagagggagaactaggagataatgtgttcaccttacttaactggaatgaaagtttttggtttttgtcgtcttttaatagatactgaatttgacctttgtttagcaccctaaatcatagggatagcctaccattctatcgatggtagaaatatagttgttgatccattatgagagataaacttccaaatctaagctgacagtacgggtttataacagcgaaagacagaaacaggtcatctgttggttggcttgtaacctgattacaaaccttctgtttgctttaaaaaaaatgtggcaatatatacacagaatctggtagtgcctcaacctactttgaatactttcatatgagctctggtatccccatcatttagcttccaaaaggaaattactatgcaagttcttagaatatactattgtctttggaacacttcaaatagaagagtggtaaccagaatacctgaagcaggtagatcatctgatggcttacatgaaactgctttcgtatcatctagttattaaaatgtttaccacgttgatgccacatttgtttgaaaacactactaaataccataaacattatgggaggatggctaatgactcatactatttggtaccaggcaagttaaaacagagaaaatgaaaaccggaaactaatatcaagtggttccaatatgaatgatgctgcaaagtcaagatttcatttccaagaaatatttttagcaactctggttaggcagattttcaacatgtttatcatctctggttaagtagattttctactctcagaaacctacagatgtttgctttaaaactgacaaaggggttttggtaggagtggcgtggaacaaatgaagtagtgggttatcttcttcaaaaagctcttaagaggccgggtacggtggctcacgcctgtaatcccagcactttgggaggccaaggcgggcagatcacctgaggtcgggttttaggaacagggcgccaaatctggccataaactggcccaaaaactggccataaacaaaatctctgcagcactgtgacatgttcgtgatggccatgacgctcacgctggaaggctgtgggtttactggaatgagcgcaaggaacacctggcccacccagggcagaaaaccgcttaaggcattcttaaaccacaaacagtagcatgagtgatctgtgcctggacatgttcctgctgcagataactagcaagagccatccctttgttttggcccatccctttatttcccataagtaatacttttagtaaatgttatgactggcttgctgtcaataaatatgtgggtaaatctctgttcgaggctctcagctctgaaggctgtgagatccctgatttcccactccacaatctatatttctgtgtgtgtgtctttaattcctctagcaccgctaggttagggtctccaccaccgagctggtctcggcagtcgggagttcgagatcagcctgaccaacatggagaaacccagtctctactaaaaaaaatacaaaaattagccgggcatggtggcacatgcctgaatcccagctacttgggaggctgaggcaggagaatcgctccaacccaggaggcggaggttgtggtgagccaagatccggccgttgcactccagcctgggcaacaagtgcaaaactccgtctcaaaaaaaaaaaaaaaaaagctcttaagagcacataaacataggaactttgtgaagtctaaggacaaaacaaaaaacaacatcactaacagaccataaaattagaaatcagtcacaaaaagccagtcaaaatatccaagaatttatggttgaagattgaatgaaattgacaaaatatttagacctgaattttatatatgcacatatcaaaacttgcaaaatgtagctgatgtggtcttttgaaggagaagaggtaaaaaataatcagttcaaaaaattatactaaagaggccgggcgcggtggctcacgcctgtaatcccagcacttcgggaggccatggcgggcggatcatgaggtcaggagatcgagaccaacctggctaacacggtgaaaccccgtctctactaaaaatacagaaaaattagccgggcgtggtggcaggcgcctgtagtcccagctactcaggaggctgaggcagtagaatggcgtaaacccaggaggcggaggttgcagtgagccgagatcgcgccactgcactccagcctgggcgatacagcgagactccgtctcaaaaaaaaaaaaaaaattatgctaaagagtaaactcaaagaaagtagaggaaaagaatgaattaaaaatctgtgtttataaataaaaataaaagtaacggagcaaaaagacgggcattagaaaatagtcatttctgacctctggtcagataaagggaaaaaagcaaaaaattagctatgttaggaatataaatggggacaacactacagataaaatagttttagaagactaaaatttattatatgtatacaagggaatagtatactatttaaaaagaattagataaacatgtaccaaacaagcctcaaaaaatacaactggcagaaatattcctagaaggaatcctttagtcaatatgcacaaagcatttaagcatttcattatttttgtttttttttttttttgcttttgtttttgtttttttgagacagagtcttgctctgttgcccagactggagtgcagtggtgcaattttggctcacagcaaactccgcctcccaggttcaagtgattctcctgcgtcagcctcccaagtaactgggattacaggtgcacaccaccaagcccggctaatttttgtatttttagtagagacggagtttctctatgctggccaggctggtctctaactcctgacctcaagtgatttgaccgcctcagtttctcaaagtgctgggattacaggtgtgagccactgcacccagccttcattgtacgtctttttgtcactagaggtacattttgttctaacaactaagaccccaaagcatccttttaagctttatcgttttgtaaaatggttaaaaataacattttccaccaatgacacagataaaattttaaaatgtggtggtattattccattcttattttaaggatatacatatatgcaatttgtatgtggatatgattttttgaatggtgaacagaaacttagtggtcaggtagctggatgcggtggctcatgcctgtaatcccagcactttgggaggctaaggcgggtggatcacctgagttcaggagtttgaggccaacctggccaatatggtgaaacccagtctctactaaaaatacaaaaaattagccaggcgcggtggtaggcgcctgtaatcccaagtactcgggaggctgaggcaggagaatcgcttgaacccaggagacggaggttgctgtgagccgagtccgcgccattgcactccagcctgggcaacaagagtgaaactccgcctcaggaaaaaaaagaaagaaagaaaataagaaagacagagagagagagagaggaaggaaggaagagaggaaggaaggaaggaagagagggagggaggaaggaaggaaggaaggaaggaaggaaggaaggaaggaaggaaggaggggaaacttagtggtcagatggcaactaggggaggggaggcagaaggtaatttatttttcatttcatatccttcaactatcagaaattttgtcatatgtgtttatattttccactgtgtttcattgattctaaaatgccttttcttcataaccctgaaattggagtgtttcttacaatcattggtatgtcacatttttttctggcttgtggtaatgggttaaaatgataaattgtaaaatcaatgacgtcttaggaataatgaaaaatagtttaatagtgaatgaagaactatgtaattttaactgttcacatttactcttgggtatgtttccagaggataactgaacggggatagattttaaaaagctttatttaactgggtacttccgcaatttagtgatcaacttctgtgtacaacaaggtactgtcctttgaggatgatgggagaatacagggaagaacgaaatcgcctctgatcgtactttctccacggatgtaagtgtccgggctctagtgggggaatgatactcttcgtgcgaaattcacttttaaaaaaggcttagaaaactgaccaccggctctcagctgcagcttatcaaccacagaactccgaatatgcccgcacatcagtgcgctgggttaagaggagaaggggctgcggctgagctttcctagaaacagctatttggggacccatttcctgttggagtctgaaaggcgcacgcaccagagccagtggcaaagcaacttaagctgcaggctcctcctgcccacccccagccgcgacgcccctgggggcccttagcagactgccaagcgagtgtccccgccctgtgccttgaatttagccaaactcctttaatatcaggcctggcgcggtgattcacgcctgtaatccccgcactttaggaggctgaggcaggaggatcgcttgaggccagcagtgaaattagccggacatggtggcgcgcgcctttctgtggtcccaggtaatccggaggctggggcgaaagggtggcctgagccagggagatcgaggctgcagtgagccgtgttggcgccactgcactccagcctgggcgacagggcaagaccctgcctcaaaaacaaaacaaactgtaatatcgttcaagaacgtgtgaaggacacttggaaagttaccaggccatttctctcctgggcgcccgcggccctagaacgccggcctcaccggcagacgcgcgccctcctcccagatgcgcaggtgaccccggcgggcggcgcgggaaagggaagagctccgcgaggccgcgcgggggggaagcgggagaagccgctcttcctattccactcgcagtctgcgtgtgggggaaacgagtgcccggcgtatgaaacgcctaacttcgcgaaataaagagagacgtataaaagttcaagaattctgtccagactcaagggccctttctcatttaggggcaaccctgtcactacatcataaacttttaaatccgtgatccccacgttacaaaagcagaagtcccttttagacttttagcgaaaactgaactttgccggtgtcccacacggagggagggaggacgggaggccacgccagggctgcggggctgcagggcgtggacgcatcctggccggggcgtccactgtcgacgtctccacatcccaggagggtcgagacggccgcgggaagcagcctgcgagccgtgcggccccattccaaggaccccgccagtgtgagtcactgacagcttcgcgaatcaacggtgcccagaggaaaaaacttctcatttggacttctaggcccggcagtggccggcggccagggccccccagtagggcagggcggggcggggcggggcgcacagagccagaggggcttgcgagcggcggctgagggaccgcggggagggggcgccgagcggctccagcgcagagactctcactgcacgccggagggcgcccttcctcgctcgcgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccaggtgagagatgcacgggaatggggtgcgcgggcggagggacgccgaggggagactgcgggggtcactgttgcgccttctcctcacccctgcctcagtttcctccgaaagccaaactggcatttgggctgagatctggagttttttccagtcacgtttaggtggggcgtgccacccccttcgcgggcccagccgatgcccctttggactcgatcttggagggtgcagcccgcctgccacggggtgttggatatggaggaggatggagcggaagccccctgggggagcctgcagtcctgcgttgcacttgtcattgtgtttctcccaggaccacccccaaaaagaaaagctctcacgttgctccaccaataaacgtttcgatctttaaaatataaagtggcgaaccgctgccgctgaagttttgctttgttggaagtttttttcttgcacattttacaggcgagaaaagtgatgtagagaaaagcccaggcagtcccttggcatgtttagcagagaatcagtaccagcagcccccggcccggccttgtgtccaggaggtgcgcagggtgcgagatatatggtgacaatagcagaggctccgcgtggtggcgggggaggggacatgaagaggattttgttgttacctagaacccattccttctaagtgagttgaagagagagatccctccccaggatcgggctccctcgaacactgtgggatcccagtatttcttaacgagatttctgatccactgcaagaaggttgctcccctagaatattttccccactagtagtctatttttaagtatctggccacttgaccaaataaataaatttgattaatttatttggtcaaatattttctgtatccctttccccaagagcagcacagatgagttgtttttagcctgtaaaggcgctaattagaaagtgagaaaagtgtttttgaatttcctaataacaatagtattttataagctttgagccattttttttacgctgaaagaagttctagcgggttttcttgttatcgctaaaagaatgtgcactctatattgctcccacactcaaaaaaaagtgtagacacatcaagattaagaggtgacaaagacatagcatgttctcgcctctctgtctttgttcagggtgagttttgagatgcttttgggaaaactaagagctccagactggggcccagtgtttagcagtaactagcctgcctgcagataagtgagcattgttgccgaaagtgtttgagagaacaccgagaactcctgaaaaattgtttgcgatgagatatgatttcacataccattatgtaatttgcacaatgtagtttgaggacacgctcttgagaatccagtgttttgtttgagatttggatcatggggtggagaacagagcttatagaaatgctgcaccctttctcacagtggcctcccagcaaggtgtgtagcctcattagggagtgaagtcaaagcgtactggtttctgccaagcttcttacatcctcatggcaggagtggtgcatgttaatatggacagtgctggtgtagacagaaaggcaggtggatgaacttggctagtttatcaacactggattctggaaccactttgggagggaaagaagaaaggagtatgatagaggaaaaggagcgcttgctaagtgccatattccatgtcaagccctgggccagaaggaattttcacttggattgtctcatttcaccttgtcaaaacaccttgttaaggtgggtatttatccccttttgctgattctgaaactaagacccagagacagcggctaagcaagtggtggcgggtggggcagggaaggggcagtccacccaccctgggtgcaagcaattaggaataagtggggctttgtctttagaaaatttaaaatcactaataaaatcaacccaagataggtttactttctattaccaccatgcattgacaattctaagcattgtctgtcataaggtagtggtgctgggactctgaggcatccaacagtgcctcccatccttgaaccgccaccgctgtgatagagtttattgtccaggattaccagctctgtgtgccaagaggggcggtaaagccctcccagggctggccctgaccaccaagctgagccttcctccagcacttcccgactttttgttcccactcattttggcatttcctgccttgtcactttgtgtgtgtgtctcattctcccaactaagattataaagttttatttatccccatggtgactaaaacaaatgttcactcagcagatagttgttgagaaatgtgtaaattcatcaaccagtttacattcgtctagacaatttaagtgagatgatatgtgatcattaaaagggccaacatccaagagtaaaaggtgatgtttataaattttatggggctctagagggttaaagtgttcaagaatagctggtggtgactatgacagagagaacttggtgggcaattccacttgctaccctcctactcacagagtcaagcccaattctctggcatggaatgaagtgctcctccccttgcaggagggtccccagcccctctccagccatctcctattactcaccctccagttcacccagccccatcctctagatcctcccttcaaggagctatgctttctctggcttctgtccgcatgccactccctctggccagaatgccctccccatatcccatacccgccacgttcatgtttaattaaaaacagctaccctctgtggagtactgactacagctgacatccttcttagggacgttacaatactatcttatttatttctcacaacagccctttgagtagatgtcatcctcattttactggttataaaacagagacccagaatggttaagtcacaagttgagaaagaggtggaattgggactgggtgcggtggctcatgcctgtaatcccagcactttgggaggccaaagcagggggatcacttgaggccaggagtttgagaccagcctgaccaacatggtgaaaccctgtctctactaaaaatacaaaattagctgggtatggtggtgcacacctgtagtcacagctacttgggaggctgaggcaccagaattgcctgaacctggaaggcagaggttgcagggaactgagattgtgccactgcactccagtctgagcaacagagtgagactctctctcaaaaaaaaaaagaggtggaattgggagttgaccacaggcctgtctctccgaagtgcaggctttctctaacaccccctatagaaaggaagccatctagactcccagcacctcttacagtagagaagtaaccccactgtgctccctagtacagtatggatttacctatttttgataattcatcaaaatatagaagcaaagtctgtgccctatcgccttggtagctcaggcccagcacagggaggtatttagtgagcatttatgcacggactgtggtattctctcatttactttcgctaacagatgataaggcaggctctgaaaagatccctgctcatgaatacactaattaatcagatgttacaagagatattgctagtaaacctaaacagaaagacagaaaactgagcagtggttctaccgtaagcagaccagaaagctctataaagcctgaaagtcagatttcttatgagtcagcaagtaattttctgccctactatctatctatctatctatatctaataatttttagtggctttgcctttatttttatagaacataccagcatagcaggttctcagggtctgggtgcagtggctcacacctgtaatcccagcactttgggaaccctaggccagatgatcgcttgagaccagcctaggcaacatagtaagaccccatctctattaaaaaaaataattaaaaagtagccaggcactgtggtgtgcacctgtagtcccagcacttgggagactgggaggatggcctgacccaggagttcaaggtggcagtgagccatggtcacgtgactacactccagcctgggcaacagagtgggagagacgctgtcttcaaaatatttaataaatgaaaattttaaatttaaattaatcatttaaatttaaaaaataaaataataaaattgaggtagaattcacataacataaaattaaccattttaaagtatacaattcattggtatttagtacatttacagtgtacaatgtacactgtaaacccctacctacttccaaaatcctgtcatttccccgaaaggaaaccagtaagcagtcagatcccattctcccttcccctacccccaggaaccaccagtttgccttttttctctatggatttacctatttttgatatttcatatcaatagaatcatataatatgtggtcttagtgtctggggaacttaactttaggtgggttaaagttgttgttgctgtttttttgagacagggtctaggtgtcttactcaggctggagtgcagaggcacaaatttggctcactgcaacctctgcctcccaggctcaagctatcctcctaactcagcctccagagtagctgggctacaggcacctgccaccacgcctggctaatttttgtatttttagtagagacgaggttttatcacactgcccaggctgttctcaaactcctgggatcaagcgatccacctaccttggcctcccaaagtgctggaattctaggcgtgagccaccatgcccagtctttaactagttttcgtgagcacctaggctccccttccattgcggatactcacaaaaacatccttgttagaagagttattaggactcagggccttggtttatttttgactatgatactagtgttgaggactccatagttttaccattcataattttctgtttgtttccttttttgcgatttctttcattctgcctttttctttctcttgcttgtgcctaaaactgtcgtcataaatagctctgtctatatactgagaatttttttctgggcatgagctttcacttccccagataccgtctcccacactgaccttgtcgtggtacttggaggaagccacttaaagggccctgacggtcctatatacattatttgctttcaaaagtaagtggccttttgaaacaacaggagtaatctgcaatttgcccttgaaaacacatttatataactttaggaaaagacattatgtaatctatttatatttcaagtctatgatgaattaaaaatcaggtattatggtattgtagaatagtgtttaccagtacagtattttcctctttcgtaaccaacagtaagaactgtagaaacaacacttcacattctgatatggtagggatgtgtgttttcaataaatatgtgtggacaatcatagtatatatgtaaacatgaaacaaaagttttaccaaacagtgctcacctttactgcattgtatgcattttgatattttccacaaacagtgctcacctttactgcattgtatgcattttgatattttccacactatattctatttttaatgcttattgcaatcttgtgaattgatttcatagccattgctaaatctataacataatttaaaacatattgcagcagctacatgaatattcctatggtagccaaatcaaaggccttattagcttttcaggaagagttctgttttcctggaactgttgtttattattgttcttatcatgtctagaacctaatttatttgagttcagatatacagactgcagaaggacttgggcagggttgggcatggggacagtttttatagtacaactcacagtattttgtacaatacaaagctgtccccatccccagccctggggaggaattggtgatcattgacatccttgactgtgaattagttttcattttagctagatgtcttgttggagagtagagatcagcattcccaagacagagagctcaggacctgtaacttttcttggagaacagacctggagaaatggggaaagccggggaacctgagtagttcccgggcaaggcctgctagcatcctcaccccacgtcaggctctggcctccaggctgctccaagcaagagcccacacactttccttatgtagtcttcatgcctgctgtggcgttgggtacacctgcgtttactttcctgcaacttcccttctcccagcttcctcttaggcttgctttcctatgcttccagaggagtacctgctccaggacatggaatgggaggagaggaggcctctgatattggcagcttcttctgaaccccagtcagtcaagaattctacctttaggttgggcacggtggctcatgcctgtaatcccagcactttgggaggctgaggcgcagatcacttaaggtcaggagttggagaccagcttggccaacatggtgaaaccctgtctctactaaaaatacaaaaattagccgggcatggtggtgcacaactgtcatcccagctactcaggaggctgaggcaggagaatctcttgaacccaggaggcagaggttgcagcaagccaagatcgtgccactgcactccagcctgggagacagagtgagactctgtatcaaaaaaaaaaaaaaagaattttgtctttaattctgctttttctgtagcagagatttttgttcacttactgctcttgcatctgctccatctagaacagtgttttaaagatgtatttttctgttttgtccttgaatatctccctgctatctctctcctgtgtgtaaggaccaagttgttggcatgtgtggttggtgtgcagccaaagtcagtaggactccagaattcccaagctttgggcatcatcacgttaagctagccattcacatgtccacatactgcctactgtagctaaaaggatgggcagattcatttgtttggtgacatgcaaagagaaaaagatggtactcttttagaagtaggtcatgaatcacaagtttttaaggagagaatagcgtggagtggtcaaaaggtatgacctttggagctgggcagacctaggttcaaaccctggctcctctacttcatagctgtgtgactttggattagttacttagcctctctgtgcctccatgttgtcatttataaaatggtagttataatgctcatgtcatagaaatgttagaattatatgaactaaggcaagtgaagtatctggcacatagtaggtgctcaaaaagatggtaaggttttttcatacaccaatgcttccatattccagaaaagcttttgaagagttgataccaaataaattatctaaatataagacaatcttcacacaagcatgcaagaacattttccccttcagaactaggacaaaagaaaaaagcaaaaacccttgcccttaacttctagtggcaaataaacatgcatacagtatttgtttgtttttttaacttttattatgggatttttcaaacatacccaaaaatgaacagtatagttactccccatacccatcatccagcttcaacattatttacatgtcaccaatcttgttttatctaaaccctcaagtttcctcctctcccaactgtataattttaaagcaaatcccagatatcatattatgtcattcataaaaacatcagtaagcatccttagagattagaactcttttttccacataaccacaatacaattataatacctaaaaaatgaacatttccttctgtttttttgtttgtttgtttgttttgagacacattcttactctgttgctaaggctggagttcagtagcacaatcatggctcatccacagtctcaacctcctgggctcaagcaatcctcctgcctcagactccaaagtagctgggactacaggcacacaccaccacgaccagctaatttttgtatttattttaatagacataggattttgctgcattgcccaggctggtctggaactcctgggttcaatcagtcctcctgcctcggcttcccgaagtgctggcattacaggcgtgagccaccgtgcccggcctaacaattccttaatatcatctgataatcagtcagtgttcatatttaccttattgtctcataaataccttttaacagttggtttgtttgaatcaggttcaaacaaggtccaccattacattttaatctgtaactgcccccccaccccttttttattgctatttatttgtcaaagaaactaagccatctgtcttagttcttatttgtcaaagaaactaagccatctgtcttttctacatactggatctggctgactgcgtcttcaactcatggatcttaacatgtatgaaatgtttcaattcatttccatcattattcttttgatggtcaaattggtgatcaacatgtcacatctttggtcagtgggagccctttgagattgactccagcgtctttttgacctaaccctgatattctttgaagatgttcaatgttcatcttgtgtatttcctaccccagatctggaactagtcatttctttaagaagccccagttcttttcattggaaaatggtgtttgtttgaatctgagggagtaaaacattccagtaatgctggtgttttccacttgacagagttagtgtgattctgttattttcctgtcctcctcttcatttctctttagcctgtagtgttgtttcaactcttgtgctctgtgtgggaatgtgagcaaagtcctgggacttctgctttgttaactctgaaaaagcatgagccccgaagggcagaactgtgagtcaaaaccatgtgtgtcatggaatgctggtgtggtataaatcccaggatcaaatgcgacattcagagatcctctagtcacccctctgcttccaggacagatctcatcacagtcagaaaacgtgttgcctaactcactaatttttaaaaatcgccacagttaaagagtccgtatttaaactatttaataatttgctgtattcgataacaaaactactctagagcaatttagaagagcctaaattaagtgaaacttagcaaatcgtatgagaactgaattcaggacctctgctgccttttttgtgaaaccatagcttaaccaaaaaaaaaaacagagatgaatgataagagatttgggcaccttcacaagcactttctccttgacctgagttgtgctaggactggaggaaaagcgagatacttaaactcaaatttcagcctaagggtcttgagctagttggaattgtctagtcaccttgcattggttttgtcctttctttgatgctggtatatactacattttttcttttctttttttttccgacattctttaatttcacaaaaaccagaatatcaaacccatagtatcaagaaaaggtaacaccttaggcagcgatatttaaccaagggattatacattcttcctgagctctagcctataaaaatttcatgtttccacaagtataatgttcctgtcggaagtaccgtctgcctgaggcctacccagagaagatgttttttaaaacaagtacttactgcctaagtactaaatacagagtaaagtctagtgacagttttattttcagactaagtgatagtatctgaagagcttagttgtatttattagttttcacattgtgtcagtctctcaggtgtcatcttgattcatgtatgtaagtatgcatgttcatgtccactttttcccctctgtgcatcacaaaagcccataatctggccaggcttccaaaactgcagaggagaattgcattattttaaggttccttggccaggtgcagtggcttatgcctgtaatcccagcactttgggaggctgaggtgggtggatcacttgaggccaggagcatgagactagctggcaagcatggtgaaaccccatctctactaaaaatacaaaaattagctgggcagccgggcgcggtggctcacacctgtaatcctagcactttgggaggccgaggtgggtggatcacgaggtcagaagatagagaccatcctggctaacacggtgaaaccccatttcttctaaaaatacaaaaaattagccgggcgcggtggcaggcacctgtagtcccagctactagggaggctgaggcaagagaatggcgtgaacccgggaggtggagttagcagtgagccgagatagagatagcgccactgcagtccggcctgggcgaaagagcgagactctgtctcaaaaaaaaaaaaaaattagctgggcatggcggtgcgtgcttgtaatcccagctacttgggaggctgaggcaggaggattgcttgaactggggaggcagaggttgcagtgagccaaaatcgcaccactgctctccagcttgggtgacagagcaagactccatctcaaaaaaaaattggttcctctagatcagcatttttgcatatgcatgtttttgtgatattaaagtgccagaaccacaaacaaaaaaaattaaaaataaaaaaaaatgtttaagtgccagaagccattcattcttttctttcagcacccacacactcattgtgatcttgagaacagcctcacatccacagggtctgttggtaccaaggtcaggcttctgtgtgactggggcaaggtgaacacagagtaagttacatgcattgcaaaggtaagagagtgatacttccagaaaagattgtgaattcaaaatttgatttatagctctgaaccctagagctatataatatacaacttgttcattccctcattgtactaaaaaactataaacattgctaagtaggagggaagatgaacctagatttccttttaacttaattaagtgagcaaacaattgggtataaaagcacactacatggaagtgggagaggaaggataatagtaatttcttaaactgcttaatcgttatggtttccaaagtgaatgtatgtcctgtttcacacgggatgctccagttgccagatttgtaggccagacaggaattagaattccattttaatgattctgagcttaattcagagaagttaagtgatccctgaacagagtcaatattagaatacaaatatgtgcctaccacatgcagggcacagggtactggaggttcagagattaacaggaacagttcttacccttaaggatcaatgtagacacaagtgtgtattcacattcatcactggagacattcattccttccctgtgacagatctcctgccaggccaccccttcattgtctggagaccctctcccaactttgcttaggtagcttgacctcaaccctacactaccaggctctgctctgctgtctctgagttggtactactctagctttgctcttcattttggaaatagatgccaacatattgtattttattttctatttctagaatttccacttggtagttctttgctgatatttcctattttcagttcatttctataaaatatttttctttttttttttttttgcacatggttgtaatacattcttcaaaatccttatctgctaattccaacatctgggtcaacttgaggttggtttccgctcactgtctttttacttaagactgggtcacttttttttttttttttttagagacagagtctcactctgttgcccaggctggagtacaatggtgtgatgatacctcactgtagcctcgatctcccaggctcaacttgtcctcccacctgggcttcccaaagtgttgagattacaggtgtgagccaccacacctggcagccccctttttcttttatttgacaaaaaattatatatatttatagtgtataacataatgttttgaaatatgcataacttgtgagatggctaaatcaaacttataacatgtattacctcaaatacttatcattttttgtggtgagaccacttaaagtctactctcttagcaattgtcaagtatacaacacattgttattaactatagtcaccgtattatacaagagatttttctaactaattccttttaacagaaattttgtaccctttgaccaatgtctccccagtctaccctacccacccatccaaccccagcctctactaaccaccattctcttctctgcttccatgagttcaactgttttcgattccacatataagtgaaatcatgctatatttgtctttcggtgcctgccatatttcacttaacattatgccctctcggctcatccatgttgttgcaaatgacagaatttccttcttttttaaggctgaatagtattccactgtgtatatacatcatattttttattcattcattcattcatcagtggatacctagtttgattccataactgggctattataaataattctgcaatgaacatgagattgcagctattgacatcctggtctttttttttttttttttttttttgagatggggtctcgctctgtcggccaggctggagtgcaatggcgcaatctcagctcactgcaacctccgcctcctgcgttcaagcaattctcctgcctcagcctcccgaggagctgggattataggtatgcgctaccaagcctggctaatttttgtaattttagtagagacagggttttgccatgttggccaggctggtctcaaactcctgacctcaggtgatccacccaccttggcctcccaaagtgctgggattacaggcgtgagccaccgtgcccagccagcatcctaattttatttcctttggatgtatgcccagcagtggaattgctgtattatataatagttctatttttagttttagaggaaccttcatactgtttttcgtaatggctatgccaatttaaattcccaccatcagtatagatgggcttcctttccccgtatcctcaccaacacttgttatctgtcatctttttgataatatccattctaacaggtatgaagtgataactcattgtggttttaatgttcatttccctgattagtgatgttgagcattttttcatatacttgttggccatttgtatgtcttcttttgaaaaatgtctattcagatcctttgtccatttttaaatcaggtgatttgttatcttgctgttgagttataggagttccttatatattttggatattaaccctttatcagacgtatggtttgcaaatatttgctttcatttcataaattttctcttcactgttgattgtttcctttgctgtgcagaagctttttactttgatacagtcccagttgtctacttctccttttattgcctgtgcttttatggtcattataaaaaattactgcccagacaatgtcatgaagcttttcctctatgttttctgctagtagttttacagtttcaggtcttatgtgtaaaccattaatccatttaagttggttgttgtatatagtgtgagagaagggggacaagacgtccagagtttatcacttttgtgtatattggttggatctggtgataacgatttggctctatgtccccacccaaatctcaacttgtagctcccataattcccatgtgttgtaggagggacccagtaggagatgattgaatcatggagacgggtctttcctgtgttgttgtcatgatagtaaaatgggtctctcaagatcagatggttttaaaaacaggagtttccctgcacaagctctctctttgcccgctgccatccaagtaagatgtgacttgctcctccttaccttctgctatgattatgaggcctccccagccatgtggaactgtaagtccaataaaccattttcttgtataaattacaggaaaaaagactctggattttgttatattccttcaaagagtgttggtgtttttgctttagcagccaattaatttggttttactcaagcagcagactctttctctcttgagcagaagcttaaatatcacttcagttcttttatctttagcagaggtgcttctcatctttcctacaaatgcatagttcaagggtcagccaaaccctaggacagaagttatactgaaatttagggctccccctctctgactttttcctttccaggattctctcctaactttccagtgactgtgattgccctgaactctgtcctctggttctgtaggccaaaaagactacggattttctatctgggttttagtcaccttttatgttatataggcactgctgttatataggaaaaaccaaactattttccccaaactgttttctcttacccagcacttcactcaatccttctgacaccgtatgtctggagcttgtttctccacataccaagcaaccaattctcctgcagattctccagtggacaccagctgggtatccttgaatataattcaattctggacactatctacctctaatataactcaattctgacactatctatctacctggagatagagtcagattccacagattaagggctcagtttcacaacgctgccttccacttcaaatggcagtcataagtctgggcctccagacttctgaccacactatacattgggagttcctaaggccccctgctcagattcgattaatttgctagcatgattcacagaactcagggaaccactttacttacttttatccattcgttataaagaaaattacagaggatacagatgaacagccacatggtagagatgcatagggcagcgattgtgggaaggagcacagagtttccatgccctctcttgggcactaccttccaggaacctccatgtgttcacctatttttggttgatactccaaaaaccttggttggtctggcatgagtggccaagaacatcggctgctctgctgacctgctcaggaaagaagtagaagaatgactgagatgatgggtaccttgtgactatgttaggagataaccccagggattgtggtttggacccagatatagtgagagatttctacattctcctgtgtaagcaaactaaagactgtagaggaaaactactgtcatggacattggccgtagaattgggagtcctgaatcccattattaatttgcctctaactccaaaacctttaagaaatcccctctggtggcacgtgcctgtaatcccagctactcacgaggctgaggcaggagaattccttgaaccccggaggcggaggttgcggtgagccgagatcgcgccactgtgctccagcctgggcaacagagtgagactgtgtctcagaaaaaaaaagaaagaaaaagaaatcccctctactttttttttttttttaatttctatttatttttattttttgagacggagtctcactctgtcgcccaggttggagtgcagtggtgtgatcttggctcactgcaacctctgctgcccaggttcaagcgattcttctgcctcaggctcccaagtagctgggattacaggtgcatgccaccgcacctggctaatttttgtgtttttagtagagatggggtttcaccatcttggccaggctagtcttgaactcctgaccttgtgatccacccacctcggactcccaaagtgctgggattacagacgtgacccactgtgcccagcctaaatcccctcaactttctatgtggatttttccattgaaaagggacaggtttcatgggatgactgcagactaaatggagaaagtgtgcacatgaaggtatgcggaggaaagagaagtcatggaagctgggagtgatttgtttatatagacagtggctagcgtggaaatcaatgattgatccctttatgtcaagtactcagcctttcctaatgtcttcagggtagatctctgaaaacctatcattcacctttgtccctttgaggggcagagtttaggaagtattgcttatatcaagacaaatgtttcacagtattttgagttggcttattctctaataaagtctatttgtgcattatctgctctttaccacccactctcctagtaagaaaacataaacaaaagtaaaatatgctctctgcttgtcgcttttgccttgttgatgcgttcactttttacatttaaaatttttttaattttatttttcagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcattttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagtattatatctttctggtcctggcacactttaagggtttaactgaagagcatttaatgaagaggtgatttacaaaggtgtagacagggttaagggaaccaacggggactggtgaagcaccccccagagactagcaatcaggggaagccattactgccaaggcccaggtacaggagggaacacactgacgcctctccctcaccctctgatctcttgggaggcctccccttgatcctaatcttaacccaatacccagagtgaagtagtccataaagatcagcttcctttgccgtggagaagggatctggaagaacaaatgcaaggaaaaaataaaacaaacagcaccatttctgccaaagacattgagtgattagctctctctctctctctcaatcccttcttaagaaaatttaagcttattgagaatatattcaaatttctgagttatagacatcatgggtagtgtctgcagttcttccctagtgagagagaaattaaatgtcagagcagaaaggaaatccgtaaaatggctgtgctgtcttctctggctgaatgacagtcctttgctgtctagcactccctcaggcagaagggaggaggggaaatttaaagcaaaatgactagtacttctcaaggttgaaaataaaaaaatttttgataaattatttctagagtcatagtcaatgaaaaaattatttcaactaaacaaggattttgttaacatacagaatttttataagttaacacacaagctttttaagtttctaaggcctggacttttcacgtgtgtttcaaggaatagattgagttcaaaaaaccttaaattttgctaacacaaaaattttttttgtccaggcatggtggctcacgcctataatgccaacactttgggagactgaggccagaggatcatttcagaccaggaggttgagaccagcctgagcaacatagtgagacgccatctcaattaaaaaataaataaataattaacctggcacgatggcatgcctgtggtcccagctactcaggaggctgaggtgggaggatcgtctgagcccaagaggttgaggctgcagcgagccatgattgcaccactgcagtccagcctgggcaacagagtgagaccatgtatccaaaaaaaaaaaatgttttttccaccaagctaaaaatagcatttttaaggaaatggaatgcttggctattgaatatacacttggaaaattttaggttatacttctgaatttaagaaattttaaaaactgtttgccgttggcatgtctttgaggaagttgagctacagaagcaagtggaaaaggttaagcagcattgatgaccaagctatttaagtttctggggcctggaccatccattagcagcttatcttcagccaggtgctgtcgtgaaaattaaggggaaaaacagttcaccaatggtaatttcctggcataattagcctgttatgtggctatgccttttgaaactactagaccaaatgtgtgtgaagagtaattgaccacaggataaacctaattgtgttttgtgaaggaggtgtggttaagtgagctgcaatgtgagaagagaggagaaattctctaatgcaattattctcagagttcctgagactctcaggagatctgcaaggtcaaactctcttcaaataccaagatattatttgccttttttggtctgtttctctcataagtggacagatgagttttccagaagctacacaacatgtgaaagtgcaacagattgaatgcagaagcagagacgaaaatctgactgtctcctattacaccagtcattaaagagattgcaaaaatgtaaaacaatgcaactctcctccttaaattattgttttgggaaaaaattttgaaaaatatagtatttattttaacatgtaatgggcttattgtcatttttagctgaaatagatattttcaaaagttctccattttaatgtctaatatggaaaatatcagtagataaaatcattggcagcagggtgcagtagctcacacctgtaataccaacactttgggaggccaagccaggcggatcacgaggccaggagttcgagaccagcctgggcaacataggtaaaccccatctctactaaaaataaaaaacttagctgggtgtggtggtgcacatctgtaatcccagctacttgggaggctgaggcacgagaatcacttgagcctgggaggcgagggttacagtgagtcaagatggcatcactgcactccagcctggacgacagagcagagcaaggctgtctcaaaaaatgaaaaagaaaaaaagtcagtgatgtgctgctaagcaggatctccacaaaaagaaaaaaagcctgatctggcaaactagcatttgccaattttgatggtgtgaatactcccttcttttccagtttcaagctcccaactgtttaacagttggcttgacaaatttcctgaatattgaattcttgtgagcaggtacaagttgactccagcacaccaatggatgcaacccacataaacaaaggctctttgctggtcctcaataattttaagtgtattaaggtgttctgagcaaaagaagtttgaaaaccactgcccttatccaagatgtcccaactttattgacttgaagaaaacagataaactggtaattattataaaagcataaaagcaaacaggggtaaagagttggcttagagctgcaggcaccactctgggtttctggctgtttcagagctgaggggttccaagtcttggagcaagaaactgattcaacatccaggctcagtggctcacgcctattatcccagcactttggaaggctaaggcggatgaatggtttgagcccaggagttcgagaccagcctaggcaaaatggcaaaaccccgtctctacgaaaaatacaaaaattagccgagcgtgatggctcatgcctgtagttccagctacttgggaggctaaggtgggaggatggcttgagcctgggaggcggaggttgcaatgagccaagatggtgccactacacttcagcctgggtgacagagtgagaccctgtcacaaaaagaaaagaaaagatactgattcacgtcatcaggtatggtgtggtccacagaacaggaagctctgtgtgaggtctgattttcagccagctgctgtgtaaaggaaagagagaggtgcttgctgagcaaagtttcagaccagaagaccaagagacaattcagaacagcagcagattctacccatggtggcattcctgtaaagtgaaactcaagcgccaagtttgttgtcatggggactgttgattgcatgctagtcttatggaaacacacggaaaaccagaggtcaaattcagtagcatctcagaattcagataacacagcatgtacagtttcaacccagcaggctgtgtgtttatcacttcaggaaatgactcataagcagtaaggagatgagctttgaaagctgcatctggccagggcacggtggctcaccgctgtaatcccagcactttagtgaggccgaggcgggtggatcacctgaggtcgggagtttgagaccagcctggccaacatgtgaaaccctgtctctactaaaaatacaaaaattagccagatgtggtggcacacacctgtaatcccagctactcaggaggctgaggcaggagaattgcttgaacccaggaggcagaggttgcagtgagccgagattgtgccatccagcctggatgacaagagcgaaactccatctcaaaaaaaaaaaaaagaaaagaaagctgcatctatagtagcctgcatggtggcagggccagtctggctgttttgcctatcttaatgactacatctgcaggtcattttggtgtgctgctatgcgacccatccaaggaagtgaaaacaccacgaagggtgggctgtccaatactgagatgcattcgtgagcaaaaccataatcatttgatatctatttttgttgttttgtttcctatcctgggatatctagttgctcttgaaactagctgacacatattttaaaaaaaacaagacaaataatatattcccatcctccagaagctaactggctttgggatttaatcctaatacttaatgtttagttaggaagcacaaaatttgaagacctcagatttagaattttatcagctctgccttgtaacaagttttagaaactaaatcagttggccaggcctggtggctcatgcctgtaatcctagctttttgggaagccaaggcgggcggatcacctgaggtcagcagttcgagaccaggctggccaacatggtgaaaccctgtctctactaaaaatacaaaaattagtcagacatggtggcacgtgcctgtaatccagctacccgggtggctgaggcaggagaattgctggaacccgggaggcagacgctgcactgagccgagatggcaccactgcactccagcctgggcaacagaacgagactctgtctcaaaaaaaaaaaaaaaagaaaagaaagaaagaaaagaaaagaaactaaatcagttctcaactctggttgcgcatagaatcactggagagcttctaaacaattccagtgccaatctctgggggcgaggcctggacattgatattgttttcaagctcctcagaagattctgatgtgtaaaccagggttgatactaagaaaagaaaaatccctcagcagtctgagctatgtgaggtgtgcaaaatttattaggcccagagagacgggagtagaggacttcagtcacacccccggcacataccctccccctacccaccaccccccatgcctgtgggcaattatttaaagtcattttgttcctggtggtgtggtagctcatgcctgtcatcccaacactttgggaggccgaggcgagaggatcccttgaggtcaggagtttgagaccagactggtcaacatggtggaacccctacactcctaaaaatacaaaaattagccaggcatggcagcatgctcatgaaatcccagctactcggggggctgaggcaggagaattgtttgaacccaggaggccagaaggtagaggttgcagtgagtcaagatggcgccactccagcctgggcaacggagagagactccatctcaaaaaaaaaaaaggcattttgttcctgactagctacattccctgttatcttcatgttcctggaatctgtgatacaaagaacaatgtgtatccaatcaacagcttatgttattttaatgtaaattttgataaacaacttaggaactgcctcttttcctttataaacattcacatgcaactgctgctaatcagattgtatattcaggacaacttgaatatacacttcaatatacactgggttgcagtcctcaagcttggcccaaataaactctctacttatattaattttgactcagcttcttccttttagatcaacaataccactgtttttgaaaagtgcttcttagcttatatactgctggtgggaatgtaaagtattagttcagccattgtggaaagcagtgtggtgatttctcaaataatttaaaacagaattatcattcaacccagcagtcccattattgggtatatacccaaaggaatagaaatcattctaccataaagacatctgcgcacaggtgttcactgcagcactattcacaatagcaaagctatggaatcaacctaaatgcccaccaatgatagactggataaagaaaatgtggtacatataccccatggaatacgatgcagccgtaaaaaagaacaagatcacgttctttgcagcaacatggatagagctggaggccattatcctaagccaactaatgcagaaacagaaaaccaaataccacatgttctcacttataagtgaaactaaacattgagtacacatggacacaaagaggagaacaacagataccagggcctacttgagggtggagggatgagagggagaggactgaaaaaccacctatcgagtactatgcttactaccagggtgatgaaataatctgtacaccaaacccccaagacacacaatttacttatataacaaacctgcacatgtacccctgaacctaaagtaaaagttttttaaaaaagaaaagaaaatagtgtttcttggccaggtgcagtggctcacatctgtaatcccagcactttgggaggtgaagacaggaggattgcttgatgccaggagtttgagagtttgagaccagcctgagcaacatagcaagaccctgctaaaacaaatgtaagaattagctgggtgtggtggcacacgcctgtagtcccagctactcaggaggctgagacaggaggatcctttgagcctaggagttcaaagttacagtgagctgtgatctgtctgcttctcaaactttaacctgcatacaaattaccagagtctgctgcaactggtccgaggctgggtctgcctgtgtaacaacttcccaggtaaagttaaagttgctccttttggactatgctttgaatagcagtgctctcagagatagccccgaggcagaatttggctaggttgcaggtccagggatccagaaaatcaattctcatattcttaaaatcattttctgagacaatttttttttattctgagaaaattggggcaatttttaatgtagtggcagcatatgttcttaatcaaaatttgttgtaggtgatatctatcttgctgtatgcttcctctcctctttctcccttctttggttcttttctagggaaaaagatagcttaaatggctctaatcttatacataaaaccatttcagaagacactgggggtttaaagtggcaactcccattttttaaagatagtgcccggcagatagcggcagcgcctggttaccagaaagcaactgtggatatttttcctgtctctgggtctggctgaaaaatggtgacctcagggaagcactagggtgctacttagcattcaggagcttcagtcttgatggagctggaatgagaagttttgcaaacccaaaggcaaatgagtcagcccagggatcatcatcagaggatccatgattccactgtgcctggggaaaaccaaagattttgttaatcaactctgggaacacatttacagcacattcagtaaacttggagtaaattcgtcattatagaagccctcttacaagttgattgaaaaaactaaatgatgaaagaaaaactacaatttgttagccaacgtgggaaaaaatgttacatctcagcgataatccaatagctgcaatttaaaacaagataacaccggctcgtgtccaattaacaatgatctttttctatgatggctaaaacagctccctaataagtattacagaaggaatggaggaaataaggaaaataatataaataccagaaagggtaagataatgtcggtggacacactttaggaaagcaatttgacaaaatgtcatcatccttacatgttcataacctttgacccagttgtatgacttctgggaatctatcaagaaataattacaaataacatcaaaaaaagtaataggcttctggttgttaatagcagccttatttgcatgttagcagaagacaaaattcctctagatgtgtaattttaaaggacttctccagagactattataccctttaacaatgagacgttttaagtgtatgtaacgacacagagcagtgcttataatgtttaattttttaaaaaataagatgcaatgatatacaagcagtacaaaaccaacaagatggggaaaaatagatctaagtcaaggcaaagactaatgagaaatataccaagatgtttaaacttgcgttttggtaattgggtcattttttttcctttaaagtattttctacttctctctttcctgagtatgtactgcctctctagcaaaaaagcaacccacattaaaacaaaagtaaaataatctgaaaaaacaaacaaatctttctgaccatctcctagccacaattagtattttgtgcctcaatatattattcaagcaggaaataatggtgttaggaaatcatatgattctacatatagttgacatcttcaagattctcccaaaatatcttgtggaactctgaaattctcaaaaacataaaaatatctttagccatggccaggtgcagtatctgacacctgtaatcccagctacttaggaggctgaggcatgaaaatcgcttgaaccctggaggtggaggttgcagtgagcccagcctgggcaacagagcgagactctgtctcaaaaaaaaaaaaaaaaaaaaaaaaaaaaaagtcattagctatactctgaagccagaaatgtttctatttgtccccagcagctaccagaacattcagtacagcattctgtcatcataaccagagcacgactttttactctgatagtctttatacttgtgccaaaagggctattcatttgttttcttctggaattcatatttcctcatcaagcagcaaatattatttttgcaaaacaaaacaaaaactttgactgattttattgcatagttatgttagtcctcttattcttgaaattaatgaatgtgtgtaacccacattctattattcagtattttaaaaatctgattaattatcccataagctctttttaaaacatacttgagctttatttaatttctgcattctttgacccatgttgttggatccttaatttcacttattcattttcttacaattattaaatggtctcttacatggtgagactgaagctggtatccataggcttgttgcttctgtataatgaaggcagcttcagtagtcgattgaaccacccagcagtgactacattcagtgcttctggaaatggagtccacaaaagtcttttgagctgcttgttataatgcaggtttttggtctccatcccggacctaaaaccagaatgtttgggataggacctggatcatctgcatttttaacaagagctgggggtgattcttatgcaaaccaaactttgagaaccatggatctagtttttacatgaaatctctaacctagtaaaccacagtttatttgttaaaatgctaaagtttttcagagttgacctgtatattatcatgtctctcagtaaagttatcggaatattagtattctttagctataaccccctagatattgaccctaaatatctgactatatccactgaaagatttaaccttacaaacaattgtctctatcacttactctgccttgtctctcctctcctctagaaatacaagtcaatgccctgtattcatgtaggatttttattgtattttttttaataggtaacactcatatggttcaaatttcaaaagaacaaaaggatatacagtgaaaaatcaccctttcctttctgtcatctcctggaagacaaccacagttaacagcttcttgagtatggtgttgaatctatttaaaaaacaatctggaaactcattattacttttggtaggaaagctaaaagagagtatacaataagctttttttttttttttgagacggagtcttgctctgctgcccaggctgtagtgcagtggcacaatcttggctcactgcaagctgcccctcccaggctcaagcaattctcctccctcagcctcccaagtagctgggattacaggcatgcgccactatgcctggctaatttttgtatttttaatagagacagagtttcaccttattggccaggctggtctcgaactcctgaccacaagtgatccccccgcctccacctcccaaagtgctgggattacaggcgagagccaccgcgcccacaataagccattttattttttaatggtatctttcagttttaaaaactccttttgatgtaaagatctcagtcagatatttgctgcataacaaactacacaaaaccccacaggcatataacaacaagcatttattgctaatattctgggatagccagctaggtagtcctgctgatgtgtctggggatctattggctgatttaggaaggcctggactgggatgactggggtgacttactgggttccatatgtctctcatcttcaagtacactaatcctggcacattcccatggcaatggccgaggtgttagagataagagaaagcatgctggacatcgggaagtgtaagactgggattggcatgttctcaccacagtcacagtctactgaccaaagcaagacacaggccatcccagttttaaggcgatggaaaaatagacattgcttctttagtgaaaggaatttcaatgtcacatgcaaggccatggctatagggagtgatgaagaatgaggctatcaccaaaatctactgtacataaatgactgaaaattcattacaataataatacttggcttagtgttcaagtattgtacttttataaaactgtccttgttttctgaagatttttcagttgtatatgtatatttatatttttggggcgtggagtctcactctgttgcccaggccggagtgtggtgacacgatctcagctcactgcaacctctgccttccgggttcaagggattcttgtgcctcagtctcccaagtagctgggactacaggctcccgccaccctgcccagctaatttttgtattttcagtagagatggggtttcgctatgttggccaggctggtctcgaactcctgatctcaagcgatccgcccaccttggcctcccaaagtgctgagattacaggcgtgagccactgcacccagtcatttatgtgtatatttctaaggtcaacggaagaattgtgaaaacatctcaaagacctgggacctacacccagccagtcagcatatacctttccactgtcatatgtgaaatgagaaaaacaggtggggtatggtggctcatgtctataattccagcactttggaaggctgagtccagagaattgcttgagctcaggagtttgaggccaacctgggcaacccgtgagaccttgtctctacttttatataaaaataaaagttaaaaaaaaagaaaaagatggataatgactctgggaaacaggaaatagaatgtttcaagttgtaccaaagaaaagtgccattttaattgaaaattttacctcctccagcaggggtgctgatgtactaacaagccactttcagaaaaacagtgtgatcaagtacagttttcattcttttatgtcaacatgttttttgagattatttttcgtattctatactgatttaaatctttgcctttttaaaatcagaatagtcatgcttacaaagtgacccttgaaaggtttatgaaacaaatgtcaggggtgattctggtttctgctttccatttaacttaatttcaattgctatttgcttattttaagaaataaactttgtttcttaagatgacactgactctgatgctatcagtagcctcatcctgatctttaaaaagtaaccttttaactagaattttcaaatactttaatatgcatgtggaattacttagacagttaacatttcttgacccactcgcatttagtcctattggctgataggcagtaactggaaaatgcagcatttctttctgatagacagtgagaagtaagacttcgcgacactcagtgatcaggccatagctcaatgagtctatgcatacagttaggttggaatctgttttagaggtttgagtatgagacgagcgtatcctagctgatacagtttgagctcgtccccatcaaaacatgatccccagtgtggccatgttgagaggcgggtgtattgggaggtgtgtgtgtcatcgggtggatccctcatggatgtctggtgccattctcctggtagtgagttcttgccctccagactagattagttctcctgggaatgttccttcaagagtgggttgttattgttgaattaagtttagcccaaagcggcctccttacatattttaagttggccctaaaggtttctccctacataacaaactgtaaccttactgaatgtgtaaacagactataacctattcttgtgccagtcactaagttttggccaattgaaggcagttagctgttcaaaccgtgttcaaataagccaaacaccgagctgtggccaatccagctgttactgtacctcacttctgttttctctatgtcggtttccttttgctgtgcataaatcttccaccaggcggttctgcgctggagcctctttgaacctatgtgctttaggggctgcccgattcgcaaatcccaaatcgctctttgctcagtgtaactctgttcggtgtaatttgtctaaggttttttcttccatccttataaaaccatgacgctggccgggtgcggtggtggcacttttcgaggccaaggcgggagaatcacatgagatcaggagttcgagaccaggctggccaacatggcgaaaccccgtctctactaaaaatacaaaaaacaaaaaacaaacattagccgggcatggtgatgcgcgcctttaatcccagctactcggaagtctgagacggggaatccgtcaaacccgggaggcggagactgtagtgagccaagattgtgccagagcactccagcctgggtgacacagcaagactccatctcaaaaaaaaatgaaagtaaaaaataaagccacgatgccctcggattttcctctcttctcgtgtgtctgcttcccctttgaccttctccaccatgttatgacgcagcacagaagccttcgccagcagcagaacagatgtcagtactaggcttcttcaacttcccagctggcagaactgtgagctaaataaacgttttctttataaattacccaatctcaggtgttctgttatagtggcacaaactatagactaagacactagcctcaatggaacaggtattgcctttgtaaattgctgaccactgacatcagcactctccataatctgagatacagaaaaatattgtacagcattatctatgcaacataatcctgtagaaattcacctcctcccctttgccctttttctttatgtttgtcactgatacccacaggcatagttcataggaactggtggccctctgagctcagccagaagtcagagagattttcaaatggaaggctatcctgacatggatgtgaagcaactggacatcgttttttttgtttttgtttttgtttttgttttttgaggcacagtctcgctctgtcacccaggctggagtgcagtggcatcattttggctcactgcaacctccacttcctgggttcaagcaattctcctgcttcagcctcccaagtagctgggataacaggtgtgggccaccacgcccggctaatttttgtattttcagtagagacggggtttcgtcatgttggccaggctggtcttgaacccctgacttcaagtgatctgcctgcctcagcctcccaaagtgctgggattacaggcatggaccactgtgcccagccaaaatgttatatatttttattgtgatggtagttacgtagctatatatatatttttcaaaattctttgaatttaaaatgggtgcagtttttgtacataaattttaccccaataaaatggaagtttttaacaaaaaagactcaacatcaccaatcattagggaattgcaaatcaacatcatagtgagatatcacttcacacccattaagatagctattatttaaaaacaactacaatagtgccgggcgcggtggctcacgcctgtaatcccagcactttgggaagccaaggcaggcggatcactaggtcagaagatcaagaccatcctggctaacacggtgaaaccccgtctctactaaaaacacaaaaaagtagctgggcgtggtggtgggcgcctgtagtcccagctacttgggagaatgaggcaggagaatggcatgaacccaggaggcagagcttgcagtgagccgagatcatgccactgcactccagcctgggcgacagagcaagactccgtctcaaaaaacaaacaaacaaaaaaaaaactacaataaaatcacatgttgacaaggatgtggacaaattggaacctttgcacatttctggtgggcatgtacaacagtgcagccactataggaaacaatatgacagttcctcaaaaaattaaatgtagaatcactatatgatccagcaattccacccctaagtatatactcaaaataattgaaagtggaaactcaaaccgatatttgtatatccatgttcataagagcattattcacaatagccaaagggtggaaacaccccaaatgtctaacagtgcgtgaatggataaacaaaatgtgatatacacacacagtgaaacataatttggccacgaaaaagaatacaattttgagacctgccacaacatggatgaaccttgaatatgcatgctaagtgaagtaagccagacacaaaagaataaatattgcaaatttcacttatatgaaaaaccagagtagtcaaatttatagagatgaaaaaatataaggggctgggggagacgagaaggggtagttattgtttaatggatacggagttttagttgagaaagatgaaaaagttctggagatggatggtggaaatgattatacaaccctgtgaatgttcttaatgcccatgacttttacctttaaaatgttaaaatttatgttttgtctatttaccatgatagaaagagagacagaaaggtagaaaaagaaacagaaaaaagaaaaagaaggaaagaaaggaaggaaggaaagaaagatggagggaagaaaggaaggaaggactcccctaatcaactgtgcttgtcttggggcaagacaggacaaatggacagatgactttcagactccactgcccctgcccaagaccccactctgacttctatgtcaatcaacaaatgtcttgttttgggaaatggaaacaatttattctgccaggcacatgggacatgggagaggcttaatgaaaaggcatctggatgaggagctggatctgcagatagatcagtggagaaaagcgcagcacatgcaaaggttccaaggtggggccgtgtttgggtaacttcagcagcctgctgttgcgggaacaaagtacatgtggcaagcaaggtcaggaggtacagctggaaatttagggtagggccagacagagggatcttgagggccacacttaagtttgtttggattttatctcataggtagcagtaaacctttcaacaatgtcaaggtggttattgacttgtgatgtgagttttagaaagatggcagaggagggatgggctggagagggccaaccaggaggcaggggccaggagagggtgagctttaggaggtccctaccattctacagatacctcaagcaaatctgacctgtagttcttggtttatcccagtcaaccacaggtcctctcaaacatcttacactcatattcctttttgagaaacattaaaatctcacactgctttaacatctcatacatttcaaagtaaattacttttgatttaaaacaaatcaaagcaatttctaatgagaatgtttttccaactacactagttagttggaaaatgcagcatttttcagctataccattcctttctcctccctcattctaattcctactcaactgggaatcattgttctacagcaaatctaagaagaagtgttatacataagtccaccctgggctatgaggttcgctttaaacaagtctggtttcattagcgcttccttgggctctcaaagatgctgcaggccctggcatgccccatgctaggaatgacctcccttcacttcgttctggatgtaggagttacccgcatgagcagcatcactacccagctgagttcaatctgctttgaaggttgcctttgccctcattccatcatttccctggtgtgccaggccgaaagggtcacctggggtgtgtgtgaagcacagaggtgcccaggcatctctctggagatgctgattcaggagtctgcagctggcatctggaatctctatgttgagcaagtgctccacgtggttcttgtgacctgacagttttggaaaacatcgtgaagaccctgcctgctctgctggcagctgctgctgtcaccctgagaagaataaaaggttcacggcccagcagatgcccgagcctctttcagggatgaaaccctctttctggatacctctttcaggatgcctgtggagtctgctcctgtgactttccagaagtccacagtcaaaccacatggctttacggttggctcttgtgattctctaaaatgtgtctttgtcacataggtgtgttctttccactttgcctttaaccaagtcagtctctctttatttggccctctttggctcccttaaatatctctgcagtgactacaggtggcgggtgccctgcctgggcctcagtcaagaaggcaaatgcacttgagtataaggaatccctttgagcacatcagaagtgagaccctgtgcttatcccaaagttacttcttcaaacaatgtatgctcagccaagtttcaaggaagaggcaagaatggcttatgagaaggccagctgtgccatgcctataatccgagcactttgaaaggctgaggcaggcggatcacatgaggccaggagctcgagatcagtctggccaacatggcaaaaaccgatcgctactaaaaatacaaaaaaattagctggttgtggtggtgcacacctatcatcccagcaactcaggaggctgaggcagaaggattgcttgagcctgggcggtagaggttgcagtgagccaaggctgaactgcactccagcctatgcgacaaagtgagaccctgtctcagaaaaaaaaaaaaggcttctgaggaggaagataaaccttgtgtttccagaatgcttataggacatttgtaggctgtgttgccatcttttttcttcttggccacaatacgtacaagcccgattatccactgctttctagctcccagcagactcgagttagttgttaagaaggaaccatgctgctggaggcagaggcactacccacatccacatataaaagagagagagacagaagaacaatgaaaagcagagacgagcactcagaaatgtacaagaaaatacaaatacatcgatcaaatagaatgaggttgaaaagtagatccactttcatgagtgtactttttgataaagaaggcattccatattaattgtgaaaggatacaaataaatagcattggctgggtggggtggctcactcttgtaatctcagccctttgggaggcccaggcgggtggatcacttgaggtcaggagttcgagaccagcttggccatcatggtgaaactccatctctagtaaaaatacaaaaaattaggcgggcgcggtggcaggcgcctgtaatcccagttactcgggaggctaaggcagaagaaccacttgaacccaggaggcagaggttgcagtgagccaagatcgtgccactgcactcaagcctgggcaacaaaagcaaaactctgtctcaataaataaataaataaaagcattaaagaattggctatgcattttgggaggagaaaaaattagatccttactttatgctgccacataaattccaggttaattaaaagaggaaaacatgaaaaacaagactccagacaaattaaaaggaaacataagtgaatgtggttataactttgggatagcatagacttccttaagcaaagaagccataaaatggataaatttcactaaataagctttcaaaacatccagctggcaaaaaagaaccataaacaactttcaaaagacaaactatagaatggaagaaactatttctggcatatataacagacaaaatattaatagccataataacataacagtgcctataaataataataagaaagaccaaacctaataatatggaaaatgaatatttttataagatcaggtatgaacaggaatttcactgaatacaaatgactaataatcatatgaaaatatgttcaatctcaacagctaaaatgagttctttttcaccctgattggcaaaaataaaagatttataacatccaatatgggtgaagatatggagaaatggaagctgtcattctcagttgaagagaataaatggatatagccttttcagaaagaaattttattctatcaaaaattttgacttgcattctctaccacccaccaattccactgtcaacatctattccagaaaaacatccagaaaaaataaggaaataagtggcataacaatttcaaagaaagagtttaaattgtcctcaattccagggaatatacagagaaacatcttcatatgcacaaaatggcaagaacgcaaaatatttccttgagcaatgtctgcactaggaaaaaactggaaacctcaatgtccatcagtaaattatggcacatctataagatgagaatgaaaaagaatgagacaatttaatgcatatagagtttatgttgggttgatgaaaatgttttggttataaacagtggtttaatatagatatatacatgtatctatatacaacacaaaaacaaagctacatatttctaaaggtatacatatatatgtacagatacctttaacatggttgggaagaatatacccaaatcactgttatgctttgttatccactaggaaagtgagattcatgggcagggtcaaagggaatgtttgctttaatgtattgggtaaaccttttatgagagaatgtactcaaatgtttacctctatgatttaaattttcatttcaagaaaaacaaaatgcatgtattgacatggaaaattatttattcattctttcaatagtattcactggaaatataaaacaaactcagaagtttcaagggcctgtggtttaaaacaaaccattctatcaccttgctagcaggagcaacaaaggaagttaaaatgactgatgctcattatggtgctgcttagccgtgaagaaaggactaaattatgctccatgtactgtgttggaaaatttcaggagtctaaagtgagtctggggattaataaatgcaacagacactgtcagtgctctgctcacattccttgaacctcactgatttattatcctctggctggtttccaactgcccaaatccatacctgaaggtttttctgaaaccagaaggcttatttcccggacacagttgcactcatcagcagcccaagagtgccagggaatgaacacaccctgctcccctgggagcagcactaataaccctcaggcattggtgtgcaaatccattagctcccatgccccttgagtgagatcttacacagtctcccagagtggccaactaggtgaggctccagtcacccactgtgctaacggggttggtagcatagcctttagtggctgctatcccatctttatcatttccccacttccctagaggtgcttcctgcacgtcccaggtaaactagttgtgttcttccagaggtagagcctgtctcaagatccgcctctggaagaatctacatgaagggtatccaatcctttggcttccctgggccacactggaagaagaaggacagtcttgggccgcacataaaatgcactgacactaacaatagctgatgagcttaaaacaaaattgcaaaaaaaaaaatctcataatgttttaagaaagtttacaaatttgtgttgggccccattcaaagctgccctgggctgtgggttggacaatcttaatctacaccagcgcagaagggtaagcttcagttatgtgaatattcctgcatttgaaacaagactttttttccaatgttactgaaaaatgaggtgtcactatatacacacacacacacacaccccaaaatgcttttctgggctagctttctaccctgctccttgcttcccttccagcctgtcttccaacagttcagctcagagtttatttagggataaccaggtattttcttttgaattctctcagactgcagagttgaacaatctcacaacggccaggtctacagcattcagatgtcacctaagtttctgcaaaatggcctaaaaacctcaaggtcccattactagaaggacttagtgaacctttccaggtggagtttttctgctcttggctgtttggatcctggtccttgggtgttgctagacagcactcagagcctggtggctcctgttactgaattcagttccctcaagagaggctgggctgcagctgctgcagtgggtgggcacccttccagcctccgtccacctcagtcctctgtgccccaggtaggcctctgtggcctcattccttgtgtcatcagtagacggttgacagttgtgactgcaagttgtccaggatcttggcatcttgaacaaagaattggacaaaatgcctagcaaagcaaagaaagagtgaagcaacgaaagaacaaaagcaggaatttattgaaaatgaaagcacactccacagtgtgggagtgcgcggagcagcagctcaagggcccggacacagaatcttcttgggtccaatacccctagaagtttcccattggccacctgatgctcacctcatgtaaataaagtggtagcccacaatcagtctgattggttgcagaaggcagccaaacagaggctgaaatggttacaaaggtcacactcctgtgcaaacatctgattggttgcaaaaagcagctagtcagaggctagggtgaagttacaaagttatacttctatgcaaacgaagacttcgcccaaaatcagtctgattgtggacagcaaccattcagaggctggagtgaagttacaaagttgcaaaccaaggctggacctgcaatcagtctgatttgttgagtacagccaatttcccatctgcggcaactcggcaactcgacactaaaaaggtgagggtttacaaagggagtaggtcattttgttacttaggggtggaaagttagggttttcctttcagtttagttctaggaagtcgacttgaaacagccctagtttccctgtctccagaccccattctcccgcctcagttatacagaccatttaggaaaatggagacatcaattataacattaccagggtagcaaattatcaaatcggacagcgtattacaaacttctatgtagaggttaaagatacttttcaggccaggtgtggtgactcaggcctgtaatcccagctctttgggaggccaaggcaggggaatctcttgagttcaggagtttgaggccagtctgggcaacacagggaaacctaatttctactaaaaataaaaaataattagctgggcctggtggtgtgcacctgtagtcccagctacttgggaggctgaggtagggggaatcacttgagccggggaggtccaggctgctgtgagccgtgatcatgccactgcactccagcactccagcctgggtgacagagcaagaatctgtctgaaatatatatgtatatataatatatatttatacctaatatataaacattattatttaattaatattaattaattatattaatattataaacatatcagtaatattaatatgttaataaatatataaacataaatatatttataaatatataaatatattatcaatgttaatatataattaattataattaatatataattaataatattattaggctgggcgtggtagctcacgcttataatcccagcactttgggaggctgaggcaggtggatcacaagttcaggagttcaagaccagcctggccaatatggtgaaaccccgtctctactaaaaatacaaaaattagctgggtgtggtggctcacgcctgtaatcccagcactttgggaggctgaggtgggaggatcacttgaggtcaggagttcaagaccagcctgaccaacatggtgaaaccccatctctactaaaaatacaaaaattagctgggcgtggtggtggggacctgtaatcccagctacttgggaggctgagggaggagaattgcttgaacctgggaggcggaggttgcagtgagccaagatcatgccactgcactctagcctgggcaacagagcatgactccgtctcaaaaaagaaaaaaaaaaatcttgatttttccttctggacaggctccaatatggctctgtgcagcactgttattggtcctgtcgttactgaaaattctgattttttttttttggaaacggagtcttgcactgtcgcccgggctggagtgcagtggcgcaatctcggctcactgcaacctctgcctcccaggttcaagcgattctccttcctcagcctcccaagtagctgggacgacaggcgcccgccaccatgcccagctaatccagctaaatttttttgtatttttagtagagacggggttttaccttgttggccaggctggtcttgaactcctgacctcatgatctgcttgcctcgg

SEQ ID NO: 12615 - DNA, 58824 bp, Human
ggggtgtggcacactaaatggtgctataagaacatttgctagagtgagttgaaattctcctgttgaagaccgtaggaacagtggaaagaatggctgtagtctggtaggcaggtagtggtaggctcagcctgtgggagagaggagtcagtggtggctatagggcacgtcctgggaatgggagtcatggagctgtggtagaaagcaagactcacctatatcatggcacagctaaaggccaggtctgggctgggtgtggtggctcatgcctgcagtcccaacacgttaggaggccaagatgggaggattgtttgagcccaggagttgatcaaaacccaaatccaaatacctacttagcatattttctcttctgggaagtaactaaccacctgattatttggaaaatgaggcatttgttggagttgaaggtgtagcaagaaacttttggttttaagagtcaaagtcagaggaaaaaaaactctcagacttgtattcatccccaccccccaccccaagctactgcaaagagcaggggctttggaagattggtttgttgaaatgaagttcctttgacaaaggtacctgggcccatttctctcattctaaaaaggacaagactgatacccagagacggcaaggtcacagagctgattaaattgggatcagaatcttctcagtcaggagctctgtccatggcttcagagcctgtgccccagtcccctctccccacctctcccctatgccccacttggcccgtcctcttcatcctctgcccctgtctcctatgtcaggaagaggaagcccctgtgtgcaccccaccctttacctcccaccctcactgcagactgcacttcccattccctgctgcctgctgcctgactgctcctaatgagattacagatctctggtgaaatagacgagggttaattccccctggctttacagggcagggcaggccaggccacaagaaatagcaaaaagacacctattctccaaagcactaagtgtgataatgaccctaagagtccgttcccctgttcagcacaccagggttcacactgcgtttccaaataccctctgggtggaattttgtaccagccctaacaaagtagatgctgttatcatctctattttacagatggagaaactgaggcacagtgagatgaaatgcttgtctgaggtcacacagctagtaagtggcagagctgggacccgaatgtgggtctcttgggctctgtcatctttaaaaaataataggcccagagagcctgcagggtgcccagcaccaggcttgaaacagccctgaagcatctacgtcccatttcccggtgagtggcacagcccacctttgaactcaggtcccctggactcgaatctacattccccacaatactgccaagcacccttgaacctatctgcctgttcatgtggtggaaacagactggcctagccctgacttctgacctctgtgaccatggccaagggactggcttctggggtctcagcctccctttctgaaaaatgaaggtgggaaccctgggatctttgggacaattccctatgattggcatagctaaggcagccagcacaggcctggcccgcagcacatgcacccacccacctcagtttctttatctgtaaaatggtgatattaatagtacttatttcttgggattggtgttaggattaaatatgccagtacatgtaacactcttctagaatggcacctggtgcatagtaaatgcttaattaatgttgagggaaactgatatcttactgtcttgtttttgattctttctggaaggaagcaggggtaaagatcaaaccaaccaagcaaatgttcctcttgttccttccagtacctggtccactcaactgtttaagaggaacgcttggctttgaggcctgaactcccagaccacgtggtctgctctaatttcccaggccctaatctgctcccagctcctaatgatgcagctggtaataggattgtggcttccctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggtcagccacccagagcatctcgggacccctgtccaggaggggcgtgtgggcctgagggatctggggtcccgttctagcatcacagctccctggtgccatgacagtgtgtgaatccctctgcctctctgggtcctggttttctcatctgtaacatgggtgtgataaacactttgcaggactagagggaagaaccagtgatgtggctggggagtgattacaaacccagcaccatcaggtgaggagaggcgagggtgcctcatgacgacaaacacagggccaagagctgtggcggggaaagaggggggtcttgtgtgagttcaaacaggcaccagagaacacctcctaaaggctgctcaaatgacaagagatccaggaagggtgctctaggcagaggtgacagcagatgccaggtgcagcggccggagcgcagaggccagcaggcccataggtcccatcgccacacgtgggcttgcggcaaccatgagatgcttttgggcagaagagcgacaggccagtttggagcttgggagacccctcaggtgctgagtggagagggggtgattctggggcaggcagggggccgagaaggggcagcctgggggagatgcggcagtgcagacaaaagggacagacgtgagaactgttttcaaaagggggagcttcaggatgtgggggccgattggatgtgggctgggggacaggaaggggagccaggccccgggtttccagcctgtgtaactgccatgaagaagctgcgtttcctgggaaagagcccctttccctgtcagcccccatctcctacaggagagggagggacattcccatggtgttaaggacaaaatcattctgccactagttaaactggtaaggaaggctctattcaggactattgtggtaggggggtagttatcaagacctcctggggagagagatgggacccaaccacaaatacaacaaagatggctggagatttatagccagcgagcagagggagggggtcggggacagaaaatgactacaggagacatcagggtagggggattcttgttgaaggcaggccagggtgatcagacattgatctgggatgaggaatttgatccagtatcaggatgctggagggtgagggatcctcactaaactgacttggcaggacttttgctacagctggactatgcaggctgaagacaaggcccaaggacaaagcccagtggaaaagagggctcagaggagcctgtctaaagtgtggtcaaggagagaggctttgtcaatgggctcctggaagagtccctattcccagaaagtcctcttcccgcagctcactaatgtctaatgccatctctacaactggggtcaggcattagactttgtcttccattaaaaggaaaacacccactcctggagaactgagccacgactatagtgaccctgttaagcctcgagcagttatttaggaagaagcatggactctggaggcagagaaaccctgaactttgactctgctagcaaatggctaggcaatatcctctctcctccctgggcctcagtttccttgtctgtaaaatgggatgtggggcagtatatgtctactagaattattatgaggaataaaccaaggattcatcaatgcccagcatacagtaggtgcttactacgtgttacttccccctccctcccttatgtacctgttaaagtcctatctacatcaggaaccatctcatcatccatagctgatgaaagtaactgtaaccccgctgctggctgcctggcttcagagctggttatatgggtgtctctttctcccaccaagctgcatattgctgaacaacatatgggtttgtttttttttttaaccaaaacgtgagcctagccctgtgtcaggcacagagagaacgctcaactatctgctgcattaaactggcaatggaacaaaaaaatctgcaatctgttctctttaattttcctcagcaacaaaaatatatctcctgcaggaagattattttgtgaaaacaaattggaatgcctattattaaaagccaaactcatctggggcctactttgccaaagctgcctttcccatctgtttggaaatgcaaatgtattccggtctggattaacctgccagataaattgaaggaaggatgtagaggcttagaacaattatttggcagaaactggctttctcagcatcttactttgaaatctgggatttctctgtttgatctctttgcctgtgactcagaaactaaacacttcttgttttgtaagcttatgcaacaggcaaaaatcataaacaatatggaaaatggtagaatgttctatttgtgaaaaagaacttttatccttgataaaatcacaggattttatcttggtgtatgagtgtctcatttaaaaatactgagcattttgagacttccagttaaaccatggtgaatcacaggtgtatccatttttttccctccttcctagaattccactaacattttagtaatgggatttttaaaaggtaaaaccaccaagaataaagagaatataaaaggagacagttgagaaaaagaaatagagaggctacaacaaattagataatatggaggtgggtggagctgatgacctcgttcacagaaagctggaatcttagtctgtggaagttgataccaagtcagtttgtcttgcagactccagaacgtaacagagcaagatgctgcactaggcagggtgaggctggggttgaaagcctgggcatggtttggagttttgtaaccagagcagttagacccctagggaccttccaattcagttgggggactcatccacccatctccacccactgcctgccccaaggaaccagagaagctggacttgagggtattgggccacccctgtgtgtgttggggagagggccatgctgaggcacctacttcaaactaattaacagacatccttgtctgagtggggtccccagcacggtttcagatcgctgtcagctgagcttaggcaccatgtcattcctcagccaaaggcaggaagagacttctctcactgaggcctcagagaaaagatctctaaattctgctataaaggagactcctctaccatcccacccagccccagtgaaaaagccagatcagcacctgtcaccctgccctgagggccgtcagttgacaaaccctactcatacatgcagaagtttagcgcttcaaacttacatacgagcagaaagccacgccaccagaaatgtgaggaggctcctaatgtgaaacagagtaaacgaagagaaaagggggtctctaatgagagaaacaaagagaaaagtgggtctctagtgaagcagagacaaggcggggaggagaaggaagctttgtaaatctcctcttaagctttctggagctgcgagtgaagatatagttaccgtacaacagaggggatgtgaaaagaaggaacaatcagagaacaagaaagaatctggggaaattaaaaatagaagaactaagataaaaatgtgagtagctgcccaacacatagaaaggataaatactcgaagtgttggagaccctgaataccctgatttgaacattacacagtgtatttaacaatataccaactgtatcccataaatatgtacaaatattatatattaatataaaaactttggctaggcctggtggctcatgcctgtaatcctagcactttgggaggccaaggcgggtggattgcctgaccccaggcattcagggccagcctgggcaacatggtgtgagaccccatctccaaaaaaaaaaaaaaaaattaatgtcaataactgggataaagttgtagaaatctcccagaaactagaacaaaaataaatgaaaatagaaaaagaaaatataagaaaattagaatgttcaatgtccagctacctaatgacacttttagagacagctaacagaagaaaaatagaggagaaacagtttgcagagaatctaagcagtttctcagaagtgaaaggcaagcatagcactgtcaattttgtttacaaaagaaagaaaaccccatactatggcccatcaccatgaaattaccaaaaagtggagataaactgatgatctttggatggttctggtggaataaaaccaacctcatctaaggaacaggaaatcagaatggctttgaacatcttaagcaaactggaagctagaagacaagggagaaacaccttctaaacctgaggggaaattatttccaacgaagtatctcacacatggccaggctaatatcagaggtaaaggtagaataaaggcatttttactcatgtaaggactcagaaaagtttatctcccatccactctttctcagaaagctaccaaaggagatgtttcagcaaaacaaggaagtaaaccaagaggacaaaggatcccagaaacagggggccctctaaaggacaagtcccagaatgacaaccaagaaggaaaccatgacaagcactgggcctagagagcagtcagtccaaactggagcaggaaggtggaaagctcacagaccaaggccccaggcaggataaaagagaactgatgtgcttgagagagcagaaaatactattgttaggtagtttagtagacatgttaaaatgtttggaagaaattagtgggtgattcccagaaaacaagacaaataaaaatcagtcaattaactttaggctacaagcaaggagacatggttgtagtacattacttggctcaatggtaaacactgtttggcgatcaaaacattgtaaatcttgatttactaaaaaattgatataaatataatgctgaaataggtggagagaaagggagtaagaactaactcctcatcaatcatggcagggaaattgatagatgtcaaaatgatgaatcaagaaatagcattatgaccatattatctagaaatagtgatactatgggaaacagctagaagaactgagcatgttcactactgggaagttgcaagatagggatagagagaggtgaggcaagagctgcctttttatcagtagagcaccttttttttttttttttttttttggagatagcgtctccctctgttgcccaggctggagtgcagtggtgcgatcttagctcactgcaatccccgcctcctgggttcaagcgaatcttgtgcttcagcctcctgagtagctgggactacaggcgtgcaccaccatgcccagctaatttttgtatttttagtagagacggggttttgccatgttggctgggctggtctcgaactcttaacctcaagtgatccacctaccttggcctcccaaagtgctgggattacaggcataagccaccgagcctggctattagagcacttttaacttaaagaatatatacatgtgggtgccagtgcagtggctcacacctataatcccagcactttgggaggcctagctgggaggactgtttgagtccaggagtttgagactagtctgggcaacatagtgagacactgtctctacaaaaaatacaaaaattagctgggcttggtggcatacatctgtggtctcagctactcgggagcctgaggtgtgaagattacttgagcccaggaggtggaggttgcagtgagctgaaatcatgccactgccctcctgcctgggtaacagaatgagaccttgtctcaaaaaaaaaaaaaaatatatatatatataatatatatatgtttttatatattatatatgtttttatatattatatatgtttatatattatatatgtttatatattatatatgtttatatattatatatgtttatatattatatatgtttatatattatatatgtttatatatattatatatgtttatataaatatatggactaaagttaattaaaaatatattgttggcagggcatggtggctcacgcctgtaatccaagcactttgggaggccgaggcgggcggatcaacaaggtcaggagattaagaccatcctggcaaacatggtgaaaccccatctctactaaaatacacaaatttagccgggcatagtggcgcgcacctgtagtcccagctacttgggagggtgaggcagggggattggttgaacctgggaggcggaggttgcagtgagccgagatggcaccactgcactgcactccagcctggtgacagagcaagactctgtctaaaaaatatatatatataatatataattatatatattattttatatatatatatatagagagagagagagtcatgatgggcatatttctttaaaaagcagattttctggtgcattggaaatgttagcagtcctggtcctgtgctgcggttaacattgggtgggtctgtcacctcccttttgcggttcagcttcctcatctatcacatgagtgggctgggctagaagatctcaagagtcccctcatagcaccaacatttgatgatttggagatttttaaagcatcagatcatcaaccgagtatgtttggctttggttaaaaaaaaatagttgcaagtacaacaattcaacttggatgatgtttgaaagtccatttgcctgcctcgcccacaacctcaccctctgaagaaagtggccccatgccagggttgccagaagtagcagaactgaattaagttaaaaaattttataaacagcacacccagttaaactggagtttcagataaacagcattttttttttttagtataagaatgaactatatgttgttatctgaaagtctgatttaactgggcttagcagcccttctgcttcagttgtcaggtcctggtcacgtgactgttacttgcgagacagcttattgggcaaggagttggcgccttagtcagagatccgtggacaggctggagccagcggcctaggaaggggtcaggcgtaagaactctgccaaagggggctgtttctaccgcgtggtgttgcacccattcaatctgatcctctctctctcagcattttcgaggagaagcactagagaatggacccaaaacagatggagaaactgactcgcaaggcggccatggtctgcttaggagtgggtctcctcaccagctaggctgggaacttctcaggacaggaaccctgcctagttcatgttggggtacccactgtgatgcgtggcacgatgcgggttgaatgaatgcatgaacagtactcggctctgtcctctggtcacctgccatctgctacacgagagagattttattccatggctaggcagatgcgtggtgcagatggaggagagctgttattttcaggattaccaaacattggctgtcatccaggcgctgtgctaagtgcttgcgtgcattctcccgtttaagccccccaatgaccctgtgaggcagagcagtccccccttatccgccatttcgctttctgtgatttcagttaccgatggtctgaaaatgggtgagaacagtactggaagatattttaagagagaccacattcacataacttttattacagtatattctaatcgctccatttgattattagttactgttaatctcttactgtgtctaatttatgaattacattttatcgtaggtatgtacatataggaaaaaaacaacgtccacagggttcagtctctgtggtttcaggcatccactggcggtctcggaacctgtccgctgagaataagtagggactactgtagttattaccctcatgttacagatgagaaaaacacaaaactcagagtggtcacagaagatgcttaaggccacacagcttgtgggggattggtggaggcggggtgtttaccaggattggaacccagttctgtggctccaaagccagttctttctccatggtctctgctgccatgtgctagacaggggagtcagatgggatagtgcttcaaagactgtgaagaacggaaccactgtgcagtctgcatctcttgctataaccccagttcttactgtgttttcaggaaattagttacttccagttccctggagagctcctgatgaggatgctgaagatgatgatcctgccactggtggtctccaggtgagagcgggggtttgaccaggtggtccggaaccaggagggtagaggatggcttctgttgctgccctgctcctgctgtgggtggctggagagcaaccacaggccctgggatgagtgtgaccgtggggcctttatgggcagtgccgtgggctgccggcttctgagtcattcagtggccccagttgttggttccatccagtagaatttttagtggatagaacaggtgatttggaatcaacggatatgacccgactccaagatagctcaaggccagggagttgagggttggcttcccagaggaggggctgttcatggtaatgcagcaaggcctggggaaaagagaactaactctgaggatactccagtgatcacagcctggcttggctgtgtaaccttggacatattacctcacctctctacgcctcagtttcctcatctgtaaaatgggaataacaacacctacttcgaagggttgtcatgaagactatatgcttgtgtatgctgagcactcaggaggttgggacttggggacaagggcgggatggtgcgagatgaatttggagggtgagctcttgcccaatcatgaacgaccttgaacaccaggctgaagaattcagaccttacccagtagggtgcgggccatggaaatcatgggagatcacttggtccctttcactgatgtgctaggtgaacttgagcaaccctatccctgtccaggtcttgagtattccagatgtataatgagtggctgctccaggtggtgtctaagagccttttgctctgaggccatgagaaatcttcatcttccaggactcctctgcagagaggaaagaggatgagcctctgcatgcgttctgcctcccagcctccctgctgctgagcagtgagccagctccttggacctcccccctttgtgaagtggagataatccccaggccaagggcgctttgtattttctgcacagaggcctttgcaagcagcatttaaatctctcaggactcagccttcaaggctctgctgaaatgctacctccctcaggaagccttccctgactcctcaactcactctagtgactgtctcctctttctgcatctttggagtcattcactgagcctgtgaatctgtcagggtcagcagtcctctgtgttgctgaatctgtacgacacgtccagttcttccacacggcctctccacagccatgggtgcagctgattactcttgccctcatgaaatgcccttccctatggactcacactcttctaactttttgcctgctttctgcccctccatcttggtctctctccttctactcaacctccaaatgttcagcttctccagccttttctcatctaatttcatagctttaacataccacctacaagcccaatgcccccagatggagatctccccagacctctcctgtgagctccatacttcattaaccaactgcctatttgacatctccacttggatgtttcacaaacgtttcaagttttgttttgtttgagataggatcttgccctgtcgcccaggctagagtgcagtggcacaatctcagctcactgcagcctcggcttcctgggttcaagtgatcctcctacctcagccccccaagtagctgggaccacaggcacacaccaccacacctaattattttttgtattttttgtagaggcggggtctcaccatgttgcccaggctggtctcaaactcctgagctccagcaatccacctgcctcagcctcccaaagtgcgggaattataggcatgagccaccgtgcccagccacacttcaagtttaatgtcaccaacttgaagttccacccagaaaactgcctccttttcctgttttcttcttgtccgcaaatggcagctccatcacccaggtcttccatcgggcctgtcattggctatcctctttctctcaaccccacagccccatccacagttccagtggattctgcctactcagtcgaagaatggagcttcctccccaccctacaggcccgggcactctcttctcacgtccagactccaccgccacctcactggtctcctcgcctcacttcttgtccccgtcccatctattccacccagtggccagaaggatcttgagaaaagcagattgggccctgcccctcatttaccttcaacagcttccatgacatgtagaatcaacctgcagaccgttaacctggtctaggaggccctgcatgatctgcctcgcccaccccacctcatcccatgtcacatactccagtcccaccagcctcaagttccctaagcagaccaagcccttaccatctcagggcctccacacgtgctgttccttcctctggaacatgcttccccaacatcttacatctcttcttcttcctctttttttccatctcaacttgcacatcatcttcttaggaaggccctccccaccaaccccttcatgccaccctggctctcccttactgtaccctgttccctcccggccacagcacatatcatatgttgtcattctatatgcattcacttgttaactggtttctttatccactgggctgtaagctttgcaaagttaacgaggctactctgcctagattcaactctgtgttgtcagcacctagccaagtgccaggcatatagtaggtgctcattaatactggtcaagtgaattaattaatggatcctgcaatcatgcattgtgctttctggacacttggccctgtgctgggtgctgcagacacagagatgatggagagactgtcctgtggtgttcacagactgctggggagactgacaggaaaatagacaatcacagaacagctaaataagtgcactggtggaggaagccaggacccttggcaggcagttctgtctgccctttcctgctgactgtcctaactgcctgggcattgcccctctctcagaacagaggcaccttagaggccattgtatggaccctggtgtcacacagcctggccttgctatgtattagctgtgtggccttggacaagtcactcaaaacaaaaaaatcctgttcagaagtcagaggccagggtcctcgacctgcctccaccacaagcgatcatgtgatctgaggtgaggcccccaaccctgggcttctttacccagcaacgaaggcccgtccagctctccaccttctggctctcaaatgcctggtctccctccaccagactcagtgttctcttggctggaaatgcatgtgatattaagttgagaaaagccaggacgtgttcatacatttcatttgtttattatagagtttggactggtgcagagcaaccgtgtcactaagaaatggaaccgctttaacattttcctatgaagggaaaattaaaccttcaggggggagatatgacgcatttctgagtcctaaaacccctcgttcctgaactctccctcctttggcctcaaactggcctattatccatcctggccaggagtccatccacactgtcccctgagctcttgctcctggccagcccagggctgggtgtccctgcctttgaggaacagccactctggtgtgaggttgttactcagggcagagcaaaatcaccagagctgctttgaaaaattcagatgtcaggcctgaccctgagctgactgagctagaaccccaaagggtccaagcagaggtttgctttcagagctccgaaagtattctgaggattttaaacctcttgattgtcctggggtcagaccttctggctccacagcttaggagcccagcaggaggctgtggtgctcccatccccaggggctccaagctgtgacccaggaaggcaagggttttctgcagtgtgtcctggctacagggcagtagcgggggagtggggggatgggggcagggggttacctttgggctcaccagcttccagttccaaccatctgcaggtctgggcctcgaagcctggctcccatgacatctgttcccacctcctctccaggacaaacagccaccctttccccatgccaagccctggaaccaggctggtcacccactagtcccacagcatgccacaagggtctatctccacactcctgctcctgcccagcccctgccatgcacgccctcttttaattcttttaatttaaagtctcactctgtattcaagacctagctcaaggttctgtgtgggaagtccttccacctccccatttgttggtaaaatggatgatgatctgtctccaatgctgacgctgtgtgtgacctgcatgagctgagtgtcgttagctcagtgacctcacggtcgcagctggcatgccacacaatgggggacaggcatcttttagtccagtagtgacatctatgtgagcaaaccaactagtatccctattcggaagagccactcatctcactgaacaagaaagccactgtcaaggggtcgggccagcggcatggccccctccgtgggcagggtcgtgtgcatctttgtttttttctgagatcccaggaggggatcaggtcattgacccccttgtctttcacactgacctctgcctggtactcagcgtgacagattcgttcagaagttggagatctaaacaacaagcaaagggaggtggtgaggtgtaaagaagtgtgggtgactgcaagggtggacgtgagggctgaaaggcccctgggctgccatggaggggtcacaggcacaccttgctctggagaaaggaggcccagtgggagggcagtggggccagcggggttggagctgagttcagtcactcttcccataatctggcatcttccagatgtgggctcttttttttctagaatttctccaacccagcccctggcccaagtccctcctcagacatgtgtgcttcagtccagctgagtgcagcccacgcttgaccagtggtggcttcatctgtcacaatgtggcgggggagcaggaagcatgggcgggggtggttgaaatctgcaaaggctacagggcaggaacagggctttggagtcaccctctagatgtgcaaatgtaaacaagccttttagcatctgagcctcagtgtccttatctataaagtgggaagaatacctccttcacgaggttattacgaaaagtaagtaagagaatgtacgtgaagacccagcatggctcctggtacgttatggatgtcccatgtttttcttttttctttttttttttcttttttgagacatagtctcactctgtcacccaggctggagtgcagtggcatgatctcagctcactgcaatctccacctcccgggttcaagcaattctcctgcctcagcctcccaagtagctgggattacaggcacccgccaccatgaccagcaaatttttgaattcttagtagagacggggtttcaccatgttggccaggctggtctcgaactcctgacctcaggtgatccgcccaccttggcctcccaaagtgctaggattacatgcgtgagccaccatgcctggcagatgtcccatgtttttctaacttattaaagcatcaccaggctcctcagatgtgtcatgaatgctcccccagcccgtggccacctctgtcactgctctcagcaggaagccccttggatggcctcttccatcttcatggttctaattagcacctgcagctcacctgtcccctgccctggaaagccacccttgactgaggcacacccgggtgctccctcaacactggtacagaccatgcagcatgccctgcttcacctgagtcgtgcacacctgcacatccacagggcctccgcaggggccctggccaggtcctgcccacttctccatgatgcactcacctggcacccagagccattccttgcgccatgacagtcagagcctccttatctgtcatgaattcctattcttttttgtttttaattgagacagggtcttactctgtccctcaggctggagtgcagtggcatgaccacagctcactgtaactttcaactccagggctcaatcgatcctcccgacttagcctcccaattagctgggactacaggcacacgccaccatgcccagctaattttttaaattttgggtagacatggggctctcactatgttgccaaggctggccttgaattcctgggctcgaggcatcctcctgccttggcctctcaaagtgctgggattacaggtgtgagtcaccgcaccctgcccaattcctattcttactgcctcttgcttttctatgcccttcactcctacaaccaagcagccttcatcagcttcccattcacaccagcattccttgcttcaagtagtgccttcagttatctcctggttctctgtgtgtgtgtctgtgtgtattcgttatcattgccgtgtaacaaattatcacaaacttagtgacataaacacacttcatggttgcctcagtccctgggccagcagtctgggcgggcttggctgagtcctctgctcagagtcttaggctgcaatccaggtgtccgctgggctctgttctcatccggaggcccaaccagggagaatccgcctccatgctccctcaggcatggacagaagtgattccccatggctgctgcctgagggcccagcattgacagctgtgcagtggagccactcaggttctagaggctgcctgcagctccccacccagctgtctccacaggcagctcacagcatagcactgtaggtcatcaaggccagcaggaagcccggttctcaccagtcttctgagtcaaagtcttctaccacataaccacagggagacatcccaccaccttgttgtgttctcatagaagtcacaggcactgccacactgcgggaggaggatataccagggcttgggtcatcggggtggcctgagggcctgtccacctccttctctctcctggaaccttccttctctcttcctctgtccccagagcagctggatgtctttcagaagtcacttctgctcacctctctccctggagccggcttgggttgagtggagccactgctcagcttctgtccaagtagttcatcaagaactttcttctgtataaggactgctcccttactgtaaaaataattctgaagaatataactctccccctttcatctgatttctcactgccccatacagggcctgctactgcctgtgcctgatcaatacattttcaatgaataagaagcagcagagggcagcggcagcagagttcagggaaagtctcaccaccagcatttgtatgggccctggaggacagttaggagctgaactttaaagatgttttcatattttaaaaaattagataaagccctggcaacatagtgagaccccatctctacaaaaaaaaaaaaaaaaaaaaaaacttttaaaattagccaggcatgatggtgggcacctgtagtcctggctacttgggaggctgaggtgggaggatcgcttgagcccagaaggttgagcctgcagtgagccatgttcatgccattgcactccagcctgggcaacaaagcaagaccttatctcataaaaaaaaaattagataagcaaattacaaacattttggataacagagaagaaaccatcctctcactccacattgctaattctgccactgtgatttcttctctacaaggtttgttcttattcttactggtgaattcaccagatgtgaggtgaggtccttggctgatgggatcagaagcccaactgtctgggccccagagctggttgggcctgtcccccgatgctagcaaggggcaatcaaatatgccacatactgatttattcattcccagagatcaagacacttgccagcaaggacagtcatatgcaggctctggccagagcctctctgtgggcttaccatgcagggaacccactggtgaaatctgcttgctggtgggtacatttagttatttaactgtataacccggcgtaactccaggtttgcggttttcagtttatttcagccctcccaccacccccgccttatagtggagtcccatcatatgtgcatttaacttaagtgaattcaattacatgtgctctgaaaaagggagaaaatcatttaaatgagacaggagactcctccttccaagggctcttccccaggtgagggccacgagagaggagggcctgaattgcctccaccagcctctgtgcccaggcacctcctgaacagtgagcacctccctgaagccagagagtttctagggcctgcagaggggtgggtgttttagatcacggcctctgagtgtatgctgatgctctcatctggtgtttgcttaaagaaacagcaacccactccaaggctggaagggaaactgtcttgaatgaacttacacaaaactatacctcctggactctatgggcaacttaagagattttcaaaggcaaaattaattacactttgtttttgctttactgacttgaaactgaatacactgaatatggtcctactcccctgtactagcaggaagcccagtgtgtccctctggaggcctccaccccgtggccacagtcagcttatttcattcagtggaagcttctggtgtaaacagagctggaacatggggtcctgccaccagccctgctgctctggttccctccacggggtggccctgtggaacgcaggtcccgcacgctctggtggaagtctgcacactgccccttgcaggtgcacaacgctgctcaggccacagggatgcctccagacccctaggtccccccgaagtgctcaataattgttcctaaagcagcctcagtcatgtcctgagatcagctccccgggagttgagccccaattcccttttccctcctactgggttcattttggaggccttgaatgccaggccatctcggctgggggactctagcgtaccctggtgctaacttcaaatcacagggaactggggctcaggtcttagtctttttcctctcagaaggccctgatcctctggtgcaaatgggcacagttttccataactctgcagatctcaagttctcaaggaggaggcattcatcaagccacaacagctcctcccttcccctgacagtgctgccttctcatccgacatttgctgctcaaaagattctttgcaaaataaaattgcctgcaggggaacttgctctgtccacccaggaacagagacgccttggacaaaaattagaaaattctgcctcacattacattagtataggaacgaatcatctggacgggacctgcattggggcccccctcccatggttttgccctcctcagccgtcttccgtgtgctgccacagttcactaacgccatgccaattatatctttatttagaaaagtcaagccttcagggcctgggagccttactttcccattctccccccagcaggccacttgtcactaccccaatcctttttgctttcaacttacagtataacccaaaaagtatcttccacaaaaataaatctgtagcctgcttgctttggttttcccccaatgtgatgtcataagaatttccacgctgcaccttcaccttggtgatcctgttttactcacccactcgggaggcacagagtttgcaaagtcttttgcctgtcacaaggcacttgggaggctgctagactcttgagggagctgccctgcctcgggactgtggtctcacctcgagttcaccctcttagcctcagccataaaataggcacaatgctgtctgctaatttacaaagcaggtcccggcaggtgctctgtgtgtgtgtttgtgtgcccatgtgtgtttgtgtgtgtggcccattatggccccattccactgaggctagactttgcacctcaccttgggaggtcaactgagccttgttttcacacatccccagacaagcttgacacaaggaattaggggtaagtcagaccagcatctggatccagctagagcctccaattctccacttgctttttgccaaacccttctctcccctcattcttcagtttcttaaaccaggcgtccttcaggggaaactgaatccatgtgtttgtgattcactagggctgcgcatggtagagtgttctgtgagctccacaacatagcaaagacagccaagcgtgggtgtgggtttgtctgtgaagctgtgttgtgtgtgtgtgtgtgtgtgtgtgtgtgttgtattgtgtatgtattgttttccttcctatttcttgtaaggactttaaactgatttttcttagaatcaggaaatcatgtttggccagagaaactcaacaatcccttctccccttcctgaggaactctagtttggcagaaaattcccaaacacccacattctaacttattggaaatgggcctgggccaagcagccgtcaaagtctggtttgggagccagtgtgcagggggctgcccagactccccaggacaggccgtgagcaggaggaggcagaggagcgggtggccagagggccaaaccggtacagcctgtgcttcggatgctgccctccgagtcagggggtagccacagtttggcgagctccactgaaccttctggtgtgagccctgggacctgcctttggccctcctgcccagtcagatgatttgccttactcatcaagaggggaaacgtggcccgctgtgggctgcgggtggggtcagacctccagcctggtgactccgaaaaactcccaggctttatcctgcaccacagacttccatgctctcgctcccttccagttagagaattcctacttggccttcgaggctccatccagctgtgccctcctctgggaggcccagcccgatgcccggagggctggccctgctctggcgctcagtcacagctacccccacccccgggttggtgttgctctgctgctggtctccccacccgctggccagagcaccaggaagaacacagacccacctcattcccttctgagccccacagcacccagtgcaaatgttcaacaccgggcagggtgggcacatatctcagagcctgggaaggtgggtgaggttttgaaaactgtgctgccgcccttctctgtggagaaccgctgcactggagagaggcccacaggatggccccgcctgagccctgtgcggggcagactccaggggccctgctggtgcagggaggggaggcaggagacctgagttcccctgactcctcatgatctttgccacatgggcaaggaaggggtgggggattcagttcacgtggagttggaaactggacctggccctgactgccttagggaatgcagccttcttggtggagaatggttgagaatggccggcagtctgacagtgagctctgagggctgcagctgtggctcctccagcttttgcttttgatccagttcaagcttgtcattctcacaggtcccagtggagcgccctcttggcacccaggcctgggaaggagggaccttcagagggcagcagggcatgccagggtagcagcacccaccgcccacactctgagccccacactctctcccaccttccctccatggaaatcaaggtggaggccaagaggtttggtccatgtggctccagagggctggctgggcccagtgtggcccaatgctcttccccggaggcggatttcattgtgacaccaggaaggacttcctaataagcatcacgagctcatagtggaggggctgactcagaaggtagtgagtgctctgtcctctgagatatgcaagcagaggtggtggaggaatttctgcccttgggagggtgtgctgagacgagatggcccagactttagctgagtgggagtctgggcatgctgccttaggcctcaggaggagtcggcttgagtgtggggctttggcagagccgtctgggaagcatgacttggagctggcgctaatgggcatggcactggctgtcagctgttgggcctgccttctgctcaggggaaaagaagagtaagccatgatgctcagatggactgaagggacccctcttgcccgcagacccccgaagcctccttcctgcggcctgtctggtagacttcctgcagctgcatcccagggccagctggggagagcctctgtggctaggtcagccgaggccagagcccaaggacttggctgcagggcttggggctcctcactgtccctcaggtcctcccactgccaggaggttgtgactggatgctgtcatgccagcagactagggcttgaacccacttattgtgtgactttagcaagttgcttgcacacctccagtgactgggaggtcaccacttctcaaggtagttcctgccagagcaggacagctctgccagaaagttattcctggtgctgagctgagagccctagggcttttcccatcatccccagcattcccaggtctgctcccctccagaccacacagcacctgccccccagccccccagctgctccccgcaaccaggcacgtgcctctatcacctgctgcctacccagctgccctctacaggacacacacaccccgccccgtccctttctcaatgagtcaaagcaggtctgcagcagcctccaccagcccccgggcttctgaagccacaggcggggggcccaccagccctttggcagccccgcgtcccaggtgactcaccagctggcagcaaacaaagcccaaagtcccctccccacgtgtgcagccacggctcagcctccccctcccaccccggtgtttgtgcactccaagctgtggaagccaagtgcggcccaacacatgtctgtgttcaggctcattgtgtcagaattgactgctggggtctgcttggattcccaactccctcatccagcacattagctattcctcccagcttcctgtcctctacaaatctgctccacatgctgtcgggggccttggccaagccattgattaaaatgaccagaaaggagagggccgaaagcagagtcctgaagctgatctctagacaccctctctactgcccaggacattcagctccttgtcccttcaccaagcccccatctcttcccagatttctggtgccaactgtctcgatgtcacacagacacacaacaccgtgggcattcccctaagcccatccggggaccaaggctggtactggtgatctgttctcaggaaaccttcaatggctgctcagtcacctgggcacacaagtcgtccttttcacgtctgatctagaatgtcaccctggttcagcatcacacacatcagcaaccctgcacccaggcctgtgccagaccttgggttttaaggacctagagccaaactagacttagccttgccttggaggagttccagtctgctgggacaggtggtcacagacagacagtgaagacagaggaaattataacaattgaaatgcagtgcgtacttatcacatgccatgtaccactccaacccaagatttggcctcacagcaaaccggcatcatccccactcatcctcagtggaaactgaggcacacccaggcccagtcacatgcccaagggctcgcagtgagtgagggatgcttacgggagcttcctcgccttgcctagggccagggcagccttcagagggcggtggtgcctgagtggagacttcagagctgagcagcatccacaggacaggaaaggagaagaaggcggggactgggctcccggcactccgtgccagcccgtcctgtgccaggcgctgggtcaggccctggggattcgggttgagcccactagcagggtgctccgtaacaaactgggaagcacagggtgccctggggaagtgggtgagatggctgcagtcagggaaggcttcccagaggcagtgatgtctaagctgacccagggttggggacattgggccagggttggggaagggatggtggatggagagttccaggcgggaggaacatccagtgcaaaggtacttccaggagcagagtggacgaggaggagagcggcccagccccaggggacgcagggcagggaaggagctgggatggttgcggagggcaatggggagtcaccccaaactgggggaggggcatccggcagctgggcagcctgcaggctctcttggctctctctgtagggaggtgcgactacaacttcgacttcgtgggggcgtggtttctaatccctcacctttgtaaccagcgcttggcaaatggcagagctgccctgcacctcccagtgtgagatggggtcaggagtcccacctcaggggttggtgcgagaaccaggggagggtcagtcagcagcctttttctccttccaccgggagcctggcagtctttgcctcccttcccccacccctgcaagtggagcaattaccagattgagacaggctgggccttcccactgcctctgcgggttaatgtctctaatcactgcaatctcttgatacacaatccctgggctctgagtggtggccagatggcttaggagggagttccagcctccagactcccagaggctcttccctggggccctcaaacaccgcaggtgctcccaggagcacccagccaagcgtggtgtgggagagaggtggttgcctattctcccctcaccataaatcacagagccagaaggaatgtttgaagtcatcctcatggaacctcccactctatctggaagcctccatctagcatctcaacaggtggccatccaggatccacctggatgcctccaacaatgggaagctcaccaccacaaatctgaggctcattaccaagggcaggctgtgaactccgagattgaactaaaatggctttacatgggctggatcacattaaaatcatagtcagctgggctgggtggctcacacctgtaatcccagcactttgggaggtgaagacaggaggatcatttgggctcaggagttccagaccagattgggcatcatcaagatacccccatctctactaaaaatttttaaaaattagccaggcatggtgtcgagtgcctgtagtcccagctacttgggaggctgatgtgagagaatcatttgagcctaggaggtcaaggctgcagtgagccatgatcgtgccactgagccccagcctgggcaacagagtgaaaccctgtttcaaagaattaataaaaaataaaatcatagcccaaaccagatcttttcccccaccaccagagttaaaccaggtttgtgccacagacaggcactgtgggagtgggaaccccacaaggttctgaatcagaaatccctgttccaatcttgacattatggttcaccaactggagggcctggccagttgcctccatctccctgtgctccattttccccatctgtaactcagaactattgtattgggctgtccaatacaacagccacgagtcagaggaggcctctgagacccaaaatgcaggcagtgcaactgaggaactgaacttttatttaatttaatttaaaatttaaaacctgaagcaatataaatttttttttgaaacggagtttcactcttgttgctcaggatggagtgcaatggcgtggcctcagctcactgcaacctctgcctcccaggttcaagcgattctcctgcctcagcctcccaagaagctaggattacaggcatgcgccaccacacctggctaattttgtatttttagtagagatggggcttcaccgtgttggtcaggctggtctcgaactcctgacctcaggtgatccacctgtctcagcctcccaaagtgctgggattataggcatgagccaccgtgcctggcctaaaaatttttatattgatgacatattgaaatgataatatttgggataaactaggttaaataaagtattaaacttaatttcaccaaaaaactaatttcacctgtttctttttactttttaatgtgaccactagaaaattctaaattacaaatgtggctcgcagtggaactccacagtgcttcactcagaaggttaaggatccactgggctgggtgttcaggtgtctggggaacagtaaagtcccagagagatgatggcttctgaggctgctgggtcctccaggaggtgtcatctccatcacacaagaagacgggctcaatctagaaagaatagagaatgtgaaggactattcgaaacaaaacaaaaattacttataacacccaaagataataattacatttcctatagagtttgcttgtttccgtgcccgtccacgcgacctggtctcccaccaccactgggcaccagctgcaagttctcagaaaagtcacctttaacagcttgaccttgaagcctgggaccttgaggagcctcagcagggaggaatccctcaaaaagccaaagggcagggccttacacctcctttctgtgcctgtgagctctgagtggaagccacgacctctgcatgcccagctcccattcttcttggcctccgccctcacctgcggtggccctggcactccgggggaggctggcctgcgctgccagctgtcaccagcagttcccgcggctgctcacctctcccttccgccatttgtgggaagggagggaggctccagcacagaacgacttgggtcccaggattctctccatttcgtccatgggtgctctcctgtccagagctgatgggggccccagggtggggtcagggatccctcttgctctgtctaaaacctacactccctcccacatctcaatctgtccctgagttggcgccacccccgtgttaggcctcttcgtccccggtggggggccttctgaggggcctttatcctttcctgaaatccagtcctcacctgcaccccactccacacaatccctcagacacatctatgtgcctagactgcaaatctggagggagtccaccatcccaggaggttccagggctcactgcagagatgcaaacaatctggtaacttgcttttccacttagcattgatttaggaacacccttccagggacacgatcactccggatggctgctataccgtccctttctatctaatctgcattggtgagttcttaggtcaggtttttgatcttacaagtactacttcagtgaccctcccagtacaccatgtgtactttgatcttctcaaatggaaggaatttttcgttctcccttctagacatccagcaaattctgctgcctgagttgtgctgaagtgccacaaggccaccctactcctgagctcagcctatcttctctatcccttctatcaccaatctgtcactaaccctcagatattacctgagctcgggccacatcgaacagcacggtgtctcacactttccagcctcccttctgccttccactgtctcactgctgcgcatgtctgccccatctccaaatcctctcccatttccaagagccaggtcaaatgccacctcctccagggagcccttcctgactttcctagctcgaagtgattcccccttctctgaacaaagacagcatttccttgtccccgcttcccttgcggttctgatgctcccacatagtccaggggccatttgagtgcacttgtggcccagtgtcctttccttctccctccccattccctggcagattaggaactccttgaggtcagggacaggttctgatttcttcctgtgggcacagggcatggcacggagtgggcatgtgcgaaaggtttgaacgcacgtgaatgaaggaggacaggcctgggtctggccctgagttctggcccagccgggcactgctgtcctgtgtgacctcaggcagggcctgctctcgggtacatggcttccctgtggcctgaggcggctggaccccactgcggggggttctgtcatggtgggaggactgtttggccctgggttgacgcaccggccctgcgtgggataatctctcttggatgatgattgcagggcagccccccatttcctctggctgcacaatcccattatgagcccttcaggatttatgtctaagacccaccctaagcccatcactaacatatggcatcctggcagatgaggatgagcagagattgtaaacactcattcattcattcactcactccttcactcagcagtctgctaccaaactgcggacccagcattcaatcagaacctggcccaaccctggaggtgcttccagtaaagagtccgcagtccagtgaggtgggggcagggacagtgggaggcacagggactgtggagccagagaaggaggcttcactcagcctggtggtcagagacggcttcctgcaagaggggatgctcaaagtgtgtcttaccagaagagtaagccattgcgccagcgagcaggcagggcagggccctcacaggcggtggctcccgctgggggagggggccggtgttcacgctcagcctggggctggatgctgctgcatggaatctaatgataagaggagcgtggctggggattatctgctcttgtttacatgattaaaaccagacaaatacttctttatctgaaagaatgaaagggctttggggaaaaatccttttgtcaacaaagcaaagcacaagcatttccttaattaatctcacttcaccccacaccccccaccgtcccacaccccccacaacggctgcaagaagcgttgctctagggctccagggctccagggctccaggacgccagtactctggggctgacctgcactggtaggcagaaagcccaggccagggtggctaggggtggggaggagccgagaggagagagacccacagccctctcaacacagccccctgtgacaaggagcctgggcccaggcacaaacccaagatgtccccattttacagatggagatcctgaggcccaaagatggggaagtgacttgcttgcctgaggccacacagccagttggcagagctgggactaggacctgggtcaccagcccccagcccagcgctctcactcactcctcattagctcgtccaggagcccgcaggaaccgcctgcagtgccgtcctctcgggacccacagggaagtcagactcatccctcctctcacaaacagacaggcagcgtcctgatggagcagccaggggctgtgggggtcctagaatgggctcctcactctgggggagaggcaggtagatctcagaggtagaccaagcttggtcctgcctggctgggcaggggtcaggagagtgaaggaagcttctgagaggacaccaagcatgggaaacttgaggcaacaaagtaaagcacacgcatttccttaattaatctctcactcccccaacagtgtccccaccatcccacagccaccctggcctgggctctctgcctagcagtgcagaggtctcaaggcacagatgtgtgtggcctgcgccccggggcgtgggggagagggcagagcagaaagagaggctggaaggagcacaggactggattgttggaagaatggggttccctggagcactgtgaggcagctggacatggccaggaggggctgagtgagcgctgagtgccagccaggccctggcctccccaccacagcccctgaccccctcgccctcccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggtaactattgccacccacaccccgcttgggaacgccaggcccgagcctgccctgccaggtcccccagaggccaggacggggtgtggagatgggggtgatcacggagtccatgatcaccctggtgggttgagctctgggctgcccgctgggctcatgctgcatcgtctgccccaccaggctagaagcaccttgcagcctggacggggtctgcccctctctgcctgtggatgggcgcagagcagacatctgtgagcatttgctgatgcccagccggtagggtgggaggctggctgttattggcccctccctttgtttattggtcctctttttacagatgaggaaatggggctcaaaaaggtgccgtgacttttccagagtcaccggtaggtaggtagtggagacaggattcaacctagtcctgtctgactccaaggacaatgccctttgccctgtggtgccaccccctagcaatggcagtgccacatcctagccacagcagtgcagctaaccttgcttctcagacctaggctccctctccagggaagcactgcagacccagcggcacagccaccttccactccctttccccgggtcccctgcaggtcacccctgctcctctccttcgtgcattcgctccctcaccagtgccagttctgtgccaggccctggaccaggggactcagagccagcccttgccctggaggagtggtcagacccacgagcagacagggacaacatgggggcctggggctgcaatggggaagctggggctgccggtgagagcaggaagccactgcccttctaagggaggggaagatggggaggcagggagggcaggcctgggggtgatagctgtgcgaaggtcctgagctgcagggaaccgtctggggggagaaggcatagcaccatcagtgtgacacagcagaaggggtgagaggcaggcagaaacccctgctggagaattcaggtggggaccggcctcaaagtgcaccgtgaaccaggccaaaagctaagttgcatcctaaagaccacagaaaatgagttttatacagagaagcggcatgatccaattcagaaggttcaatctgaccagggatcagagttgcaggggaggtaggaggggaaggcagagccagggacagggccaagtggtggccctggggatggggaagggggcagatggcagggctgctcaggagggatccttagcaggaggtgggtgagtaggaggtgaggtgtgctgatcacccagcatgaagatttctggcccacgcatccaagtggatggtggtgtggtcaccaagcgatggatggtctggagcaggtgcaggcatcctggggtaggtgtcaactgatggttggccagtggatgagaatctcatgggggagtctaagctggagacggaggtttggaaatcgccagggagaggtgttaggtgctaccctagtggcagaggggctcttgcaggacaggtggtgagagagcagggattgggatggagcctgggaagccccacccaggaatggtgtgctgggctccacaggctaccccactaagcccgctcagggaacaccttctagtacctctcacttcctggtcaatttcagatctaagaagtctaggcctaacattaaaactccaaactcctgcagtttaaactaagcctgtcttagccttttggatctgactcagactgggaaagctgcagtgggaagagggtcgtggtgagtttgtttctctttcctgctctgcctgctccctggtgagaggtgagggagtgggctaggaagggctgcccagactgggagaggggtgagctggagcaggtgctccctcgttgtgtctctccaggactacttctatgggttctctggagcccctcttctctctcgcatctctcacctgctgtcccctggactcaggcaatttattccatctggctacttacaacatcccctagaccagggctctggttgactcctctgctggggtcacctcacccctctgggtgaccctgttgggtcatgtctggcccatgggaagcatacatatccctattggaagtgctggcctttcccagggcctttggacatgagtcaggcaccagcccctacattcctcaaattctaagagactcaagccaaggtctctgaatagttctcttggcttaaggttgtggagaagcattcctttcctcccccgtggggatagatgcccatacacaggctcccacccactgtctaaagaaactctcgttccctgtatcagctagttactgctgcataacaaaccaacccaacatttatcagcttaaaacaacagccacaagtctataggtcagctggaaagttctgctggtttggactgagctcactcacatgtctgcaggcagctggtggctcaactggggaacagttggtctaggggagtctggctgagatgattcagctatactctgtgatctttgtactccagcaggccagcctagatttgtttcatggtggcgacaggattccaggagagagctagcccaggcattttttttaataacaaaggtagaggagcaagagaggaaatcaaaacatgcaaatgtttctcaagcctctgctttcagcaagtccactaataccctcttggccaaagcaagtcaggtggccaagcccagactcagggtgggaagggaccacaatgttacaagggaaatggagtctacaaaccgaggccatcaatgcaatcagtctaccactcccttcatttctccaggaagatcttcagcttctcttttaccctttagagtgtgtgatgaactaaggatcatcaaatatttgccatgctgttcctatcgcgtggctgtcacctatagggtctggagccagaaagagatccaggcagggtctgttctgtgtttgcttacttggctggcaagacttcatccaataccagggctttgaacaccttctggactctggcacttccgaatttagtctccagcctggaaaactctcacctgagttccagattctcacataaagtgtctagaggtatctcaaaattaacaggcccaagctcaactcttgatttctccataaatctgcccttttctcgccctgcccatcttggtctgacatctctcattctctcataccctgcagccagttcctcagcaaattctgtgagctctaccttgaaaaccaaatcccaagccatggcccttccacctcccctgccactcccgccattgccgcccactccagtgtctggcctggcctccgcttcctctctgcttcctgtcctctgttctcagcactgcagccagaggcatccttttcaaaacctgctctcaacccagcacatggcaacaaagtcgtagcctgcaccgcagcttacaggcacttgctgacacacatcagactctgacctccgccccaactctccctttccctgccctggctccagccccacccgcctcgttgtccttcctgtctgggtgtcattgcctcctctctgggtggccctccctgcagaaagcatgcagctccttccctcactccatttacatctctcctgggtgtcgcctctcctgagacctcccaggctctgcctctctgttgtcttctcttgagtcacttctcctcatagcctttcttactacccaacatgatcatatctacgtgtttcttttcctcccacatccactggaatgtaatatgccctgtgaagcctggctctttaacctccgttccctgctgtatcctggagcctaggacagcacctggcaccgagtgggtgcgcagagtttgctgaatgcacacgtggggtttaaggtcatcagtggcgttggggtctgatccccaggaggaactggaatggtccagggagaatgtgcccagcaagcaggtgcagaggcctaggacgggccttggctcacggccgcactgtgggctttgcacagcaaacagagcaggggcaagcagagaggcaggaggagaactaggagagtgaacatcctaaagacgaggaaagaggaacttcaagaaacctcatttgtaagatctgttatttctaggatctggtaactgtgattcatggtttcttgggtcttatgattcagaacggcttctccacatggtggaaggaggtatcggtgctgcctccttcaccactgcctgcccttactcaggggctgcggggctccagatcagaaacacgtgccacagtcaaatgttccagagtgtttcctgctcttgggttgcttttcacgtggtgaaaactgatcctgctgcttagagccgcaccccccacgccccagccctaccccacccgctctcaacccagaggcaagttgttctgcaaagctgggtgttgggcctcgctctcaccgtttcttggtcagagagcggggctacagggagagaacacaggcgtcctgggacaggaaaccagaacctaggagacctgtggcctcatctccactctgataataataagttactgtgtggccctgggcaggccagttcccctctccaggcctcagtttccccagtgattttcaagatcccgtctagctctgtggttctgaaacacaaaggcctatgagccagtgaggaggctgcagggcatgaaccaaagcttctggaggtgggttctgggagatgaggttgggagggctgggcagagcccaaccttgaagacaggaggcccaggttgaggggctggctgttaggctttgggaatgggaagctggtgggtttgggaaggatggattagagcagggtggagtggacagaaggtgagcagaggcatggatggggtgccctgggaggagcacagtcacttcctttccattcagctccgctgtattcagctgctgctctgggtgaagacattgtgctgggagctgggaagcaagtacaaatgcccctcacgcccccaccccagggctgcccaccatcttaggacagacggacaagtgggtgcactgacagccactcctgatgctctgagaggctgtgaaggagatggggacactggcagtgagggaccaggggcctcctgacccttgccctggcccagaacaggtgcctaccaggtgctgaagactgaacaaaaacactgatgaccaggaagagaactgagaaccagggcaagtgggacaaatggaaagtgggagcccactgcgtggggacataaggcacaccacaggggcaaagatctgcatccttgtctcaaagatgactccagaggaacacaacaggccatgtccctggatgaccctccaagacaggaattcattttccagggctccggggggccgctccagaaggctggcgcctgctcacagtgcagcacgcaaaacagaaacccaagcagagcactaatcaggtctggccccttctcttttttttcgaatcttattaaaacaccacagagattaagtaatgactgggctctatttatagctcccaactaccctctcagggattggaggaagcttccaggagctgtgcttgggaaggaacaattcccacctttagggcttggtttggggacatgttattaggggtgggtttggaagcatctcggtgagaatttgcaagtagcaggtgaagaggggagctgagaggtggactctggctctgcctagaaaacgtgcagggaggcacagggcagagtgtgtgggtatttgataggcatggctattaacgtccccaggcacgttctgtgttttatgtagctgccaccaggagcacggacctcatgggacaagcagaaaagtcttcccgtgaaggctcaaagccaaaagaaaatgtacatttccccatttaataatcaaaggtataattcttgattaaaatctgcaggataaattcattggttattagtatgagcacacacgagtcaggacttgcttttggctgccagatcagcagaggcttaagtaaggtaaggtttgcatttgttcctgaagaacagtccagaagtgggaggtgggcagctggcagtcaccagggtcccaggccctgccctcctgtgtgccgtgccatgcttagcacctggctttcatctgagtctcatggtccatgaaggttgctcaagctctagctattatccccatgttccaggcagaaagaagaaagttggaggaacggaccaaagggtcctggctgaatgggcacctccttaagagttttccaggaatcaccacccaacgacttccactcacctctcgatggccaccccattagcaagagaatcagagcttgatggcaggtcccatttggtccccacaacataataggacttctattaaggaaggacgggagaatggagactgcataggcaactagctgtccctgccaaggcccacatttaaaatgattgtaattgtaaaggaagttgtaaagaaatgtctatataggtataagttccatttggcttcttacgagcttccaaatgttctccgtgtgtgtaaactgagtcttgaaagaggggaagagggttaccgaggacaagagtgagtgggaggcgacccaggtggaggcagtgtgagtgtggggcggcaggttggaggaagagcaggcatgcaacggaagcctcttaccagatgctcacctcagagttggcatttctcacaagacacactcctagaaggggactgtgaagacaaagatacaaatgcttttagagaaaggttgctgccaggaccatgtgagggtgcccatctcaccaaacctcccacattgtgcactgtcatttgaaaaatactttgtcagtttgacaggtggaaatatcttgaatttgttgatgaaactaaacattttaaaaagcatttttggccactgacttttcttcttttgtaacacgaattgcctggtagtatctttccatcgttttcctgtcgggtttttgtggtctattggtttacgcagcaaatatttactgagtgcttggtatgtgccgggaactcttcccggggctggagacacaacagtgaacaaacacagagcttccgccctccagggagctgatattctgatgagaggagatagtgaaggtagaaaccaggccaagatttgtaaaagctcttagtagatttaggatggtagtgcttggtcacgcagtctctccagctcgtcacttgctttgtggttttatttgtattgcaatctgtcttagagagcttctcaagcattcagctttccattttagcatagttttaggtttacggaaaagttgtagacagtacagagagatcccacacacccttcacctggcctcccctgatgttagcggtttacataactagggtacgttagtcaaaactgagaaattaaattggtacaacactattaactaagttacggatctcgtttggattccatcagtttttccacgaatgtcctttttctctgttgcaggatccaatccaggatgctatgttgcgcttagggatttctttattttcatgtagtaaaatctattgatttattgctcattttgttcttagagagtcatttcctatactgagacatgataagatctcaacctatatttcttctagctttttatggtttctttgccttttttttttttttttttttttttttagtcagagtctcactctgtccccaggctggagtgcagtggtgcgatctcagctccctgcaacctccgcctcccgggttcaagcaattctgcagcctcagcctcctgagtagctgggactacaggcgagcaccaccacactcagctaatttttgtattttttagtagagacggggtttcgccatgttggccaggctggtctcaaactcctgacctcaggtgatgtgcccaccttggcctcccaaagtgctgggattacaggcatgaactactgtgcccagctggtttcatttttcaaagacttatttatttctttaaaccttttggaatttattttggtgtaagcatctaacatctattttttccaaaccgttggtcagctgcacagcattctataatgaatccttcgtttcctcactgatttgtgaaacaacttttatcaagtacgaaacacttagaggtgctagtttctgtttctaggctacagcttacatggacttttccatcgactgctgtgtcagtatcacagtttgacagttacttttttttttttttttgagacggtgtcttgctctgccgcccaggctggggtgcagtggcgcgatctcggctcactgcaagctccgccgggttcacgccattctcctgcctcagcctcctgagtagctgggactacaggcacccgccaccgtgcccagctaattttttgtatttttagtagagacggggtttcaccgtggactcgatctccgacctcgtgatccgcccgccttggcctcccaaagtgctgggattacaggcgtgagccaccgttttttatctagtaggaaagactcctccacctttagctttataataaaatatgttactaagaataatgagcccacctatgtgcgaggtcccgtgttaggccccacagataggacatgaacaaccaagtcccacctgcaaggcggccactatatgggggaggcagacaggtgagccagtgaccgcacggtggtgtggcggagcagcagcgacctacacacagaagggccgcagggtctcgtggggcagtcagggagggctggacagaggaagaggtgcttgatctgtggtagatttgagtagttcaccagaccaagaggcaggcagggcattccgggcagagggaacagtgtagacaaatgcctggctctggaaagtatgtggcacagtctgggggcggcaggtgctggcgctgtggagtgtccatgatgtagtgggtgagactgcagaggaggctggcctgaggaaggcccgaccaccaaaggagatgtccagatgaccccaaggccacaacccccagggccctcctgtcctgggctctggaatttttcaattgctgattctcttcctaggaacatgttcccagccaacctagtagaagccacattcaaacaggtgagtgagtctctgggcagtggaggggagggaaggggcagcaggcaggagggcaggcagcagggctagtggcatggctgggaagtgacaggtgtgctggccagtcacgctgtctcctggaggtgggatgctagaggggagggtacgctggggaacctagatccttagagacccccatggccacatccctgtcctgggttccagttttcatgatgaaaaagtgtgggggtggagagaagccttcactgagtgcctgctctgcttccacatacaccatctcgcccatccacacagtaactcggcactgaggtaggatgagccccacttcctgaagaggaaactgaggctccgaggagtcaatgatttgcccaaggttataccactagtaaatgacaaagccagtaggtaaacccaggcctatcttcttagcctgttttctctttctttttaaagtaatcatttttcccctaacaagaataataatgatgttcactgtagaaaattaggaaaataccaaacaatataaagtagaaaacaaaaatcatctctagttctagtacatagtccctggtagcagaggatatatttctggtcttttttcttctgcttatttttaaataatattataatcatagtgcatatacagttttcatcttgctttttttcacttccattatatcctgagcattttccccggttatgaaatatttcttaaaagtacaatgtttagtggtactacaatggcctgtgataaggctgggctgtaatttatttcccactccccctttcagtgttcccttaggttgttttcaaagtttttccttcgtcgaaattgtggtgaatgtccttgtgctcagtctttgcctgccctttgaataatttccaattctttttccctttctaaactgtcagctggttggttgacttaatccagcaagggtttcctgaacccctttcctgggctgggccctgtgttgagcctggggacacaaaggaagtggctgaggtatagagaggaggcttctgaatagggagctgtgaaagctttggcatatcgccgcgtctctcctgacatccatgaaataagccagattgtgaaggggactgaatgctaggctagggagtttctattgtaattgggaatcattgagggtgtgagagataaagagaaagaatgttgctctactctgtaactctctggaatgccctttctcttttggcaaactcctacccatccttcaggactcaagtcaaatgtccccttctttgtgaagctaactctttcagccaattagtcactccctccgcaaggcagaaatcatgtcaggttcatttgtgtatctccagcaaccagcacagagtgttcaacgtgatgatgacgatgatggtagcagtaatgcttccatggggcttaacatgtaccaggaactgttgtaagcactttatatacatcgtctcatttcatttcatgcagtagatgctatcacggtcccattttacagaggaggaaaaggaagcagagacttcaggtctcatatgtttcctgagtggttggccttatcgatgcagtgatgtttgaggggagaggaggctccctttttgggctcccagtacctgagggatgatggggtgagacccatgaatgctctgggggcagagagggaaaggtacgtggctcaggaaggtcattttcttgtgcatgggcttcatctcattaacaaggcttggggcaggctatgcttcttcaaaaagaaggtccaagtttccacctggtgggcagcagggccagcaggccaccaggtggatggatactggatgattgggaggggacagatgggtggataaagggttacttgggtggataaggggctgggcaggcagttaagagggacccagatggggtgatgaggtatagaagtaagaagaggaatgaaggcaggaggcagcgtggctgggtggtgtggtggtagaggaaggagttgcagctttctttgggtaaaatatcgatagcaatccctgctctgcctgcctcacagggttactgtcaatcaaataggataggaatggatacaaatgtgccttcaagatgctattattgttgtcgttaatattagtaacaacccttggccctgacttctctctgggtggggtgtcacccaccagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggtatgtgctgcccacctgcccagcagtgccgtggagccgggcccccagcccctcccagcagcctgctcctccacctcttactgaggtctggggagaatgctggagaggtttactgtgaaaaactggaaatattcaccacacctgtttatttaaatccttcgcctccccaccccaccccaggggcttccccctggcacctccccctcaggcccgtctgggccatttcttaggcccgcagctggcatccctgccacacccttccctttgctgccctcctctgggatgccaggcccctcacctatgcaagccccttggaggcccgcaccttggtttttaaattttgtgttatttttcttaaagatgggtcccaaattatacaagcttcagaccccacaaagcctgtggaaatgtcctgcctgccatccccgactcctccactgggttttcttgtcaaggaaaagacctcaccaacctcgttcatgcaaaaactctaggggtgactttctacctcgtcctctgccttggcccccacctttgcatccggtcgggtctgcccccaaagtcccctccaagccgtgcgtttccttctaccccgcgtcactgcccgggtcaaggccgtgtggtctctcgcctggttcctgtgaaagctgcctagaaaacttccacggctgtccctgctggtgtgtccagctcaggaggtcacaagtctgaccgtgctctgcccattgcccctggaaaggggccgaacccctagtgccggctgaaaagccccgtgagactggcccgtgtgctcctctccgcacaaccctcagcccggctgctcttgccactccccctccacgtttgtcatcttcagggtgctccccacaagtgccatgccctcaggagagtcctccgcagactaggccgagtgccccgagctacactgcctggttactctgtgagcactagactcgattgcaaggatatcattgcttgctgtctgcacagccatgaccagccccatacaggctgacgggcttgtctccatccaccccagagcccaccgctgccgtggctacagcaggcactcagcagacctggtagggagatgggtggacggctgggtgacaatgggtaatggagctcttctcatctgggccaaaacgccaggtgtgcagaggggccggggcctcggtgacccaagtgtgtgaaacgaaaatgtctgaaagtgcctctcggcacatctgacaagcagtccccaaactcagcctttctcagggctgggaacataagagaagggcatctactggcagaacaaaagaaccggagacccttggactcaactcgctgagcgttcgctgcgcatgtgtaactgtccgtgcatctgtgaacatttgtgtgagtgtactgaggcagggcgtatgagggtaccgaggcagggcgtgtgagtgtactgaggtgggacatgtgagtgtaccaagacaaagagtgtgagtgtaccgaggcgggcgtgtgagtgtactgagtgtgcgtgtgagtgtaccgaggcggtgtgtaagtgtaccaaggtagggtgtgtgagtgtaccgaggcagggtgtgtgagtgtactgagacggggtgtatgagtgtactgacactgtgtgagtgtaccaagctggtgtgagtgtaccgagacatggtttgtgagtgtaccaagatgaggagtgtgagtgtaccgaggcaaggtgtgtgagtgtactgaggtggggtgtgtgagtgtactgaggcgggttgtgtgagtgtaccgagtaggcatgggtgtaccgaggcagggtgagtgagtgtgacgagtcagggtgagtgtactgaggcagggtgtgtgagtgtaccgaggtggtgtgtgtgggtgtttcgaggtggtgtgagtgtaccgttgtgagatgtgtgagtgtcctgaggcagtgtgagtgtaacaaggcagtgtgtgtgagtgtaatggggcagtgtgtgtgagtgtaccaaagcggggtgtgcgagtgtaccgaggaggggtgtgtgagtgtaccgaggtggggtgtgcgagtgtaccgaggtggggtgtgcgagtgtaccgaggtggggtgtgtgagtgtaccgaggcagtgcgtgtgggtatgtgagtgtaccaaggcagtgtgagagtaccaagacgatttgtgtgagtgttccgaggcagggtgtgtaagtgtactgaggcggggtgtgtgagtgtactgcggcagtgtgtgtgagtgtaacgaggtggtgtgtgtgagtgtaccaaggtggtgtgtgtgagtgtaccgaggcgggttttgtgaatgtaccaaggtggggtgtgtgagtggacaaaggcagggtatctgagtggactgaggtggtgtgtgtgagtggaccaaggtgcggtgtgggagtgtaccggtgcagggtgtgtgagtggactgaggtggggtgtgtgaatgtattgaggcagtctgagtgtaccaaggcaaagtgtgtgagtgtactgaggcggggtatggcagtgtaccgaggtgatgtgagtgtactgaggcgggtgtgtgagcgtactgaagcaaagtgtgtgagtataccaaggcagtgtgtgagtgtaccaaggcaatgtgtgtgagtgtaccgaggtggtatgtatgagtgtacacaggcaaggcatgtgagtgtaccgaggcaagtcgtgtgagtgtaccgaggaaaggtgtgtgagtgtaccgagacgggttgtgtgagtgtaccgaggcaggttgtgtgagtgtactgaggtggtatgtgtatgtgtattgaggcagtgtgtgtgagtataccaaggttgggtgtgcgagtgtaccgaggtggtgtgtgtgaatgtaccgaggcagcgtttgtgagtgcaccaaggcagtgtgtatgagtggaccgaggtgggacgtgtgagtgtactgaaacaagacgtgtgagtgtactgaggcggggtgtgtgagtgtaccgaggtggggcgtgtgagtgtactgagttgggttgtgtgagtgtactgaggcggggtgtgtatgtgtactgaggcggtgtgtgtgagtgtaccaaggttgggtgtgcaagtgtaccgaggcggtgcgtgtgagtgtagcgaggcaggttgtatgagtgtaccaaggtggggtgtgtgagtataccaaggtggggtgtgtgaatgtactgaggtggtgtgtgtgggtgtatgtggatgtgtgagtgttctgaggcggggtgtatgagtgtgtcgaggtggtgtatgtgaaggtatcaaggtgggggtgtgtgagtgtacagagaggcaaggtgtgtgtgtaccaaggtggtgtgagtgtaccaagacaaggtgtgtgagtgtactcagatggagtgtgtgagtgtactgagatggtgtgagtataacgaggtggtgtggtgtgtgaatgtacagaggcatggtttctgagtgtactgagttggggtgtgtgaatgtaccaaggcaatgcgagtgtaccaaggtggtatgtgtgagtgtactgaggcagggtgtgtgagtgtaccaaggtggggtgtgtaagtgtaccgagatggtgtgtgtgtgtactgagacagggtgtgtgccaaggtaaggtgtgtgtgtaacaaggaggggtgtgagtgtaccgaggtggtgtgtgtgagtgtaccgaggcagtgtgagtgtactgaggcaaggtgtgtgagtgtactcagacggggtgtgtgagtgtaccaaggtggtgtgagtatactgaggcaatgggtatgagtgtactgaggtggtatgtgtcagtgtaccgaggcaaagtgagggtattgtggtggggtgtgtgagtgtaccaaggtggtgtgagtgagtgtactgaggcggttgagtgtactgaggcgaggtgtgtgagtgtaccgaggcaggttgtgtgagtataccgaggcgggctgtgtgagcatactgaggtggtgtgtgtcagtctatcaaggcagggtatgtgtgtgtaccgaggcggtatgtgaggtactgaggcagtgtgagcgtaccgaggtggtgtgtgtcagtctatcaaggcggggtatgtgtgtgtaccgagacggtatgtgaggtactgaggcagtgtgagtgtaccgaggaggggtgtgtgagtgtaccaaggtggagtgattatactgaggcagtgtgagtgtaccgaggcggtgtgtgagtgtactgaggcggtgtgtatgagtgtaccaaggcaggttatgtgagtgtaccaagactctgtgagtgtaccgaggcggcgtgtgtctgtaccgagatggtatgtgtgagcctaccgaggcggtatgtgtgcatgtaccgaggcggggtgtgtgagtgtacagaggtgggttgtgagtgtacagaggcagggtgtgagtgttttgaggcagtgtaagtgtaatgagaggtggtgtgtgagtgcgaggcaggatgagtgtactgaggcagggtatgtgagtgtaccaaggcagtgtgagtgtaatgaggtggagtgagtgtactacggtggtgtgggtgtaccgaggcagtgtgagtgtaatgaggcagagtgtgtaagtgtaccaaggcggtgtgagtgtaccaaggcagggtgtgtgagtgtactgaagcaggttgtgtgactgtaccgaagaaagttgtgtgagtgtactgaggcaatgtgagtgtatcgaggcggtatgtgtgagtgtaccgaggccagttatgtgagtgtactgaggtggtatgagtgtactcaggcagagtgagtgtaccgaggtggtgtgtgtgaacgtactgaggtggtatgtgtgagtgtactgaggcggtgtgtatgtgtgtaccgaggcagggtgtgtgagtatgctgaggtggatggtgtgagtgtactgaggcagggcatatgagtgttctgaggcagtttgagtgtaacaagggtgatgtgtgaatgcattgaggcagggtgagtgtaccaaggcagggtgtgtgagtgtactgaggcggtgtgagtgtaacaaggtggagtgtgtgagtgtaccaaggtggtgtgaccgtatgtgtgtaccaaggtggggtgtgtgagtgtagcaaggcgggttttggtacgagtggagtgtgtgtgtgtaccgagacagggtgtgtgagcctaccaaggcagtgtgagtgtaccgaggcagggtgagtatactgaggcggggcatgtgagtgtaccaaggtggggcatgtttgtgtattgaggcagtgcatgtgagtgtacagaggcggggtgtgtgagtttaccaagacgtggtgtgtgtactgaggtgtgagtgtaccgaggcaaagtgagtgtaccaaggtagggtgtgtgagtgtaccaaggcaaaatgtgtgagtgtacggaggcagggtatgtgagtgtaccgaggcagggtttgtgagtgtaccgaggtggtgtgagtgtaccgagttgtggtgtgtgagtgtaccgaggtggggtgagtataccaaggtgggggtgtgtgagtgtattgaagcaagggtgtgtgagtgtaccgatgcagtatttgtgatagtaccaaggtgggttgtgtgaatgtactgaggcggagtgtgtgagtgtactgaggcggtgtgtgtgagtgtactgaggtgctgtgtgtgagtgtaccaaggcactgtgtgtgactgtaccaaggcaggtggtgtgggtgtactgtggtgggttgtgtgagtgtactgaggcagagcgagtgtactgaggtgggatgtgtgagtgcttggaggcagggtttgtgagtgtaccgaggcgaggtgtttgagtgtaccgaggcagtatgtgtgagtgtgccaaggtggtgtgcgtgattgtaccaaggcgggttttgtgattgtaccaaggcagggtgtgtgagtgtaccgaggtggggtgtgtgagtgtactgaggcaggttctgagtgtgccaaggcactgtgtgtgagtgtaccgaggtggtgtgtgtgattgtaccaaggtgggttgtgtgagtgttccgaggcagtgtgtgtgagtgtaccgagggggtgtgtgtgagtacacggaggcaggttgtgtgagtgcaccaaggcagtgtgtgagggtaccgaggtgggttgtgtgagtgtaccaaggcggggtgtgtgagtgtaccgagaaaaaatgagtgtaccgaggcagggtgcgtgagtgtactgaggcagggtgtgtgaatgttctgaggtggtatctgtgagtgtactgaggtggggcatgtgagtctaccaaggcggggcgtgtaggtgtactgaggcgggttctgtgagtgtgccgaggcagtgtgtgtgagcgtactgaggcagtgcgtgtgattgtaccgaggcaggttgagtgcaccaagacagtgtgtgtgagggtaccaaggtgggttgtgtgagtgtactgaggcggggtgtgtgagtgtaccgaggcaggttatgtgagtgtaccgaggtggtgtatgtgagtgtactgagggggtgtgtgtgagtgtaccgaggcaggtcgtgtgagtgtatcgaggcaaagtgagcgtactgaggcagggtgtgtgagtgttctgaggtggtatctgtgagtgtattgaggcagggtgtgtcaatgttctgaggcagtatctgtgagtgtaccaaggctgggtgtgtgaatgtatcaaggcggggtatgtgagtgtaccaaggcactgtgtgtgagtgtattgaggcggtgtgtgtgtgtactgaggcagtgtgtgtggatgtgtgagtgtaccgaagtggtatgtgtactgaagtggtgtgtaagtttaccaaggcagggtgtgtgagtgtatcgaagtggagtgtgtgagtgtactgaggcatggggtgtgagtgtactgagctggggtttatgtgcgtgtgagtgtaccgaggtggagtgtgtgagtgtgctaaggtggggtgtgtaattgtaatgaagcaaggtgtgtgagtgtaccgaggcagggtgtgtgagtgtaccgaggcgaggcgtgtgagtgtacctaggcgggatgtgtgagtgtaccaaggtggtgtgagtgtactgagacagggtgtgtgagtgtaccaagatggggtgagtttaccgagacagtgtgagtgtaccgagtcggtgtgtgtgagtgtacagatgcatggtttgagtgtaccaaggcagggtgtgtgagtgtatcgaggctaggcgcgtgaaagtaacaacgtggggcatgtgggtgtaccgaggtggtgtgtgtgagtgtaccaaggcggggtgaatgtactgaggtggggtgtgtgagtgtaatgaggtgggggggtgtgagcataccaaggcagtgtgagtgtaccgaggcagttgagtgtaccgaggcgagttgtgtgagtgtactgaggtggagtgagtgtactgaggcggggtgtgtgtgtaccaaggtggtgtgtgtgaatgcaccgaggtggtgtgactgtaccaaggcagtttgtgtgagtgtaccgaggcgggttgtgtgagtgtaccgaggcgatgtgaatgtaccaaggtggtgtgagtgtactgaggtggtgtgtgtgagtgtaccgaggcagtgtgtgtgagtgtaccaagtcggggtgaatgtaccgaggtggggtgtgtgagtgtaacaaggtggagtgagtgtaccgaggcagttgagtgtaccgaggcaagttgtgtgtgtgtaccgaggcagggtgtgtgagtgtattgagctggggtgtgtgagtgtacctaggcaggttgtgtgagtgtactgaggcgggtttaagtgtaccaaggcagtgtgtgtgtaacgaggcggggtgtgtgagtgtatcgaggcagggtgagtgtaccaaggcgagttgagtgtaccgaggcggtgtgagtgtaacgaggcagagtgtgtgagtgtaccgaggcggtgtgaatgtactgaggcaaggtgtgtgagtgtaccaaggcggggtgtgtgagtgtaccaaggcagggtgtgtgagtgtaccaaggcagggtgtggcttactgtgtatgctcatgcctttatgtgcccacatctgccagtgcctgtgtctgtgtgcacgtgcatctctgtgtccctgcatcagtgtgtgcctggcctctccgtgcctgtgtctgtgtgcacctgtgtccctgtgttcccccatcagcatgcgcctggcttacctgtgcctgtgtctatgtgcacctgcgtctgtgtgtgctcatgcctgcgtgtgcccacatctgcctgtgctcatgtctgggtgcagctgcattcctgtgtccccgcatcagcgtgtgcctggtctttccgtgcctgtgtctgtgtgcacctgcttctgtgtgtgcctgtgcctgtcagtgtccacatctgccggtgcctgtgcctgttggtgcagataccagtgtctgcccgcgtgtgtgagtgagcacactagcacagcggctccgagcagggctttctttggttccctcaacccagcctcctttccccaccccatccctgggatgtggctggtgctaaggtcctgctggccctgccgtgagggagcccccgtgccacactagggttccatgcacactggctcccagcagccagtcctcggatgcccctgggaaaatccaaatgggcctgaggaggggcaggaagcccgtgcgtggtggtggtggagcccggggagggcggagccggcaggggagtctgggtctgcatcagccaggcggcaggaagacaggcgggcggggtaggcccagggtcacctccaactccagcctctcctgcccaccctggcagggccctcacctcactccgtcaccacggggtagctgctccatggactgtgtggctcaggcttctcaggacagggaaagagcccttctctggtgtcccacaggccagggtttgaatcccaccctgcctccctagctgagccccagcaccatgacagtgggcctcatgagggcagctgtagagagtgctctgctccccacgtcggtctcaccaggaggtagggcagccactcagtccctgtttcaggactggcctgacagagctcaccccacggagccgttcccacaccaccctttcctggtgtgtgcgagctggggaggaaggcctagaatgccgggggaggcgccaggagcatcaggaaaggccctagtcctcactcaccattgaccactgtgcgtctaacatgctccagctaaggagatgcagttcttgctctcgctgagctaacctcgcagaggagacgggaaaaaacccagacagttatgttgtaataggccctaagaggtgagatattgaagaataaatgggagtttgcaaaggggatcggggatggcttccaagctgtttggagagcgggcagccagtgcctggggcactgcgtaaacggcttgcgcaaaggccctgaggcagtgaagagctggactccctccttccagaaacttaaagaaggccagtggtgccagggcacagtgagatgggcaggagcaggagggagaggcaggcagggcccactcgagtggggctgaggcatcgagctgggtgaggcagcggggagcttgtcatggcctaagcgcacagcgaagccaggggtgcacttggcagggagcacttttatcctgaggaggtgacattggctgctgcgtggaggaaggtgagagaggaggaagcgtgagagcactgtgggatcggtagtagagtggaggaggagagagggagagagagagtggggggagtggggggagtgctggagcatcaaggctgctgggaagccagccatgctgagacccatgtgggcctgtgggtctgtccctgctttaccacagcactgtgtccctgacccgcaggcatcatgctgggccgcatgggtgacagcggggcccccctggtcagcttctgccagtgcctcaatgagtcggtcatgaagatcgtggcggtggctgtgtggtaagcctcctcatttacccacctcaccccggccagccctgggtggatggagggaagacaagaccccaccctcttctcccgtaaagtgagcagaaagctgtgcccaggctcagccctgggccggggcctccggagctacatgtgtttccatgggtcccccagccccagccaggcctggctccggccctgggcctgccccttccagcctggtctaagagctctgcccggctctgctgctctcctgggctcagtttctccatcacatggagccttatcagctcagcttttggagaaaggaaagctggcggtaaggactagcccacagttcagagtcctcggcccacagttcagagtccaggagctcagtggggaacgcagagggagggctgcccaggcgcactgtgtagactctggcgttgttgggcctgaaatgggggcctcctgaaggcaggtcgggggaaggagtggcagaggttgtctggagctggggcggtggaagtaacggtatgaaggacgccatgtgctgagcctgggccgggcaccttggcacagtctcgctctgtcctcgcaggagccccaggaagctcagggggaaggccgcgcagcgatgcggggctggggccggggtgtgtctgcctgcctggttcctgagcctggctgccccgccgcccccaggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccaggtagccccggggacgggcaggacggtggggagctgggaggggctgagccctgtccgtctgtccagccatcattggttcatagccacagaaccaccaaaacgccagtgtggcccacctcacaaatgcggggacggctggtgctggggtaacaagactgacgtgggggacttttggcctttgtcgaggcctctccttcccccacggccccagtcctcaagctcactgagtccgcatgggggcggcctcgacgcgccagggcagacagcacagtagagtcagtgggaaatcacattggcaacgcactgctgctgccttttgccccacaaggtgcttctcctggagtcgggccctgtgttgctctaggagctcggcctgtccactgccgctgggatgtcctggctgggtgccctgtcacaaccttggcagtgtccctagacctcagggacttgagccatggctctgtcactcactcgctgtgcctgggcattgctttcctcatgcacagactgggggagactccagcttccagctcacagggttgcagtggaggtcgagcccctccttgccaggctgggccaggtgaaccagcacttggccttaaggatcccaaacctcagcccagtgcagagacctcaggaatttagagttgtgcaaaccatgtcgttggtggagggggcaggaaggaagtggtcccttatggagcatctagtgctgtgaaggcagtttggctctccccatggcaagtgtctgagctccacattaagggagtcgcaggaacttaagccacatctttctggcactgaaggcctcactcttccctctagccctcacttgggtctcagtttttccatctgtaaaatgccctgcaggcctctgtacccagcagtcatatgacacccacccctggcagcagatgcacctcctgcaggattcaggagcagaccccagtgaagaaaagcccaggagccattgccaggaacaccctcccgcagatagggggtcagagggcaggacaaagccccaaacatgccagctcccatgccaggggccaagccagccagagccagcagccccctggccatctcctgccagcaggaaccgcagcctcaagcccagcaggtctggagctcctgagaggctctggcgagtagaaccggccttccaggcagaggcccgggggagaggaagacacaggggccacaccggcctgttttagtcccagcactgccactgggaactctcatgacaaacatagtaataataatagtcatggtcaccattgactgagtgggtacaatgggccaggtgctgtccaagcccgtagtcgtttaatcctcctagtagctctgtgacccaggtctttttgggacaaagatgctgaggcacagggttcaggaacttgccaggaccacttgacaggaggctggaatctaagcccagacagcctggcccagggccctgctgctcagacctccatatccctcggcacagcagtgtgacatgggtcagccccgccctctgggcgtcagcttcctcatctgtaaaatgcacccaaacacctccctcataggaagaaccaagtgagagcactgcagtgcccgcggtccttacctcctgccggagcagcgctgcagaggcacaaacactcctggcggggtggctgcctggggaggggtgagcttcccgacagaggccccagccatcctggaggagggtgctgggcagacaccggcccctctaaccgtagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcaggtgcaccctgacactgcacctgggtggatggggcgggggctgggggccttggggattcccaggctcccagacttgaggggtatctgaagcgagcgagcctgggctcggagcacagcaggcagagggccagggctgggagctccgagcctggaggacagcccgggagggagggcattgctggtggccacagggcgagcggaggccagggacaggactcaggaccttggagaggccgcccgtgtggcaggagccaacgaaggggtgctgggatgcggctgaggctgacggaggcctcacagcccagccaagcacacaggtctgaccctggaggccaggccccagaggcaggcaggcagagccatgtggtggtcagtcagagtccctgggcagccccatagcaatatagcttcctggaacccacagaggcacagctccagacacaggtgtttgcacagttcccagggattctcctgaggccaggaatgggggtccatggggctgcaggactgtgaggagggacttgaccccgagagctccctggtgtggcattcctacccaccccccgcaccaaatggctgtcccagaggccctgacactcaacctcttccttggagccagaccctgacaatgcaccctgcccctcctgctgctcctcttccccttcccaccccctgcagtatcacagccactgcagccagcattggggcagctggcatcccccaggccggcctcgtcaccatggtcatcgtgctcacctccgtgggactgcccaccgatgacatcaccctcatcattgccgttgactgggctctgtgagtggactttgcctctagctctagccctctgggaggggctgacttcagggtcagcagggatcagggtgagcggctgagtcccttccccagggtagaaggctggggactgccccgcttggcactgtgggagtgccctactcattagcacaggcctggctgcataatttgtggggtccagtgttcaaaaatgaaaatgtggaacccagtccaaaaactgtaaaggccaggcatgatgactcacgcctatatgtcccagaactttgagaggccatggcaggagcattccttgagcccaggaattccagagcccagcctgggcaacacagtaaaatccccatctctactaaaaattagaaaagaaaaaattagctgggactggtgacatgtgcctgtaatctcagctattcaggtggctgaggcacgagaattacctgaacctgggagatggaggtttcagtaagccgagatggcgccactgcactccagcctgagtgacagagcaagactctgtctcaaaaaacaaacaaacaaacaaacaaacaaaaaacaaacctataaagaatttcaagacagaaacagcagaggattaaaccaaacctaacccttctaagcatggggacctgtggaacccacagctgcatgccaagaagctgcttcaatgatgccaaagggtgggcttgggaggagccaggaagccatctggctgcaggctttgcatgacagctggtcaccggccgtgctgtactgtgctgggttgagcactgccctcttccagctccccttcaagtgcccaccactcacccccaaccttggctcaccagggaccgtttccgcaccatgattaacgtgctgggtgatgcgctggcagcggggatcatggcccatatatgtcggaaggattttgcccgggacacaggcaccgaggtgagagcagtgagatccagaggctgccaggagggtggagccacgcagggtgggcagggcaccagatcttccaccaaccagctcggcagcctccagccaatccctccctccatgcctctgggcctcggtctcctcatccgttacagaatgactgattcctctaacatctatttattgagcacccgctgtggctggcgctgatatagacacaggaggaacagtagaacaagatatgataaaattccccgccctcgtgtcgggatggtctgtccagtttagccaacatgtgagcatttgtaggtctgtgcaggctgtgtgggcttcaggctccttctacaggcaaatggagaaggctgtccccacatcatggggaagaagctgaggtcaggcaggggatccaccaattccccagatggaccctgtggattaagtcccctcctctactaagccagctccagtgggaggcaggacgcttgggaacaggagcccagggaggccgtgacctgccgaggtcacacagcgtgtctgcaggaaaatccatcttgtggttcctagccctgagctcattctgccccactggccctcagtcctccctcgtatctaaccttggtccctcctgctgctacaaagacctgtttcccttcaccagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagcgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatttcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttcacttcttgtgggcttcaacaccttatgctagccagcaaatatgatattagctactgggctaattaatacaggcggccagagtgcagacgggcctgtctgggcagccaggatatgggcgggcctatgcaggtggccagaatctaacaggcttgtccatttggctggagtgtagacaggtctgtctaggctgccagtgtgtggacaggcctgtatgggcagccagagtgcagagaagcctgtcctggtggctgcagtaaggacagtcctatctgagctgtcacatgcagaagacagagtataagctagcctacccaggagcctgtctcaataaccacagggcagctgggcatcgtccagtgtggacagacctctctgccatggtctaggctctgctctgcaggcagggccttgagatcagtccccaaagaagaaacagatttccttcccagtctggctccccgtggtgaatgctttgctttagacaggggcgtgcccagggacatttccagatggtctccctcattctcacaccccaggctgcctccaggaggcctgcagggcacacagaagggccctggcaacacagcctgttccagatatgccttggggagaagatacagctctggggtctggaggggcttgcaccatgatgcccttgaagacactaaggcccagggaggggacaggcctcccccaggtcactcagcgtcaagagggcacctgctcccactgccccattcctgaactccttccaccctcctcccaggggtggagtgtgaggagtctgggaagagcacgaccccaggacacctcctcccactgcagggctgggggctgcaggcctccacgagagcatccttccttccctgaggcctcctcacctgggagaggtcagatgtcatgcaatcggtcatcccaccttcatgcagacaagcttagcagccccttctaggtgtcacatctctaagaccccttgagcaatcgagtctgtcccagcacaaggcaggagtctgctctttagtggacttggcaggagcatccttacacacctccagcagcagggaggtcaccacttcccgagcatctcaacccacagtggggcagctctgcccatcagaggctcttcttagctcagagctgggtaccacctcccggtggcagctctcccactggggtgggaagcacactgggtgcatctgttagctctttcctggaaaggtctgcggagacctgggcccccaagtcggctctgctccagctcccaggcctgcctccagtcccctgctctcctctagaaccc

SEQ ID NO: 12616 - DNA, 22303 bp, Human
atgttgccaggctggtctagaactcctggcctcaagcaatcctccagccttggcctcccaaagtgttgggattgcaggcgtaagcctccatgccctgccttacgtgcattaattacaatacacagaattacaaaacaaaaagcaatgatattgaaatggcatcaaaatgctttaaaaacaaatttctgctatactagtatagatgcttattttcaatgcatgaaataacaagaccctatcataatttcttttcttttctttttttttttttgagacagtctctcactctgtcctcaggcgtgacctcggctcactgcaatttccgcctcccggattcaagcgattctcctgcctcagcctcccctggagctgggactacagacgcatgccaccaagcccagctaatttttgtatttttagtagagacagggtttcaccatgttggccaggatggtctggatcttttgaccttgtgatccgcccgcctcggcctcccgaagtgctgggattacagccgtgagccaccgcgcccggccgactctatcataatttcaaagcagtaataaatgtaagtgacagcttaagataccaccttgtagttgctgcacaaactgggtttttttgcgtctcactctgtcaccaggctggagtggggtggtacaatctcggctcaatgcaacctctgcctcccgggtttaagccatgctcatgcctcagcctcccaagtagctgggattacaggaacgcgccactactccaggccaatttttatattttcagtagggacggggttttgccatcctgtccaggctggtctcgaactcctgacctcacgtgatcctctcgcctcagactcccaaagtgctgaggttacaggtgtgagccaccatgcctggccctgcacaaactgttatctggaactatcatttacactcaccctcacagtttcaggcactgctaaggctgctccagcaatcaggaaaggaaatgctatacttcacatagagaaaaataggggtgcattttgttcctacacaagctcattaccccaccctggttaaaaaaaaccctgaattaggctgtatagtggctcatgcctgcaattccagcactttgggaggcccaggcaggaggatcgctttgggcttggggccaggagttcgagaccagcctgggcaacatagcaagacccgccacccgcccccccaaccccgccgtctctacaaaaattaaaaataaaattttaaaaattagccaagtgtggtggtgcagcgtctgtagttccagctactcgggaggctgaggtgggaggatcgcttgagtctgagaagttgactgcagtgagctatgatcgtacccctgtactccagcctgggccacagagcgagaaaaaaccctgaattagagacacgctgcggccgtccttcctcggagagacccgcccctcctcagaggcccacccggaccctcaggccaacgccgacccctctccacacggacttctgcagcctcagtttccctcctcagacgcccccggctccaatcccggctcgggcacttccttcccctctggcgtgtcttggcccgggtcccggggctcctgcgaggatcacacaggaactcacttgaagtgtccggcgcagtgcactccgacggggagccctgcccggtccccgcggcgaaccagtctcttcctcgggtccccctctccccaagcgcgcaggcgcaatccgcgtcgccgactcacgcggctggtttcaggtttctggcgaggccggtgttcggctggcggctagctgggactagcggaacggcggagtctcgattggcagtgcctggacaggcgcaagggccggcgcgggctccgggcgctcccggcatccctctgcggcgtcggcggcggcggcgaggcgaagcgaaggaggagtgtgtagcgcgggccggcggcgggtaaaggcgagaaggctgcaggagatccaggcggagcccagcccatggagtcgtctccgacgacatgcaggaaatcatcgccagcgtggaccacatcaagtttgacttggagatcgcggtggagcagcagctgggggcgcagccgctgcccttccccggcatggacagtgagcgcggggcccgggcgggagggcaagagcgactcgaacccgggacccgctcctctgtgatcccgggactccctcgcctcggtcctgagacctcccccggcttcctctggatcctgggacccctcccctttggtcgcaggactcctccctctaggtcttgagagtccctcccacctcctccgggtcctgggatcctcccctttagttaccgaactccctcatctgtggtcccgagactcttcccactccatcctgagacctcctcttctggatcccgggacgctccccttggtttcaggactcctgactcccaggcccccatttccaccgtctggggactccttttaccctcactcggactcaggagttcactgcctcggatctttggccctctgcggctgttcaaaggtaatctgtaggagggtagaccttgtctgttcgcttaattcttgaataagggtgggttatcctggattggaactctccctcaacactctcccaactgcaggagagtactaggatatcacacccgctacgttgagcgtctcttcttgatttcatcaaaactaggcggttggaggagatgtgctgagggaaggaccacctttctgtaggagaccccagctagactctcaaactcccttctaggactcactctcctgggagctcatccctagtttttggcccgtccctacttttttctggaccccaactctgagttattcatcacacccagcagctggtgtggacccttggcctgaactcccttcactgctccccttcatatggtggctcctggcttcccacctcctactcggtgggatatcttgtactttaaaagaaaccagtagttttctttgtgtcttctttcctatctggacatacttgaaatctaatgctataaccttaaagtttgggggcttgtggaagtcactgagttcaatccacagatggggaaactgagacccaagcgggggaagggacttgctgacaatcactcagtgcatagcagaggcgggcaagctctccagtgttgtgtgctgtcgcccacaactaccagcggggtctcccaccgctcccagcagcctcactcccctcaggcggtcacaccttctcatgcacatgtgacctctgagtctgtccctttatgtgtttttgttgttgttgtttgtttgcttttgagacaggggcccctctgtcgcccaggctgggtgcagtgacgcaatcatggctcaatgcagcctcgacttcccaggctccagcaatcctcccacctcagtctcccaagtagctgggaccacaggcatgcaccaacacgcctggcaaatttttttgtgtgtatttcttggtagagacactatttcatcatgtttcccagggttggtcttgaactcctgggctcaagtgatccttttacctcggccttcggaagtactgggattataggcatgagccactgcacctggcatatatatatatatatatatttttttttttttttttttcctgcctgtcccacaactttacatggtgatagttctgtacaagatagtttcattggaaattaattaagtcttcaagaagacaagatagtgcttataaggagacatcatcagaccaccctatttgacacaggcacaaacaccatcaccactgtacactccctaaaaagcagctgctcaaattcacacacacacaccccctcttacctacccctcgactcttgtgatcatccctgcacatgtggccttttcctgtcttttttttttttttttttttgagacagagttttgcttttgtcacccaggctggagtgcaatggtgcgatctcggctcactgcaacctccacctcccaggttcaagcagttctgctgccttggcctcctgagtagctgggattataggcgcccaccaccacgcccaactaatttttgtatttttagtagagatgaggtttcaccatgttggccaggctggtcttgaactcctgaccttaaatgatccacctgcctcggcctcccaaagtgctgggattacgggcataagccactgtgcccagccggccttttcctgtcttgatggcactagcttgagaccatggaaccacccacgcagggcagctcttttcctcccacccttctgccatctgacacatccacaagcctgtgaggggaggtacagtggcgaggggcccacatacctgttcctgaggcccgggacacacctagccatgggtgttgctccagccagggcttcagagtcggtaggcaccctccacactcgctgcttgtccatatcctgttcagttaaagcctagtgaggccacagcccttcctcacccatccctcctcttcatccccatctgagttttgggaagaactgtcactttgcccataaggcatactcatcctatccacatgagactcagttcccagaactgtgtatttctgagcagaagcaactctaacctctaaagagagagaccagaagtactttcagaattttttttttctttttttttgagacagagtcttgctctgttacccaggctggagcacagtgacgcgatcttggctcactgcaacctctgcctctgggttcaagtgattctcctgcctcagcctcccaggtagctgggattacaggcacgtgccaccatgtctgactaatttttgcatttttagtagagatggggtttcaccatattggccaggctggtcttgaactcctgatgtcaagtgatccacccgcctcagcctcccaaagtgctaggattacagacgtgagtcaccgcacctggccactttcagactttttgagatgcaaatggagtgacctccctgtgacagccataagttctataacctcagctgtgtcctagcaaaatctgcttgcttccaagaagccaaggaatcttttgtgatttagcaaggggaggcatgttaagtgggcttcagagatgctgtcattggtttttcagcaattctaaaatggttacttgtagaggaaactgtttctgatgccaaggtcagtttagtctggcagctggggctggtgaattcctggactcatcagaacagctggtccctggagcccactgaattccagcacactccgactgtgggaatgaaaggctgtgctttttttttcttttcttttcttttttattaacaagcaacataatcggccgggcgttgtggctcacacctgtaatcccagcactttgggaggccgaggcgggcggatcacgaggtcaggagatcgagaccatcctggctaacacggtgaaaccccgtctctactaaaaatacaaaaaattagctgggcaaggtggcgggtgcctgtagtcccagctactcgggaggctgaggcaggagaatggtgtgaaccccggtggggcagagcctgcagtgagccgagatcacaccactgcactccagcctgggcaacagcgagactccgtctcaaaaaaaaaaaaaaaaaaaacaaaaaacaagcaatataatcaaaaacaaaaacacaacaaccttaaagctgaaacagcaataagtcaaactgccgcggcagttcacagttttacctggggtacctgctccctcattgcaaggcaagactgcatttagtatatatgtgaccaagaagaatgagagaagtggaaaacactggagaacagaaagtatcaagaacctttcatcaggcaatgccaaagcgctctgctcttttcctcttctttgcctctgtatcctctgtggttccagttccagctgaacttgtgacaatcccaaatcgctccttcctctttttcagtttcttatcatcttcagactttctggaaattgaagagacattcaaaccaaatctttgagctctttccttcggcttatccaagttaaccataggtgtgttcagatgacagacttttgttggaactgaagaaatcccaaacctagctgcctgagcagctttcttactctccaagctcacaggtacactgaattgttcggccctcttctgcattctctcagcctgtggtatttcagatgtaattttcaccactttcttctctgctgccacatcaacagtttttttcagggggttcttcctatttgacaaggggtttttttcttcttctgtttcatctcctagtacatcttcatttgcctcctcttcagcatgttcttcaagatatgcctggagtctgtggataagatcttgctttattcccttggtctccaaaccacaagaagacattcttgctttagtttagcaagcttcagcttatggagctccaccatctcagttaccatcttgttacccctccgggtgtgctcttttaataattgtatgtggggtggggtgcggtggctcaatcctagcactttgggaagccaaggcaggcggatcacgaggtcaggagttcgagaccagcctgtaataattgtatgtgggccaggtgtggtggctcacgtctataatcccagcactttgggaggccaaggtaggtggatcacttgaagccagtagtttgggaccagcctggccaacatggcaaaaccctatctctactaaaaatacaaaaaaattgggcaggcatgatggtacacctataattccagctactcaggaagctgaggcaggagaatctcttgaaccaaggaggcagaggttacggtgagccaagatcgcaccaccacactctagcctgggcgacagagcgagactctgtctcaaaaaaatagaaaaaaaaaattgtgtacggatgttgcatattaaaagcagtcctctgtttctgcacttaatgtgcttccccctggactagcatctcagaggcactgcctcttccttgaagcctgaccctcctcagaggccctgattgtctgtacgtctgtgagatcattccttccctctgcctcatgttaaggtatctgtgaattcgccctcctggaggaaggtgtgagctaggggccgttaatttattcctgtgtgtcaggcactttggctcaacgcctgtaatcccagcactttgggaggccgaggtgggtggatcacctgaagtcaagagttcgagaccagcctggccaacatggtgaaaccccgtctctactaaaaatacaaaaattagccaagcgtggtggcaggcacctgtaatcccagctacttgggaggctgaggcaagagaattgcttgaacctgggaggcagagattgcagtgagccaagatcgcgtcattgcactccagcccaggcaactagagcgaaaccccatctcaaaaaaaaaaaaattatttctgtgatctcgtactccagccttcctttccccacccactcttaactccttgaaaggatcttatatacaggaggctctcaaagcactgggtaatgactgttctcaatgtatgtgtctcattttgtagggcgtgactaacttaagcagcttcttccttgcttggttgggctttgcaaatttttgctactttatttcctgtaccctgaacccttggtgggtcagaggtcagaagggttccctcccactgtcttcagacattgtcaatagcaaattgcacctctttgattcctctccttttctctcctttctacagagtcgggcgctgctgtctgtgaattctttttgaaagctgcctgcggcaaaggtaagaaactccgggctccctgatgtgcctccggaggcgccctcccacctccttctccccggcagacttggaggccgccaggtctctggcttacattgctttctacagactaacgatctctgtagataaaactggtttggacaggctaggaccctgatggggtgttccacctgaaacctaaacgcaggactgaacctggctctaaggctgccttatcacttcgcattccccgtggccacaagctgacctgtgacatggagagaagcccccagcattgagacactcaggaactttctcaatgtcacagagttaataagcggcagagcccagtgtctgaacccaggtctttctcattccatagtttccactggctcatggttttctgtggcctcccatcgaaacaccccatgataacccatcttgcggggtcttgttctcgataaccagccctcaacacagactacacaaaactactgaggtgcgagaatcccttgaaccagggagtcagaggttgcagtgagccgagatcgtgccattgcactccagcctggcaacagagcaagactctatctcaaaaaaaaaaaaaatcttgctttatttgctcgtctccaaaccacgagcaagacattcattcttactttagttcagcaagcttcagcttatggagctccactgtcttggtcgccatcttgttacccctctggctgtgctcttttaataattgtatgtgggccgggctaatccatcagaagtatcactaggggtcaggcgtggtggcttacgcctgtaatcccagcactttgggaggccgaggtggatggatcacctgaggtcaggagtttgagaccagcctggccaacatggtgaaacatcgtctctactaaaaattcaaaaattagctgggcatggtgacgcccgtctgtaatcccagctactggggaggctgaggcaggagaatcacttgaacctgttaggcagaggttgtagtgagccaagatcgcaccactgcactccagcctaggtaacagagtgagactctgtcttaacaaaacaaaacaaaaaaaaaagaaagaaagaagtatcactaggtacaacctaaactttccatggtctgggcatttttctccctgtaggaaaatttatttaggagacttaaatattaatcagaagcttgaaaaagagagcagagaatcagagcaaagggctggttttaatgaatggttttggtgagttttgcttctataacgtagtcatttaccactgaggtaggagactttctggcagatcagccaggccaccttcacactgtccagtcagaacgtcattacctccactgagtttctggtctcattcccatgtctttgctcagtaattctgcccttctgaccagccaccttctgttagcacagccatccctaacacagggcattctgtctctctgttgactaatacagtagccactagtcacatgtggcagttcaaatttaagtaaaatcaaatcacatttaaaacaaaattctcagacacactagtcatatttcaagtgctcagtagtcacatggggctagcagctgccatattggacagcagaagtgtacagcggcctcattctggtcggacctccatggtggtcttgccaggccacccgttagaagtctcacacatccccagaggctggctctgtcccatcaggtcctgtcccagaagggacacgtccctccatgtgtatacatcacatttcctcaattctgaaattggtctttcctttttttttttttttaaaaaagaggcagcatcttactctgtcacccaggctggagtgcagtggcacagtcatagctgactgcaagcttgacctcctgggcccaagtgatcctcccacctcagcctcctcagtagccaggactacaggtgtacaccaccatacccagctttttttttttttttttttttttttttttttttttttgacggagttttgctcttgttgcccaggctggagtgcagtggtgtcatcttggttcactgcaacttctgcctcctgggttcaagcaattctcctgcctcagcctcctgagtagctgggattacaggtgcacaccaccacgcccagctaattttttgtatttttagtagagacagggtttcattatgttggccaggctggtctcgaactcctgacctcaggtgatgcacctgccttggcctcccaaactactgcgattgcaggtgtgagccactgtgcctggtccccaagcttgcttggctggcttacttacttacttacttatttatttatgtagtgaagacaagatctcaggctgatctcgaacttcttggctcaagtgattctcctgtcttggccttccaaagtgctaggatcatagatttgagctcctacacccggccaagttcctttctttttttttttcttttttttttttttgagacagagttttgttcttgtcatccaggctggagtgcaatggcgtgatctccggtcactgcaacctccgcctcctgggttcaagcgattctccagcctcagcctcccaagtagctgggattacaggcacccacccgcaagccgggctaattttttttgtacttttagtagagatggggtttcaccatgtcagccaggctggtctcgaactcctgacctcgtgatctacccacctcagcctcccagcacctccccccttttaattcctccatcttacagtaatatctgtgagatcatgagtaacttttttttttttttttttgaaaaggtgtcttgctctgttgcccaggctggtgtgcagtggcgcgatctctgctcactgcaagctccgcctcccgggttcacgctgttgtcctgcctcagcctcccgagtagctgggactataggcgccagccaccatgcgcggctaattttttgtatttttagaagagacaggatttcaccgtgacagccaggatggtctccgtgccagccaggatggtctcgatctcctgaccttgtgatccgcccacctcggccttccaaagtgctgggattaccagcgtgatccactgcgcccggccatgagtaactattaaaatgtaaaatgtctgtcagtgtagtacctcaaatcatgttgccttctgtgagggggacctctgcccctttccaggacgtgatgccttcaggtggctccaggagttaggaagtgaaggtacctcagcttcttcaggccgtgtcccccaggctcagggtggcctctctgctgacaccctgtccctatcttgccggcagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggtaaggcgcctggagccctggaggctctgctgagaaccagggtgcagaggggtccgctggctgctcagtgcccacactgtctctgcctgcttttcccatctttctattctcagaggagaactctggcagaacctgccagcctcagccagcttttaggggacagtgtggctattttctgctcatctctttttttttttttttttttttaaagacatagggtctcgctatgtttcacatactggtcttgaactcctgggctcgagtgatctgcctgcctcagcctcccaaagtgctgggattacaggcgtgagccaccacgcctggccccgcgcatcactttggagtgcttcagtgtttggagctctttcaatcactcggatttgaggctaacgagggtgacccggaagcagcgagttgtgcagctggctgcattatgtccgtggttggtttctgtccacgtccaccttctccctgaaacccacttctccctccagcgtgggcattgcctctcaggcccgagctggttccttctctccaggagccatgatcctggtgacatctcagccatcctaaatagcccttcaaaataacagcctcagatgtgtcttctggtagcaacaaacttgccttgagccctgcttagagaatgcgtggcctcagctgtcctgagtggcctgcgtggagaagcgggagcccgggtggagtcagtggggctggcacggagtctggcagagatgtgctccctgctggaaggagtccccagggtccccgctcaggtctgcacttccaggtttcccgggaagcagctctgtgggtcagcgtgaggctggctctggtcctgtgcagggagcccggcaggaggctggaatcctgcagggagccagggagtgcagggtatgcttcatgctttcaaagcactgctgttggaggagacattaattatttcagcatcccatcaggcgtggcctgctggcttatcaatgagagctgtggcttgttttgtggaggtggcataagctgagaagaaataggacccaagcttcccagctccccaagtgctgtccctgtcattgtgcaatgtagcatgttccccccgatgccttgcccatagcagcactggggcagcactgggatggggcagtggcctcccatctgtccccagaggcagcagctggctctcctgggcaggctcttaaggcaccgctatacaagtggcctgagggtcgctccttccttgctgacagccctggtgcaggacgcactgtctgcagcttctgtcacctgcaccacagacattgggttgagggccccctttccaggcactggagggacaatggtgaagaggtccttgccctgtgaagccttcactcttgtggtccagggaaagaggtagctgataggccatgagacgaacagagaagaaattgcttgtgacaagtgctttgaaggaaggaaaccgtgaccagaaccttctctaggctgagtggtcaaggatgaggggattcctgagctggaagcggaagactaagaaggggctggtcctggtacagggggacccatgtggctggggggtggcagaggctgagcctgcggaggggcctggggaaggagtttgcatttcctctggattttgagcacagttgtaaacatggattggagaaggtgagcctggaagcgggcaactactcaggaaggcggttcttggtgctggtggtccctggggtccgctgctttggagagggccaggtccacaagtgcttcccctacccttgtcccagctcttagatgtgaagagccaatcagaatggaacttcctggtctcaatgggtgcatttccatcacagctccgctgcacaggaagctggggctcagaaacactcttccctggctctcagggctcgtcaggccaaaactggacaccagaacctcttttccttggatgaagccaaggtgggcctggccccggccttcccagtggtctcacgtctgagtttccctgcaggggagtgcagcaacaaggaatgtcccttcctgcacatcgaccccgagtccaagatcaaggactgtccttggtatgaccgtggcttctgcaagcacggtaggtgccagggtgggctgggccccgggcaagaagccagtcctcccttctctgcccacgaccctggaggctgccagctggtctacctgtcccagcaaaacctgacattctgcagctagcggctttctcacactcctcatctcccttgcctctcccaagaatgctgggtgggtggtggtccacccgcttttttgataaggaggccagtgttgggaggtgaggtccctgccccgtctcccatgaatgggggacagccagcatttgaaaccatgctccagctctctaactggtagaggggacatctaagtgaccggacacttggctctgcaggtcccctctgcaggcaccggcacacacggagagtcatctgtgtgaattacctcgtgggattctgcccggaggggccctcgtgtaaattcatgcagtgagtagccagctgctccgccctctaccccagctcccggcccaggccctgctgccctccgtatcttccctgggccaactgggccttggtcactgggtgatgtcagtaccagggccaagggtgggggcaggagatggggaagtaatccctgcttatggccaccaatgcttcctgagcccgcaggtggctctgcctagaccaggagctgatctttcttgggtcatgggccatctggtaatgtaatggaagctgtgggatacagacaaacatgtagccttgcatatcatttagggaatttggggacttccagttaagaacctgtgccctaaaggaaagaatttcagagcctcccatgtggaggctcaggaaaccctgagcttggggtttcacatagaataagtagtcgtctaacagtgagggtaggagagaacgcacccatttcacacagcagcacactgaggcacagggctcagtccctggccaagggcacatggtagcaggtggtggcacctggtcaaaggcaagtctgggctgggtgtggtggctcacgcctgtaatcccataactttgggaggcagaggaaggcggatcacgaggtcaggagttcgagactagcctggccaatatggtgaaaccccgtctctactaaaaatacaaaaattagccaggtgtagcggcgcgtgcctgtagtcccagctacttgggaggctgaggcaaaagaatcacttgaacccaggaggtggaagttgcagtgagccaacatcgtgccactgcactccagcctgggtgacagagcaagactccatctctaaataaataaaataaataaatagcaagtctgtgagcctccgaagacgggttttaattcttgctctgtggggttagcacccctcttgtggctccattttcttgtccttggagcccagtgcccatctgtcactttggttgtggacctgggcttctgcctggggtggcactggggccacagacaagcctcccttcctcccggctgcctcgcccacactgctgaacctacagcaggataacagtctccaggtctgtgggaaccctggtccctgcttctcactgcagggaagtggccggtgctgtcactgggtctcactccctgaatgagagtgcaggcacctgcaggtggctcaggggcagaccgtcaccaagtgatgggaggaggggctgacgccagagtaagaccctgcggggaggggggcttccctgtgtacagctcctgtggcgcagcaggcacgcaccagcacagcctttgtcatttccgagaagcactggccatgagtctcccagctcggtgtaggcagggttgggtctgagcccaggcaagtcagttctgttctccccgccactcctgtggcctcccaggagcagagctgagtgccagccaccaccccatccatgcagcttgtgtcagtcactttgtgctggggcagctgagtgtgattttcctagggctggaatttaagagcatggcctggcttctcttctcatcccctgaccccactccttctcttgttctcatcccctctggctgctggtgaccagccctcgatttgaactgcccatgggaaccaccgagcagcccccactgccgcagcagacacagcctccagcaaaggtaccgtgcctggccttcctcggtaggaaggaagtgccttttctacagcgagaacctcagtgtcccccaggggtgtggtctgccttagaccccgctggacaacttgggagaggaggggagtctcccaagttcccgaagaaaagtcaggagcaaagccgtgtatatctccctcgagagacggagggcctcttgccctagaacctcagcaaggccaagcgcagcagcagacacagtccaggcgccgtgcaactggccacccgttgtgagatggggctaacctggttcagcagcgtctgcccctggggctggcatggagggcggcctgggcaccgtgtctgctgctcttgctcctgggtcagaccctttattttgcaaatagggaaaccgagactaccagagggagggacctgcctgaggtgacaccactgggcaggagcaggtgtggcagcagaactgaccactctggccagcaccgcccctgctcctgtggagtggaggttgggaggaggcgcgagaacaggcccggctggctccagttttctagatgaggggccccacagccaagcagctggtccgtcccctcaagcacaaggagagggggaaatgctgtagacacatggggatctgcagcagcctctcaatgccaagggcaccctgagtttggttatgggagtcgggagttgagccaagaggaagggctggcgtcaaggcagggcgggcatcaggcagggttcccaacaggcccatcaagcccaaccacctcctgagcccaatgcctcacctcctaccctgctgggctctggactggctgccaaagccccaccagccccgctcagtgctagaggctgaacagccaggagaggatgcggaggatgtagctgcgtggaggcgccaatcacattgaactcttgatggggaaagccgggaattccaggtgtaggtgcagccgtgccaacctgggggttttctagctcgggttctgcacttacgggccagagccaggagcccacctggtggggaggaggccctgctgtggaatccctaccccaggagccctggccctcctcctggtggggctccctagaggagggtcctctcagcccgagaacgcagctcagtgtgtcaggctccaactgtttttctgtgacttgctcgccgtgtaggctgctaaacatctggctgaaccaagcgttcatcctgacctgaagccagaacctcagaaaccaaagtaaggcctgatcatgccctcgccccactgccccagagacctcctcttgtctctttgatgttttgttttctattttatttttcgtttttgtgtgtctgcatggtgtttttcgggcagtggcttctgccatcatcaccacatgtttctctgctgcccactgtcctgaggtgggccgtcgtggaagccctgcttcctgccgtttgcgggacgagtcccgccctcttttttcctgtccccatcggtagtctgcgtgcacgtgttttccacagtaaaaccgtgttgtgtaactctttccagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaaggtgagtccctgggctgggggacagggtggggtcttcccttaccgtcagtggccattccctcatgccccatgtgtttggtgaaatgagaaaaatgaaaacattcatttttgctgattgtaagcataaagttacagtctagttaccatccactgtggtgggctagagactgtcctatttcctaccacactgcactgaggcacggtaaaggatggtgagaacgcctgcctagtgaatggacggggcctgcaggcaggtgagggaagcccccaagaggccgggaacaaaatagaaacactgatccagggaagggtgagcccttggagccgctggctgtcctgggggcatccttggatcctgcagggcacacccgagaaaacaggacactgggttacagcacccctgtccccatcccctcccccagtacataaaatgggactcaggaagggtgagcttcaagaaacctcctcgaaaactgtcctgttcactcctggctctgtgggaagcggggaaaggggaggaaaatctcttgatagtttgacgttattaatgggcccttatgtgagtctaggcctgtattcatgtccttggttaaggctggaaagttacaaactaagttttctaatctaaaatcgccccaggattggtgtgtccctggcacgtggcaggagtaacccccagtactctttgaagagtatgttctcaacccaaggcgcacacaattcctacagctggagttctgaagaatgagtccagattaaaaatcacaaaacaggctgggtgtggtggtgcacgcctgtagtcccagctactggggaggcttagatgggaggattgcttgggcccaggaggtcaagcctgcagtgagctatgactgcaccactgcactccagcctgggcaacagactgagactctttgtctccaaaaaaataaaagagcatggaagtggggcactgtgtagagcagacttagctgttatcttgccaccctccaggcctgttaagcggggccacttctgtgcagcaagcgcccttaagtcctggagccttagaaaggtagggctgaccgcccctgtccacagcctgtcaccccattaatgtcagagacacttcatgtaagtcctggattccccagagtcagctgtggggtccgacagacatgccagatgccgtgagcagggtgtgtggtccctcccccagccatcatgttagccctacagcccatcggcagcctctccatacagagtcacacctgcagatcagacaaagttgaaaacacagggacagctgggtgcggtggctcacgcctgtaatcccagcactttgggaggccgaggggagcaggtcacaaggtcaggagttcgagaccatcctggccaacatagaagaaagaaaacaggaattgcagagccagggaatagagctggcaagagtgttgggtgccaactgggcagagcccctcagggcagcagggactcaggggtgggtgtcagtacagagtcagtgcccccagctgcctcctgacccttttgttcagtgcttgaggctgccgttttaggagtcatagagtaaagagaagctatggaagggcctggataatcaggactgggatgaggcagggtcagggctggatttgtcatgtggctctgcaggctccccttacccaagtctaagcatcgtcccatctctctgatcctgtaatcaaaacctgtccccaaggtagcttaggtgtgtcacagccacgagggaaaacgttgggtacagcccaccctctgtccccagcagtggctccccaagggaggggaggctgggacacttctgatgctgttccctcccatctcctgccagggaaccccagaccttggctcagaggtaagtgactggcctgtggtgcagaagggcttggtccccagacggggtggcggagctcaggtgccacgggcttctctttgtcctgctacccacttgggagtccctccctgggcaggccatgtgtccaggtgggagagttgtgggcctgaaagagcaggtcgctagcaggtcgccttctggcggccttgttctcccttgcatctgcggagttgctggctagtttctgcaccactgcactttccatcctgagctccctcaccctctaatttgaaagaaactctgtaccactgagaatttcagagtcatgtcccgactggggacttggtggatgatttgggatttggtgggcactcccttagttgaaaactgcatttgaacagtgttgttgtctgtctctcctcttcccccacttcctgctgttcccagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaagccatgtctcattaattaagggtctcatgccaacccttttacactggctgcaatcacggcgtagctttcttgtccctttcaacaaatgtcagcctcacaaagggaagtgcagctgcccagaaggcctgcaagcagctggtcaagtctgggagtctgatctgtggagccagcaggcaggtcctccacctcagctcagatgtctggtggcacctatttctggggcacagtatcccacccccaatgaggctctgatgaagaggaagcagggaggggccgccatagcccctcacttttccccatcacccccaacccactaagcctcctgttagagaagccgcctcagccggagggccacaatccctgcagcctgggcgtgagtgctgcctgaggtctctccagacagtgccgggtcacctcaccctgtagcccttgatgccccagggtgatgcagaaacacaggatgcgggccatccctgcctggagccacaggacagccggggtgggatctggcgctctcaggtacgcaagcctttgtgttacaccataaagggccagccaactaaaggccagaatgtctgcaaatgcacctgcccacagcactcatggcaagggacggacttcggcactgctgcttcgggaaggtctggatgacaccctgccctccagggagctgggacacgaccagagtggtggtctgggaagtccacaaaggccttcaccggtcaacggcctggaaagacgacctccccccaccttgtgccacaggagcccctggaacatgggataatggctacggcagacaggcaggcaatcagcacacgtaccagtcatgttttatttggaggttaattcctattaggatatgaaaggattcagcaacgattgagattgtgttcctcacggaggggctcgggccaaggtcgtggggtgggggggtgcagagtgtgtcctcttcagtggtatttgcggagccgctcgtgctctgaagtcaggaaggcaagatggtaagtatcttaaaaggttacagtgaaggcacagcatggcaggaagcaggctgagatcacacaaagccttcctgagaattcccttcagagatgacccatgacccgcctgccggtgtctctgcagaatcagcagacccggggggcacaaagacacctcaggagccaacctgccacctggccaaccactttctttccagaaggaacagagggaacacacgctcagacaaacagccccagagaacccgtccttcagaggcaggaccgccctggtgccacagaatgggagtgaggtgggggtagggggtgtacactacactgtcagaaacagcctagtcagaggctgccaccgacacctcccgccaatctcccaccagacaagctcctctcaagcctcagagccggaacagccatgcttttctggggtaccagattatcccactcaactcatttctctttctgcattggctactaggaaaatcgagccaaattttcacagtgtgctgtattttaaagaatgcttctaagtactctctttaccctggcttcatcttgattttcctgtgttctctttgtcacaattttctcatttcaaacaatatcccacatactgtactctgataggtccctccaattcttttaggtggaaacataaggaactttaactaaaggtccctcagcctcagaagaaggtgggctgctgtatctaatgaaatcagtcaccaccaccctctcatgggaactaaaggcaagacgccgcagaggcactcactgagatgcttgtaggaaaaggagtagctaaagagcacgtagcatgccagcaccatggtaatccccgagatgctccccttcttcacattgatgtacttgttgtagtaccggtagtaacctgcaaacgcaagaggcgctcactgccctgctgggcttcacatttgagtgaagttgagcacacagttgagtctggctgacattcagggacctagtcctgctctggctg

SEQ ID NO: 12617 - DNA, 160018 bp, Human
  misc_feature (1)...(160018): n = A,T,C or G
tgttcaacataaatctcactagggaccgggcactccttgcttaccagtctccctgggtgaactggtgagaggtggccctcaatatttttactttttatttggtgaagcaggatcaatgacaatgacttttgtcatgtggtaggcagttagatatgcagagcttctagaaataatgcagactgggagactggaatgtagttacaagtgtgccaatgaacatgagacttttctgcttgatttttaagctaaggctgacttactctcctgacatttaagggcctcctctccaattcccagtcatcagtaaaggatgtgtacagggaatgacaatattagaacaaaaacaacctgcaagtaaatcggatgcaagagtctatgtatcttgcaaggaaatcttttgcacttaatcacaacatggctctcctcaatactacggagaacagaattgattcagattgtttttaagcctgaacgtaaacaatattgtcgcctttttgggtttcagcacctccttattcatccattttctcttttatgggaagggggttgatgaggtgtgtgaagatgatagaacgtgccccagaaactgaacaatgaagagacgcctgtcatatcgggggtacctagattcctctgaaaggaagcccagctgaaggagcagggtcaccactttattttaaaaacgtaacatggcacatgttggtgctctattaatcgagcctcgggggcccaataacgtgagcatgggctgctgcgtggaagtttgagaccctgttgctgaatcctcgggcctgacggtctatcgctgaagacaagacttccaaagaatcacagtaaacgttaacctaagccatcagaagccattaactccggtgacactacatttcagcgaaaccttcgcgacccaacccctcgctccctctcgcccaaacgctgggtcaaccccacgaactggcggtggcaaggccctgggcaccggtgaagttctcgtggcagcgcagatcggcgaccttctcttctttcgcgctcagacggcggcggcagcagtacgctttcgggctgctggagccggcagcggcgcgaggccggagcccgggcagccaggctgggtgggggaggggcggcggcagcggagccgggagcgtgcgcgcgcacctcacactccgccgcccggggacgcccactcgcgagccggggccggtaggccggcccgggtcccatcgcccccgccctccggttcctctccggcgtgagcccaacgggtgtcggcccagcagctgctgcgctcaccaggcctggggaggcagggtacggggaccgggccgcagccccgagcggcgtgggcgcgctgcctctctggcagccgccgccagagccagcagctgcgagccaccggaggcggcgcggaggaggcccccgcggccgggcaggaaggagacgcggccgacctctgcccgcccgaggcgcggctgctcccgcgcgcccaggccctcccgccgctccagggctgagtgaggaatgagccggcgcctaccccgggctctcggagcgtgggccccggctcggcttcttaggcgcgagggctcggccactgcggccggcggcctagctcggggagcaggcgccggggttcactgaaccggccgcggagaggaggaggaggaggaggaagaggaggaggaggaggaggaggagctcggcgggggcggccgccgcgcctcccctcccccaggacacgccggggcttctcagtggccgccggaggaggaagttccgctccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggtttgtttatttcagaagttctggtactaacatttggcagagcaaggtacggtgattggatcgaatctgtcttttttttttcttgcagtaaaatgtaatttttcgagtcataaatattgtattgttacttcaagactggctgaataaaaccatagactggagggactctacctccagtctatggtagagtccatagactggtaggactggagtcctacctaagtcgttcttctcttcggttttatataagaaaaacatttgcgttcagagttgtgtctaatgtggacatctgggaagggaggtatgaaaacttaacctaaagaaatggtgacataagctgtgcctgcatttattaataacgtgttggagtcagtcattgtgccaccatgtgaaatcaaagcatcgaaccttgacagctcttttgggtgtgctctcccagagggctctcgttttctggcttgtagttgaagcttagtagtgagtcagctttttaggatgacaaacgtgggcagaatatacctgtcatttcttaacgtgaaaatatcctgatttttgttctttttttggggatgtgtgttggtgctgtatatgaaatcagttaagttaaaaggtattgaatcctaagttattgcactttgtgaggcttgtagacaagatttatttttgtgaaacttaattttgctctctcttttaatgtaatagatggactgtgtcaagcaactattggaatttggttgattaaggggttcacattctttcagatcactaaatctaaagtgagctctggggagagcatagccaaactaggataaaatgggagctctagttacaatttttataatttttatatttgtactcaagagtttgggaaagtagttgacttttcttaaacctgccatcttttccttgtttcttaaaataattcttgagtatgtgggaaaaaaaatcatgtgcttgaattcatttcccatctgatgatagttttaactttttgtcaagcaccgaaaaagcttaggttcacgtgtaagcctacattaaatatttgggaaaatgcactgttttatgagaactggtttttctttttttctcaacctagttaattcattacttgtgtgatggttctttgacttttggatgaattttatggagtagttacttctaatattgtttcatgccattcttttgtaactaagttaatttggaatttttgccattttcgactactgtactcctgtatttgtttctttaattttgcactttgcttgttgtgactttaagaaaacactaatatgatctgtgaaatatgttactgaaaaattaacggtgaaagtagttttccttgaaaatcttatttcgcatggtatttgtataacatatgaaatatattgaaaaaatgtgttaaggctgtttttagagctgtttcacaacagccacacattaacattacttagctctattattaatagtatctgtcatgtactaagcagtttaaaaaatacattttgaatggtctaaaagtttaaaataatatgaccacattttagtttaaaaacatttacacaaaaattctcagtaaatggagttaaaatatgaaatttgaatgaaaatacagatatgtgccttttattcacatttttaacagtctgtataaatagtttaaacaagaattcttaaatttatgaagcccttggatatatatgcatatgtatttagctatctaaaactattgggttcctgagtttggaatgagagattggttattgttctgatagcaggggtggtttgtgagccatgccctgagttttggctagtaagagtctggatagcaagtgatacatgtgagtctggatagattccaatgcagtttttggaatctattcggttcctgagttttggaaaacgagaattcaaatagagttcaggtggcaaaggatccttgtgttatctctttgtatttctgtggttatatcagttgacatttgctttagcgtattatttgctgttgtttactatatcagaaaagagtctgtagtaataaactttcttttactttgagcaaggaaatactttttaaattaagtgtatgtttaaaatgtggaaacagaaaacatcaaatgtataaacattaacttatttaaaaataattcagaaaaatagcacttttacagttggtactaagatcatatgtattttgggtatgggtcagaacttacctaatttagaagaaacaaattgacagtttatcttcatttagtgtgtgtgtgtgtgtgtgtgtgtgtgtgtaagggtacaggatagagggctgaggaatgttactttaactaataagtaatggaaaataagtcatggtcaccatttcttatttgcagtacttaagagatacttgtttagttagtatttctttattaatagattagtataataatttggtgtttaagttctggagtcagactgtatagattcataccctagcttgccactgattagatttatgatactgagaaattttaaaactctatattgtttcctttgtatcacagtggcatgtatctactttacagattgttttattgaaagagatagtacatgcaaagcactcaacatagttcctggcatttagtaaatgatcaataaatgttaactattattatcatcagtgattataattgtaatggaatatttttattcggaatctactttcctttaaatactgtatattttctgaaaagtagggtacagtttgattaatatttagaagtatactaggatcttattgtctaaaggaacattttataaccaaactggttggcaacaaatgtatgcctactgtggcaggccccgctttcatgaaactttcaatctagggagagatgatgggcattaaataaataattttgtttttgaggtgtgatgaatgttacgaagttgtactcagtgctttcagagcaaggaatgtgtgacctagtctatagagttgggggtggaggggcagtgggaataaggaagacttcattgagaaagtgtgcctcagaaacgtagaatgagtaggagattgcttaatgaagtggaattggaggttgaggggaggttgagggtcaaagcagaagacacaacatgtgtgagagccctaaggaaaaaaagcttggcatcactaagaatctgagaaatgttaagtatggctgttgcagagggtgtgggtctgggtgatgagactagatgagaggtcaggtttggcctgcttacaagttttttggcctccttattgttgttacaaaagtttgaattagttgtcagcattcacagatcaggagatttcatgttaaagtctggatttctgatctttcttgaaaaattagaggttatggcaacatccagtgtattttcagatggtaatattcaagccacaacccagtagcagctgctcccttgggagggggacgggggcgggcatgtgccactcagagtgcgaaataagtaaatacaaatcaatcaatatttaacctggttgttgttgagtttgcaaattctagtcaggattctagagagtttgtagttaaatattttggtttttatcataaatactaagagaagttattgaaggattgtaataaaagcaagggaatgacatgatcattttaaattaaaaaaattaaataatcactttggttgcaatgattacttactggatggtaagaagcaggaggataacaagttaagaggggctgggtcacagaggatatattggcttagatcgcagtggtgatagtggagaatgagataaattagtggagaaaagtggttgagtcaagaggtgttaaactattaagtttcacagaaaatggtggttggttaaatatggggccaaaatagaaagaaaagtgagtccaagataatgtctaggtttctgggtgacatggccatggattagtaagaaatacatactatatttaattaatgccctaatttatagataatagtggtattacatgaatttagtatattttcatgaggaaaccaatatgttcccttctattaagtagttcataaataatccagaattttcaaacactgtagatacactttatagatgataaggatatatcaaatgtgtagtttggtgttgattatggttatttatagtatctatgattttgcagtacccaaaaccagaagttgttataatatacatgttgttatacgctaatatacataaagtaatatacgtaagtatactttgtgtacataatagatctcaataattaaaaacttttttttttaaaactgacatttgttttatataatggcatttatagatgggctttgtgagttaaaaaaaaaaaaacccagcttatgagctgtttatctgaatagctaataagtttcaccctccagtcagaactttgttagtctgaattgaatacttgagggtcaggtatatgtttacctttgatactttcctcaaaggcattggagttataaataaggctgcatcttagttctactaactagctgtgtggcattgtgctagacgtaatcactcaaacctgtgcgctgtccagtaccatagccactagttatatatgactattgcacttaaaatgtggctagtccaggctgcagtgtgctttagtgagtttctcaagttcttcatgttatgattcgtgttttttttttgcttgattcagttttgttacaagagtagagatttcaaatctcactattgcaattttaattttcttgtcatctttctttgtctcatccctcttctggaccttttttttctatcctgttttttatttagggctttctgctcctgtttgggcgacgtcacattgttttatgcactaatattaaagtctgctggatgttccatttcccttataaattgctcatggttatttttcccacttccctttactcagacatgaattattgtgaggtttgtttgtatttgacgtttgtcaacaacagactggtgtagatgcctttgctgcatttgttttttttttttttttttgggtacattctgtggtccaggctggagtgcagtggcacaattacagttcactatagtctcaaactcctatgctgaagtgatcctcctgtcttagccttctgagtagctgaaactatgggcatgagttgggactacaggtgtgaacaaccatgctaggttaagttttaatttttgtagagatagggtcttacttgttgcccaggctggtctcaaactcctgtgttcaagtaatccttttaccttggcctcccaaagtgttcggattacaggtgttagccactgcacccaaccgaatcttatttttatcgatatggatactttcaaattggagctcatgcctaagattggaaagttggtaatgcagaagctaagtatcttctagaaatcagtagtacatggtaaacattaattgatttttttttttaagtgaaagcaagtttattagaggaggaaagaaacaaaggattataggcagagcagccaatttatttttaactgggcaaatgttttgtttactattgtttgaaaattatagaatatttaacttatgtgggaggtggaggtgggaggattgattgattgaggccaggagtttgagactagcctgggcaacatagtgagaccctgtcactgcacatactcgcacatgcacacagctgggcatggtggttggtgcctgcctgtagtcggaggctgaggtgggaggatcacttgagcccaggagttcgagggtgtagttagctatgattgtgtccgtgcattccagcctgagagacagaggctctgcctctttaaaaaaaattaacttctggtttgggctgactccacatatttcttggataggaaaatcatattgctacttttattttccctagttgtgcaaattctgtcagaaaagtttattttcactgctattgaatttttgctagaactttattcctgttaaaacatggttgtaatgaagtctgcactggagttttattttcagattgggtattaggatttgtcattaaaaaaaaaatctccttcaaagggcattctttccaatgatctgtttttgaatttaatgtagtccagaaggaaggcatcattatatattagaaagaacattggactcagtgttaagagacaggggctttagtttcaccattgtccttggttgttgaagtatatttagatatgctattcaacttctctgtgcctcgatgttcttatttatgaaatgagggaattgattgaatctttaaagatttttttctagctcatgcatatgaaatacaagtaattttatgaagtagggaactgaagagtgtgcagtaatttagttcatacatctcaaatattacaaagataaaatgtattctaaaggaattagtgtcttttttgtatataaaaattagtttaaaatcactttggaaatgactaaaatttatttacataatattattatttacataatgaaatctataccgatttaaaatgtgaaaatgaacgaaatgacttttatacattcttgtttcttgttagttttaaagtatagtttattgagcatttgatatgccagcctgaatgtagtgggtatatttacaaaattgttttcaggtgtcatttcttgagcccagttatcaattacacgtcttcacctgttacctgagactttaggatagattctgtggaatacagtccttgactgaggcctcagaccctttgaaggctcttactactcctgtggcacaattttctttgatttaaggctataatttccttttttaaaaaaatttattttaattttttaacaaaacacacctctcatgggaaggactataatttcctaaccttaatattgagagattccactgaaagtgttctctcctgttctccatatcttaagaacaacttttgggacaagttatacaaatagtttttttaaaaaaagaggaaattaagtaatctggagattacaaagaacacaggtgttgtttttccttttgactttttaaaaaaatatttatataatcaacctgttatgtagctctcttggcctccccttagtgatgttgatattaccattaaaaaatattagtcacaatcatttgttcagcaagtgttttgagtgtttattatgtaccaggcattttgctaaatattggagattattaatgaatgttacagaagattaattttgactattgaaaaattcagatcttagactcacgtcttgatatttttcttaaagcatattattatgtttggagccagattccaggggtcttagagataactttccacctatgggaggttctggtacaggcatttaggtcattggcattttttaagagttcagataagttattctatctctccccatttttgttttctttttctaagatgtatttaagataattaatttatgtttttttttttttttgagacggagtcttgctctgtcgcccaggctggagtgcagtggcgcgatctcggctcactgcaagctccgcctcctgggttcacgccattctcctgcctcagccgcccgagtagctggtactacaggcgcccgccaccacgcccggctattttttgtattttttgtagagacggggtttcaccgcgttagccaggatggtctcgatctcctgacctcgtgatccgcccgcctcggcctcccaaagtgctgggattacaggcgtgagcccactgcgcccggccctaatttatgtatttctaatatacggtctgggttatctggtataaggaagatggatgctgcggtcaagaataggtcgaggcagacatccggtccagcatgactcagtgagtttggagtgcaggcatacagctccgcttattatgtaaccatgtcatgtgaggcgcattaggtgatcacccatgtgagtgtgtgcttggcttggagccactatggtctgtgaaaggtctaattaccctgctaacgtggtacaaaaggctcgcgccaaggctcgctcacgcccagagagtaaagccatgttgaaactatgattcctctagtgtttttccaactacctgccactcacccaccaactctcctcagacctcagttacagcctgacatctggaaaaaagagacaaatattttgaagcgttttggtaaggaatcaggctctggcatctgaaaagaattcctaacattgtgtgaagttgagatctggtacctttgtatgtacagttggccctctgtatccataggttccacatgtgtggattcaaccaactgcaggttgaaaatattcagaaaaagttaaagatgattgtgtctgtactgaacatgtacagactattttttcttgtcattatttcctgaacaatacagtataatcactatttacattgcatttacattatattaggtattataagtaagctagagttaattttaagtacaggagaggttgtacatgggttatatgcaaatactacagtattttatataagagacttaagcatttgtggattttggtttccaagggaggtcctggaaccaattcctcatggatatcaaggaacaactgtgtttatatttagccatatatacatgaacatatttacatatggctatatatggttatatctgtatgtttataatgttatacatgcatacatgacttttttccaattagttggcagtcaggtggcatctgatacaaagtttgtatgtgtttggtgtgtatctgttaaatataataaatgaggattattttctattaatttgtgttgtcattaataaatatgttttcatgacctagatttttttctctctacataaaaagattggtaacaccctgagtaaggtgaacattgagcctctggctcttcttcagtgccgttggtgtaaatgtaaattaatagaattttcataaagagcaatttatttatatcaactaacttatagtgcatattctttgattcagcaatccttctagggatttatccttgggaaattttcacaaagaagtgttcaaatcacttctttcacaaatccgtgtgaaactgaagtttcacaaatcagtgcacaaagaagtgttcaagaatgtcccctgaagctataacatgacatattgtaagtgacctagatgtctgtcagcagggtattagttaaataaatgatatatcccatcccaatatatacaaagggtttctttgtttttttgtgttcgttttgtttctggtgctgtgaatctttctggttactcccaaaagcaccacactattttaatttcatagttttataatagtatgctttcatatctggtaggttaagtttaatgtatcattcttattttaaaagttattggctcatgcctgtaatcccagcactttgggaggccgaggcgggtggatcacgaggtcaggtgattgagaccatcctggctaacacgctgaaaccccatctctactaaaaatacaaaaaaaattagccaggcgtggtggtgggcacctgtagtcccagctactcgggaggctgaggtaggagaatagtgtgaacctgggaggcagagcttgcagtgagccgagatcgcgccaccgtactccagcctgggcgacggagtgagactccatctcaaataacaaaataaataaataaataaataaaaaagttataagtgtacatgaaaagtcttagtggataatattactgaatgtcagtgtaactactagttagctttgtcaaatcctaacattttcttattttggctggattacccttcttgaggtaaattcctatactgagttggacattgtcattgtcagtgcatggttttatatttccataacgtgtatttgttgatataaattatatacagtttttcatgtttttaaacattatttatcattctgcaagttgttttccccttcatgttatctttacaatttcacttttgggctctggttcaattatataattatattatctgcctattcagtgattaaacctcaagttatttgtgtatttccctgttgatagatttttagtttttagttttttttgttgttgttgcaaaaacattctgtacatatgttcttgggcacatgtgtttttctccaaggtaaaaacttagaactatagttactgggttgtagggtatgtgtatcattgactctaaatttttttgtttacagcccctgaagtggttattataccagtttatacttccacctgcatcttaacaaaccatgatattgttagagtttaaaactcttttccaacctgctgtcaatttgtttgtacttccctgattactagaggtgaaacacgtattttcaacatatttattgactatttgagtttcttaatctttgagttacttgttcagttttttgccagttttcttttgggttgttgcctttttcttatttatttgtagaagttatttgtacattctggatgaattctgtgttaatatgcattacacatttcctcctgtgaataccttattttttaattttgattatgatgtttttagttttacacaagtttgaaattttaatatatttaaaattgttaatgttttcatttatggtctctactctgaagtaacagtttcctgtattttcagttctgatagttgtaaagttttgtttttcacacctagggatttaatctacttgttgatttttgtgtatgatgaggtggggactgaatttatatttttccgtatgggtatctagttgtccctgtgtgacttattgaagagtctgtttttttctcatggatttgtaatgtcatttctgcaatataaattttcatatattcatagatttgtttatgatttcacttggttcttttgtatatttctgttggaataacgtgccgttttgttaagtatagcctttagatatatcttgacatcagatagtgtgggctcttctaccttgctcttcaaaattttttgctcttaattctaagctctttcataagcatttatttttttattcaggttaagttcatttaacatagaattaatcattttaaagtgagcacttagtagtatttacaacattcacatggttgtgtaactaccacctctagttcaaaagcattttcattactccaaaaggaaactctatacccattaaatggttactttccattccctcctccctgcttccccctagcctctgacaaccatcagtctgctgtttctatagatttacatgctctccatatttcacataaatagtatcatgcaatctaagaccttttttgtctgggttctttcacttagcataatgtttttgaggttgatccacactgtaacaggtaacaggtattagcacttcatttcttttttatggctgaataatatgccattgtttgtatatatgtgatttgtttatacattaatctgctgttgggcatttgggttgtttctaccttttggctattgtgaatagtgttgctgtgaacatttgtgcgcctatattcgttttgagtacctgttttcagttctcttggttatatacctagaaatggaattacagggtcgtatgataattctatgcttagctttttgaggaaccaccagacatttctgtagcagctgaaatgttttgtgtttccaccagcaatatagaggttctaatttctttatattctctctaatatttattcattaaaaaaattacatccatcctagtgtctatgaagtggtatctaatgatgaattgaatgaatgagtaatgatgaataggaatgaataatcatgttgaacacattttcaggtgcttgcagaccatttgcatttttgaaggaacgtctatccaggctttgtccatcttttaaattggtggttatgtcctttgcacaaaagtttttaattttggtgaagtccgatttatctgttttcttttgttgcttgtgctttgggtgtcatatccaagaatcaattgccaaatccagagtcatgaagatttaccccagttttttccataagattttttaaaaaagagtttatggttttaactcttatttaggttgttgattcatgttgagttaatttttgtgtatggagtgagatagaggtccaaattaattattttgttagtggatatctgtttgtcccagcaccatttgttgaagagacaaattttcccctattgaataatattggcactcttactgaaaatcagttggctatagatgtatgggtgggtttctggacattcagttctattccattcatctatatgtgtgcccttatgccagtatacactgtgttgcttaatgtagctttgtagtaagttttgaaattgagaagtgttccaggtttgttattctttttcaaaattgctttggctatttggagaccactgaccattccttatgaatctgaatattggcttttcaatttctgcaaaaatgactgttggaattttgatagagattacattgaatctgtagattgttttggtattattatcatcttaataatagtaagtcctccaaccatgaccacaggatatcttcccatttttgaggtcttctttaatttttcagcaatgtttatggttttcagcatacaaatgttttaccttcttcattaaatttattcctaggtattttgctcttttgtatggtatcgcaaatgcaattgttctcttaattttcttttttggtttttaaatttctggtgtgtagaagcgcaactaatttttttttattatactttaagttttagggtacatgtgcacaatgtgcaggttagttacatatgtatacatgtgccatgctggtgtgctgcacccattaactcgtcatttagcattaggtatatctcctaatgctatccttccccctcccccaaccccacaacagtccccagagtgtggtgttccccttcctgtgtccatgtgttctcattgttcaattgccatctatgagtgagaacatgcggtgtttggttttttgtctttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcagtaaacatatgtgtgcatgtgtctttatagcagcatgatttatagtcctttgggtatatacccagtaatgggatggctgggtcaaatggtatttctagttctagatccctgaggaatcgccacactgatttccacaatggttgaactagtttacagtcccaccaacagtgtaaaagtattcctatttctccacatcctttccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttttttcttgtaaatttgtttgagttcattgtagattctggatattagccctttgtcagatgagtaggttgcgaaaattttctcccattttgtaggttgctcgttcactctgacggtagtttcttttgctgtgcagaagctctttagtttaatgagatcccatttgtcaattttggcttttgttgccattgctttttgtgttttagacatgaagtccttgcccatgcctatgtcctgaatgtaatgcctaggttttcttctagggtttttatggttttaggtctaacatttaagtctttaatccatcttgaattaatttttgtataaggtgtaaggaagggatccagtttcagctttctacatatggctagccagtttacccagcaccatttattaaatagggaatcctttccccatgtcttgtttttctcaggtttgtcgaagatcagatagttgtagatatgcggcattatttctgagggctctgttctgttccattgatctatatctctgttttggtaccagtaccatgctgctttggttactgtagccttgtagtatagtttgaagtcaggtagcatgatgccgccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttattagcacaactaatttttagtgttgatgttatgcactacaatttgctaaattgacttattagctctattaatcattttatgagttcattgggatttactatctgtaggatcatggtcatctgtgaattgaattgattttacttcttcctttccaatttggatgtcttttatttctttttcctgcctaactgctcttgctagaacttccagtacagtttcaaatagtagtggtgaaagtgggcatctttgtcttactccttatcttaggggcaaagctttcagtctttcaccattgagtgtgatgttagctgtgactttttcataaatgccctttatcatgttgaggaaattctcttctatttttagtatgagcataagtcctttcactctattaatgtgatatgttacattaattgattgattttcttatgctgaaccatccttgcatttctgggataaagtctacctgcctatgcctgtagttcttttaatatgctgttggattcagtttgctagtattttgaggatttttgcatcactatttataagggacattagtctgtagttttcttggaatgtctttggctagctttggtatcaagataattactggtctcataaaatgaattaggaaatcattcctcctctgttgtttttagaagagcttgagaatgattgctgttaatccttctttaaagatttggcagaattcaccagtaaagctatctggttctgggcttttctattttgggtggtttttgcttcttgattcagtctctttacctgattcagattctcttcttgagtcagtttttatagtttgttttcaagaatttgtccacttcatgtagattatctaattttttggtgaataattgtttatcatattctttaaaaattttttttttttttaagcgttgggggtctgtgttgcccaggctggagtgcagtggttattcacaggtgtgatcatggtgcactgcaaccttgtactcctggccttaagttatcttcctgcctcagtctcttcagtagctgggactacagatgcacacatcaaacaaaccaggccataagattctcttttaatcttatttatttctgtaaggtcagctgcagtgtctccacttttatttgtgattttagttatttgcatcttctctgtttttcttctttgtcatctaaccagaggtttgtcaattttgttgatcttgtcaaagaaccaacttttggtttcattagattctctctattgtttttctattctctgttttatcaccactgtaatttttcatgtttttgtctgttgtgcaggttatgggcttggtttgcacctctttttctagttctttaagttgtaaagattattgattttagatcttttaaatgtaggtatttactactattaattttcctctgaggattgcttttgctgcatcccataagttttggtatgtgtttttgtcttcatttatctgtattttctaatttcccatgtgatttctttgacatgttggttaagagtgtgttgtttaatatccacatatttatgatttttcattttccttctattattaatatctaacttcatttcattggggtcagagaagatactttgtatgatttaatatctttaaatttattgagacttattttgtggctcaaaatgtggtctgtcctggagaatatttcatatgcacttgagaagaatgtctgttctgctgttactgggtaggtgctctgcatatgttggttagtcttctctttccttattgatctttctagatgttctagccattattgaaaatgggggtattgaagtttctattattgttactttgtctgtttctcccttcatttctggccatgatttcttcctatattttgggggttctgttgtttaatgtatatatttatagtttttatatcttctaaattgacttccataagtattttagaatcaggttatgaagataccatccttatgctttcaagttttgctttagtgcttcctgttggtggtacctagtagggaaccagctgacaaaagaaagatgtaatttgcagagtctaagccccagcatcatgaagcatagacgacggaatttggaattatatagaagagtggatttggaattgaaaattttggtttacttactgatgctgtctggctgtctgaattttagcgtatgaactttgattaggtcttgataagcagtcagtggaacagcctatgagggacctcttccttgtagaattagaattgaatagccagcagctcacctcagacaaaatggatgcctgttgaaatgggccttttctcagtagagccctgcagaattttatgacttgtgcagtctgaggttttgccccaggtagatgagcaggagggcatctttccagtagtaacagagacaagctctcttcacctgtgctggaggatataccagttctcaaatcagacatgtgatagacttgccaagagaagaacctatataggtgagttccttgctaagttccaggtctcttcctagattcctgacagtgccttctatctgaatgtgtagtagtaattatggtctggttgactgccttcctgcattccaccctattctcatctacaccatattcagagtaacttggagtgttaatcatataggtaggatccttctctatttttcacggatgttgtgatggatcaaagttttatgttctgtattgtttgacttgccttagcaagaattgagggggtggggtgatgagttaaaggcatgtgcttaaattttattcccagaatacttttccatttgtattacaaataattacaggagaggaatcctggatacagacagtagacagcaactgtaacacatgcagaaaaggtatttattggaaggatgttagactgtaacacatgcagaaaaggtatttattggaaggttattaggttgcttcagaattgacataaaagtctgaagaactaggtttagtaaataggcattaagtgaagccagatacacagaaccactgtcagtgctgctgattaatgagcattggttatggcattgctacctctggatactggatgtgtctgcttccagagtgatttcttaaattgagtccttgtttctttacaggtatatagtaccagccatagcatctcattgcttacacataggtgataggcaatacccttgctgctagatgttaggaagattaagtatcttgaatttttctgacttctgtaggaagaggagggattctgttaccattatactaattaattcctgaatgttttggcagcttaagcaacataaaggaaaccgaaaggaatcctacattttattacagtgacttaaaataaaataaggggatgaagtttttatttgtgctgtgctatttagaaatgtagatataaatagactttctagactctatcctttcagcactttctgttcaggggtttaaagtaggggttggtactgttcacctgagaggcagcttggaaacatggggacattttttggttgttagaatgatggggatgagggcactattgcatttaattatatgtgggctgggtatgctaaacatcccatggtgccttggtggttgtgcacaataaataattgaattatcctcctcataatgccagtagtgcatttaagaaaaaccaggttatatggctatcttggtgaaggactaaaagttattactagcttcctttgcttcactgtctgcaccctctggctgaggattatttctcatttcgttgctttgctgttttctttccttagttcaagggacttgattcctttcaagctccaaaaatgttatttttaaactctggctttggctcggctcagtggctcatccctgtctctagagtccctgtttctagagaccctgtctctagagtccctgtttctagagaccctgtctctagaaaaaaataaaaaaattagccagatgtggtggcacacacctatatttccacgtaatcgggaggatcattgaagcaggaggctgtagggagctatgattgtgccactgtactcccacctgagtgatagagtgagaccctatctctaaaaagaaaacaaacaaacaaaaactgtgaaaaggtgcccggtagcatgggagaaaatatttgcaaatcatgtatctgataaggcattaatatccagaatatataaagaactcctacaactcaacaacaacaacaaaaaacctggtttaaaaatgggcaaaggacttgaaaagatatttttccaaagaagatgtataaatagccaataaacacatgaaaagatgctcaacaccactaatcattagggaaatataaagcaaaaccacaataagataacccttcacatctattaggatggctgttgtaaaaaaaaaaaaaaaaaaacaaagtaacaggtgttggagtggatatggaaaaattggaaaccttgtgcattgctgaggggaatgtaaaatggtgtagctgctgtagaaaacagtatggtgtgttcctttcagcagtctttgtgtagccagtagttgtgattctaataaaagtagcagttggtttgggactgatagtgattgttatgatttcaattgggtggtgctgacagtatgtggttcttggtatctgtgaggataaaccgcataagctatctcatttctatcttacatgagtggtgtggatcattccgtatcagtaggttcactaatgcaaataaagtacatttaaaacaatgtaaaaggtagtagtaaatgcaaaagtatggaggtaaaggtgtaccattagtttttgggcttcaaggcttggaactcagggttggcagctgtcttacttagtttgcttgagctgccttaacaaagtaccatggactggctggtttaagcaacaaacattatttcccacagttctggaggctgagaagtgatgaagatgctggctgattcagttcctggagaaagccctcttccaggcctgtagactgccactttctctgtgtgtcctctcatggtcttttctccatgtgtgcttgtgaagaaagagacagcagctctctttctcttcctttccttatagggccccaccctcactacttaatctaatcctgagtacctcccaaggccccccaccccccgccgtcatctccaaataccccctccccctatcatctccaaatactatcactttgggaattaggggttcaacatatgaattttggggggacacaaacatttactctataattgaatcagtctgagagataatatcttagtaacaaaccaggtaaatctaggctgaccacagaaacaagttgtcagtttggagaggccggacagaaaggaaagatgtgagccaataagacaaattagagacacttgaagagagggaaggttcaaagcctgaaaatgggatggcagagatttgagaaattatctataataacaaggagtgatggctataacaattttgttttggggttcttactaccttagatatatgtaggcaggggagacatggtaaagatgctgtattaggctgttcttgcattgctataaagaaatacccgagactgggtaatttataggaaaagaggtttaattggctcacagttctgcaggctatacaggaagtatgatgccaacatctgcttctgaagaggccccaggaagctcataattgtggcagaaagtgaagggcggggggagtgtaggcatctcacacagtaggagcaagagcgagagagtgagtgggagatgtcacaaaccaggtctcatgagagctcactattgtgaggacagcaccaagccatgagggatccatctcatgacccaaacacctgccaacaagccccacctccccaacactggggattacaattcaacatgagatttagtggggtcatatattaaactgtatcagatgcctgtagtactaataacagcttggggccaaggtctgcacaaagactgaatgggtgatgttttactccacaagaaaagaatgaatagtgtaccaaaacctttttaaaaataatatttacaataaattattttcatgtcttcacagataacccataatgactttttgctttgtactgatggtgatttctgatatcaacatcctggtgtatcagtgctgtttctgacctctttctgatggtagcttttgatgaaaatatacaaatttttggtaaaggatctttatggtgatcagaaatccacttcaacttttatcctttatacttcaaaatgtcaatgagaatgactacttaaaataccaaatcccatctaaaacaaccccccaaaatctcataaaatattgaagctaaaagaaagaacgagttactatgtgcatgatagtttcttctttttcctttgggttttataccttcttcagtttctgatttgttacagcagcagtccccaatctttttgggaccagggactggtttcatagaagataatttttccatggacagtgggtggggtgggggatgatggcttcagggtgaaactgttccacttcagatcaccataaggagtgtgcaacctagatccctcacatgagcagttcaaggtagggtttgcgctgctatgggattctaatgccatcgctgatctgacagttatgtggaatgcaagtggtaatgcttgcttgcacagctcacctcctgcttgccagccgagttcctaacaggccctggactggtactgatctgtggcctgggggttggggatcactgcattacaggaaggccaggccttattttatttagaacctgtatactggggtagtgatttttagtatttttttcattatgtgttttaaaactacaacaaagcaatttaaaggtcttataaggtttataccttttttttcttttttttttgtgtgtgtctgattgcactgctagaacctgtaatagatttttgagtagctttttgttcttgatcttaatggggaagctttcagtctttcacccttgagtatgatggctgctttaggtttttaataggtgccctgtatcagattaggaaatacccttgcattcctagttcgctgagaattttcatcaggaatggatattggatttggtcaaatactttttctgcatctcttgatgatcatgaggtcattctttttaagtcttttaatgtagcaagttgttacattagttgagttttgaatgttagacaccctttggtaattattctgtaatcttaaaagtagttttctgtgtttatgagggatattagtttgtttgtttatttatttattatatttgtctgattctggtatcagagtaatgttggccccatgaaatgagttggttttccattttcagtgtcctgaaagagtttccatagaactggtattgatttttacctaaatgcttgatagaattcgtcagtgaaataatctgaactggagttttctttgtggagaggttttaactatacattcagtttctttaatagatacaggctgttaaggtaatctagttcctgagttcacttgagtagttttttttttttaaacaaggaatgtaaattattgaattgttgacataaagttgctaataatagtttcttactgtcatttgagtatttgtaggattgtaattatatcagttctctcattgctgatattggtagtttgtggtttctcttttttcccttctcgtcattattagaaatttatcaattttattgatctcaaataactagcttttggatgtattggtttttctctgttcttttgttttatattttatttcttgttttgcttttatctttattattttctttcttcttctaactttgggtttaattttctcttttttccattttcttaagttagaagctgaggttcttgatataagatcttttttccccctaatatagattggttaatgctataattctctctttaacttttctttttttttcttcatattggcatttagtgctatgaatttcagtctaagaagtactttagctttatctacagtttgatgtttccattttctttcggttcagggcactttcaaatttcactttttaaaaaacgcctttattgaggtattattcacataccataccatccacccatttaaagtatacaattcagtggtttattcagagtttggtatgtttagtatattcacaattatctgcaatgatcaccagtcatctagttttacttttgatttcttcttggacctgtgattattgagaagtgttttattgagtttataaatatttggagactatccagatacctttatgttacctggtttctactctaatcccattgtagcaaaaaacatactttatatggtctgaatacttttaatttcattgaaacttgttttatgacctagaaaatggtctgtattggtacatgttccgtttgcatttaaacagaatgtatattttgttatagtgttctgtaaatgtcaattaggtcaagttggttgatggtgttgttcaagtcttttatgtccttattgattttccttctattttgatcagttattgagtgaaggatgttgaaattacctataacattgtgaatttgtttacttctttcatttctatcagtttttgcttcaggtattttgaaattttgttattaggtgtgtgacgtttatcattgttacattctcttgacatattgacctcattaatacaaagtgaccctttttatacctgctctaaaagttactgttagatttaatatagctgttctcacttaaactttattgagttactttacacactgtaaaatttacccatgttaactgtacagttaggtgggagctatgcctcctgtacataggatgatgatttccaaatctgtgttttcagactttgacatctgaacctacgagctttgttgacttcttaaacttaacaggtctaaaatcatacacattcatctctttctcactccttccctttatcccaaatcaccctttctttctttgttcttggttcagttaatggcacccgtttctatccagtcagtattgtgaaaaatctattattgttaattaattccttttccttctcatgtttaatcacttgcctaaatttctagctttctaaggtctcttatattggtccttcttctctgtatctactttaaatacattttattaggcccttgtcattttttgcctgggaggactgctgtgacttcctgactccttttcctacttccagccttatatcccctccctttctactcccaccttgcctcaagtcaatcctgaggaggcattctttccaagatttaagtacaatcatgccattttcaagttgaagttctttagtgccttgcatttttccccaggctgcattgttagctcaattaatgattgagcttttgtcttctctagcttccttgctatagtatattgtgttacttcttctgtgtctttgtacactctgctatcttcgtctagaatgcccttattacttgatctgcatggcaaactcttattcttttaatttttatttgaagatcatgtatgtctttctctgtttccctatgtaaatctgctttcaagtcatatacttgtatggttaacaagtaactattcttttctatgtatatcttaccttttctatagctgtccgtggtatttattttctctttcacacattttgtgcttactttgtttatgtattcattagattgtgaactcctgtgggcaaatcatgtgccttatttttctctgtataccttgcctttcacatttcgtaaattttactgagttaagctgaaattacttgaatgacagataaccattgatttaatctgaaattaccataaacgcaaactgaaatcctttgaaaaccctagttagaataatctataactgctttctacagaaacaaaatcttttaatagccagataggtgacctatacctaactagagacagtaagtttgtgttgatggtccatggctgcattattaaagtgggagtgctaaagcacttagtattttgtaggtgccacatgaccaaagtaattggatttggtataaaagcttgaggttctgtggatttctcagtgcttagccttaaatcttttttagcctctttcatgtggccaaccaattcatattgagaaacagttgggcttcttcattaacgtgttattttaggaaagggattactgttaaggagtggtgatcccaaatgtgatacaatttgtcttgtttggcctttaactacagtcagtacactggaaactatgtgattcttaagatgataatgttcagaaacttttggtcatttgtaagacagtattattctgtgctggtagagtatgttcatttgctgttgaaaatcatcttagaccagatttgtaaacatctcccttataataacaccattttaattaacctcttggttatttccaggtttaaggagatctttttattaccttgaaggtgtggcatttcttttaggaaggtcttaaattccttcaggcacttgccactaaaggagtgtagaatgctgttgtttcattattttctgtatcagttgctgactatcctatagtcatttcccaaaatcattcttggcctatattgtgcacaagtaactatttatataactgcttcaactatttttttttttgtgtgtgtgtgtgttttcctggattctctgaaatttcttttgaatattattaaaatataggatgtttgagaaggctatttaatatctaactttgtcataaaaaaacttttagtattggccattgttacttatcttttaaaaggtagcattacattgttgattcatttagcatttttttttagtcattaaatggagcaatggggagttattcttggaatttggcgatgagagtcaatgtaaaattcatttatgattgttaacaatagttatctgccaaagtctttaaagggctctcatattcttagaccttattcggaagaagatggtctagaaatcttagcaaggtagtaatggatgtgaatgaaagctgatataaatagtggtattatcatagaagaaataatgtatcaatggaagtttgaatgtgtggagtctagtgatgggacccaatagatagggagggaaggaaattatgtttactgagtacctgctgtctgctcgtagtttccttcccttgctgagctcttatttatttgttgattcttttgagttttctatgtagaactcctattgcctgtgacaaaagacagtgggtttcctttttttttttttgagatggagtcttgccctgtcgcccaggctggagtgcagtggcgcagtcttggctcactgcaagctctgcctcccgggttcacgccattctcctgcctcagcctcctgagtagctgggactacaggcacccgccaccatgcctggctaatttttttgtattttcagtagagacggggtttcaccgtattagccaggatggtctcaatctcctgacctcgtgatccgcccgcctcggcctcccaaagtgctgggattacaggggtgagccactgcgcctggccttcattttctctttttatgttgctggctaggacttctagtacaatcaaattgaagccgtgatagtgagcatccttacttgtttccctcactttgagagagaattacttttgtagtttatcaagaatgtgatttgctgtagtttttggagatatcttttattaggttgaagaagttctctttttctccattcactttcttcttctgtttctactgaatgagtgtaagagcagaagtgaccaaaaggctggaacactgtacttttgagggtacattgaagatgataaagccaatgatcagaggcctgttggtaaagcaggtttgaggaagagggagcttcaaaggaaggatcaatttttaacagtggtggatagaagagtgatgtaaagtgtaggaagtggaaacagcaagtgtagtactgtttgaaaaagtaaagtgaaggaaggagaacaccaatgaaggttgaagtggaggcagttttgaggggagtttttatttattttttaaggacgggtgaaacttcatatttgtaagtaaaggttaaagctccagtagagaaggaaagagtgaatataaaggaaaatttctgccaaccaaaattccagcgtaattttatgtatccctatgtaaattagaatcatccagaatgcttccaaacatgattcaagagccacagcggcttaagcaagatagaagttaatttctgttcacacgtatgaattctgcaggacagtttcaataagagaggctgagaaatagagtttttatttagcaggatcatgggtctagccaaaacttgagggctctaggactaaggaggaagaaagaaaagattttgggagacagttttcagtatctgcacagtaagtgtgagaaaactcttaaataaaatttatctctctcagtatttgcatagtgtttaagaagtcaaaatgcatttgtttatatctagactctacttactagctccttgaccctgaacaaactatttttctctttgtgccttaattttttcataacaaggtagagaataatggtgtttgatagagagtacctcataagttggtatgataattaaataagataatatatgtaattgatgaagccattgccttgtacatctaagccacaattactagttttgttgtcatttgcccttgctcttcaaggatcagggatgtgttgaaggacaaaacacaaaaaaacaaaataatataacaaaaacaacaaacaaaaccttatattacttatgggatatccaaaagttaattaaatattacacattaagatacaattgaaaagagtaacttcaaatctcatgagaacttgtagatataaaactagatttttttggaaaccttggaaggtactcagccaaactgcaaagtttgaggacacagttcttcacatgaccactctcacatctggcaccacttgcaaattcagagggctccccagaccaccctctggcttgataatttgcaaggactcacaaagggattacagattacagggatccagattaaaatcagccaagggaagaaacacatagggtgaagtcaggaaagttccaaatgttgatctgccagtgtccttttcccatggagtcaggacatgttcttccagcaccaatgtgtgacagtatgcatgattgccaacctggtaacctcatccaagcttcagtgtatagagttttatggggcttcattatgtaggcatcattgattgattactcaattacctgtatggttgaactcagtctcccaatggactgatactgtgtaacccagagccttgtcctaagccatattgttggtgtttatgacatggccagcttttgctttaaaactattagttgtggccaaccctacctgaagatctggtatggccagcacccataataaacaagcacacttctatcaactatgacacattacctcccagaagctgaagtcaatggtgagacttctctttggacaaggccaaattctttactacacaggaagatacaagacactgatgaaaaggaatgatctttacaaatgaaagtctaacataattatctgttgaaaataccaaagttaaaaacaatcttaaaaatatgtatataagagaaagatcatccaagtgaaaataaaacccccagctggagtaatttaaaaatctagaaatttggctgccaaagcaaaatttgaggaaccatttgcatggagatcaaaatgaaaataaaattttgagtcatatagagaagaaaactagcaagaaagttcatagtgctactaaataattattgtgaaaactcaaggaaaagaaataaagcacattatttgctttggcagttgtaaagattgctgcattaacttgtaatttggaacagagaggttagaaggattgaaattattgacttacatgtgtatagaacattactttttacttgattccaaggtaagtacaaggaagtacttagcaaaaaagggttatagtgcttttaaagtggtatagtcagggtagtgtatgttttcctatctctgttaatgaaggtactaatcatagaggttttttttttttttagtgattgttccaggttgtagtgtgaggcatgggcagagatggaactaaaatctttgtctcctgacttttgggttaagtatactttttttctaactgcaaaatgattcctcttggaacccagttaataggaggtctgactgaatttcctggaactctggagtttctcttaggaccagtctggttagtcttttcttgccctctagttgatattggttcttctgaaatagtttactcactaaactcttaagcaaatagtgcttgttgaggaacaaataaaaataaatctatagattatttagattttcaaaatgtgtttgaataaggctcttcacaatattgcaacaacataggttctgatgagcaaagtttgactgctgtaacaataacaagtgggataagatgattggagctttcctttagagcaaacatttagagggctcaattttttatttttaaaaataattataaaaattattatacatgttgctatcaaatgtactttgcacctgtggaggaacaactgatgctaacacgaagttaatagcaatagtaagtgaaaatggaaaactgttacatggcagtgttattaaggggtctcaccataacaccttgtcattaattttaatatggattttaatatttaatatgcatttgtattgcctaccctgtagtcagagccgctgtttataaccccctttttttttttttttttttttggagacgtagtttcgcttttgttggcccaggctggagtgcaatgtcacgatctcagcttagtgaaacctccgcctcccaggttcaagcaattctcctgcctcagcctcctgagtagctgggattacaggcacctaccaccatgcccagctaatttttgtatgtttagtagagacggggtttcaccatgttggccaggctggtctcgaactcctgacctcacgtgatccacccgccttagcctcccaaagtgctgggattacaggtgtgagccaccacacccggccttacaactcttttgactgtttgtagcctcatgatggtatatagactttgtatatcatatttacttcagatggggtcttagaatctgtatttgcattttagtatttttaaacacctattatatgccaggtagtgtcctaggcattgagggatatgttggaacaaaaatcagatagggtctctgaacttaatggagttaatagtcatcaggagagacaggcattactcaaagaatcacatgtggttaagtactatgaaggaaagatacatggtgccatcagactgtatattagggagatttgtctaatctaggagaagttatgattgatcagtgacttgaaggtaaagaagaaattgtaagagtgttttaagcgaggaaacctcatgcatatggggctattgatgggaaagaaaatggtgtgtaaaagaactgaaagaaggtggctgggcacggtggctcatgcctgtaatcccagcactttgggagcctgaggtgggtggattgcctgagctcaggagttcatgaccagcctgggcaacatggtgaaaccccgtttctactaaaatacaaaaaattagccaggcgtggtggcgtgtgcctgtagtcccagcttgttgggaggctgaagcaggagactctgttgaatctgggaggcagaggttgcagtgagccgagatcgtgccactgcactacagcctgggtgacagagggagactctatttcaaaaaaaaaaaaaagaactgaaagaaggtgtgtggctgtagaacagagagctagaggagtatgtatgagatgaagcttgagagatagatagaagctacattatacagaatttcttaataggccataatataatagaattccttaggataagggaagccatgaagtgttttaagtgagagtgaggcatagtctgaataatttcagaaagcacattgggtctatagtatggatggagaatagcttgtgggtgggttggagagtggttggagagtgaatgtgtgaagactattggaagcgtattacagtagtttaggtgaggcatgatggtagcctccttattgtggttccatcgcatgctaaaaagagtatgcagaaaaggaggactatgactaagtaagttcaagaagtgttgtgttaggcaactctattgcagaacttctcagggcttttaaaatgcccatgtgcgtggtgaagctctgtgaggggatatgggatgttttgtggcatatatgtcttgccccccacagggtggactctagaaaatggtgtgtaatacctgttcgtggaagctcactggtaggtgaagatgctttctgagtgataacatatgagctattgcaaacatggttggggattccacatgccatttagcaataacttggggataatgtggtacgtggagatagaaatggaaagcttgttttcctggggcaatctccccatttgtcatcaggacagaaaattacccttgaaagagccagtcttccccatttgatgttgctcttctttggggcccatttccaggtcctctgtttttctgaatctgtgtgcctgcttgcacagtgagtgggtgagttggggaaattctcagctggaaatgtcagaatacccattgatagttactccatagaatctgaaatctggggacaattgagggccgtggtggtaactcatgatagcaagcactttccctctttctcttctgtcctgaaccatgttggccacttgacctcaggcttatagtctcttgattgcaagatggctctcttagctttaggcttcacaaatacatttgaagacaggaataggtggttgggtgggtttagacttagcaggtaaatgtccttttctcaactggctctgtccatttgttaatccgtaaaggaaaattcctggtagttcccttttttctctctggttgaaatagggttttatggctacccttagctgcaaggacagctgggaaagacttgattaacatagatggattatgatctgttctctggggttagtagtaccgtgtttttctgttggtaaaatgtggggctgggattggaagactcttgggtgtttctgccttggatatcttatataagacttcaatcagcacctatgtgctgatgatgcccttgtctgcctgagtcgcctgaacagatcagccctcatgtcagtttctcatggtttcattcagggaccaaccttagttccctgccctgttcctcccacatcaatccagtctgtctgtagggcccgtggattcttcctccctgctgaatgaccttttgtgttactgaccgtctagcctacttcacctccctctccctttctctctcttgtttctcttatcagcaccttttcagtgctaataactctttttttttctccagtgtttaacattttattgttaatactagataatattagattgtgaatttttcttttggcatacaggtttatgatttaacacgtgctattcatgtaactaccatcataattatatatgtaacaattctatcattaaaaaaaaaactcccttgtgttattcctttatagttagcccatccctcatccataactcctggctaccactaatctattcaccatccctcttttttgtcttttttgagaatgtcatataaatggaatcatatagtatataaccttttgaaattggcttctttcactcggataagaatgcctttgagatccattcaagaagtgtgtataaacaattcactcctttttattgctaagtagtagtctgtagtgtggatataccacagttttgtttaactgtttatttttggaggatatcttgattgttttcagtttttgcctattatgggctataaacatttgtgtatagtcctttgtcctccattttttttcattatggcaaaatacaattaacataaaatttaccatcttaaccattttaatgtgtacaattcagtagcattaaatacattcatattgttgtacaaccatcaccatcatccatttccagaactcttttcatcttgcaaacctgaaactctgtctgtacccattaaacaataacttctcattatcccatctctagttcctggctaccaccattctactttttgtctctagggttttgccttctttaagtaccttctacaagtggaatcatacagtatttgtctttttgtgaccagcttgtataaaggtttttttttttttttcagtgatcataagtctttatttctctgagataaatgccgagaagtgcatttgcaggattctatgatagttacatctttagtgttttaaaaaaacacaaacttttccaaagtggaaaaatttacaccattttacattctcactagcaatgttataagttcagccatctgcagagcttgaattaaatttctggagagatgacctattgactcttgggttaggtgtttacccttagagtagtcatcgttggttgactgatttggaaaagagtgttttacagtaagtaccactcttgtattcattcctgtggattggggtggatatagagggaatattgaactctctttcacaaaagtagggctgggtggaaaacggtgtaggtgtccattgcagtagtggtttccaaatctgtgtgtacaccagaatcatctgaggagctcttcatgatacagattcatgggtttcatatagacctactaaattggaatctgtttttaacaagagttcaagagagttttaagtagtcatgcccacatctgttgggaatgttacattatagtatctatgcacttttgaaaacttaaaggttttagaagcatatgctgtactatataaatgaaaaacttcctgttctcttatcttttcctcttatttttttctttggccttatgtttatatttttgtctcttctctgttacttattctatttttgttttctctcctccatttagttttcactggtgtctgttttttgcaagtgtctatggataagttactgttatctttgctcttagtctggaaattgtataaagagattataaacagagtttgatcttaggcatccagggttccttttctttctcattccagatctgaatgtgtctcactgataattctttccttttaatggcaaaagtagaaaacaagttcctgggtttaatggagaaacctttatgttttatatttaaaggttgacattcttaagtaggctcactgttacgttttatttccttcttttctcacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagaggtaataagctgagttttgtgatatggagtgtttatggatttgtatttggatacaaacaaatatatataatctatggtatcctgttttgatctgtttattcttgggtcatagttgtagtatagtttccaggttggtaataaggactagaactctttcttgtttttttttttaatgttaattataatgtaattattggacacttaaaatatttttgatacaacttttggatggttagtgccactcattctttgttcagagatcttttgaaattcagcgttttattaataatatatctgtatataacttattgtctaagcagtttcttaaatgttcagttacaaagggactctgctagatactatgcagatcacctcataaacatgcttctaaagagctagcattatatctccaattttttaaggaacatgtcatggtatccctcaactatactgtagattaagaacacattccttccaaaaagtctccatggattgaaaaatgggaaagaattgatttcaaaattctttaaatttatttagcctcagaagtctttcaatttgttattctgtagttacttaaaagtaaagagaataccagatgggaaaaatctagtgaatatttgggttaaactttgttaattagaactcctaaaaattctgggtggagtttgtgattatactgcctgtgaagaaaaatattttatcagagtgtaattgtaccaacaatatttcagaaggtttaattattataaagtaagataaatttagttcaagtaatcaaatatctatttggatatattctagtaatggatatggaaggtatagcagatactttaagcttagccttatgaattattataaaaccttgaccttgatggagtagaaatagagctgtgctctgattttacctcacctctagagtctgttttatatgtagactacttaaggcacttccttcggacagtgttgggagagacagtgatagattttttttcagatgcctgacttgctttttttcagatgtcattacaatgtactgaaatacttttttcaaatacgtaataattcagatagataaccatgtgtgttcaggggacccccagatgatcctcaggttcagtgactcaccagaagtacccacggaactcagcatatagaaacatgttttagtttgctgaacttttatcctgttattttactgaagttatttattcttatagcttttttgtagattgcttgtgatttttcttatacgtagtcatgtcttctgtgaagagatacttttactttttccttcttgatttttataccttttatattttttttcttgtcgtactgcagtggctaggagttctaatacattgttcaaagtaagtggcgagaatggacatactaggtttgttcccaactttaggggttaagcatccagtcttttgccattaactatgttgtgtcaactgtaggttttttaaagatgctgtttattaggttgaggatgtctccttgtaattgtagtttactgagagttttatcatgaatgagtgttgaattttgtcagatgcattgtcttcatttttctctagatgactgtatgattttttttcctttattctgttaacatggtaaattacattgttttttggatgttaaattagtcttatattcctgggttaaactccactttgtcgtggtatggtatctgtcttagatgttgctaatttttcttaaggaattttgcatctgtgttcttgagatacattggtcttgagttttcttgtaatatctttgcttgattttggtgtctgattaatgctggctgcataaagcaagttgggaaatgtttaatgaatagtatgctgttaaatgaatagatttttggtctactattatataattcgtctgatatataattaaatactctgctattgtataactcagaactccttgggttgtaagacactcagctcaaactaagtgatacaaatagtatttattggtttaatggctctaaacaagggcttcaagtttggctgaatccaagcctgtagatattattgtgagtgttaagcatctgtctctctttccttttgctagtttctccatgctggcagagagccattatcagctccaggattatatattacatagaccatcagattgcagaataaaaaagccctctatctcatggtgtcaataacaatatgtgtaaaaagaacttgattgttcctacctgaatcacatgtatccactcactttgtttagggcaggggttgacagctgcaacctgtgggccaaattctgcttgctgtctgttttttaaaaataaattttaggctgggcatggtggctcacacctgtaatcccagcactttgggaggccaaagtgggcggatcatgaggtcaggagatcaagaccattctggctgacacggtgaaaccctgtctctactaaaaataacaaaaaattagccaggtgtggtggtgggcacctctagtcccaggaggctgaggcaggagaatggtgtgaacccgggaggtggagcttgcagtgagctgagctggtgtcactgcattccagcctgggtgacagagcgagactccatctcaaacaaaaaaaataaataaaataaattttaatttgaacacaaccatgtccatttacttagatattatctgggactgcttttatgctgtaacagcagagttagtttgttgatctctggtctaaggataggggattttctagctagggtgagttaattggtggtagaagcagagcctcttgattgacagctctgttatatgtgaggaaaggagagctgtccccaaaaagacttaacatttctcaaaaggaaagaatgccaaacaaatatgtacctcctgaagaaagaagacttttctattatgcccatttttttcctgtcatatagatgagattaaacatagttatgtatgttttcatactgatacaaatgctaattgaataatgtactaatatagatctggaagaatgggcaaggatatagtaatagaacccaaaattgtatgaaataaaaaaacagtttgtgaaaaatttaaattgatggattataatttttctcttttcagatgatgaaacatgcttgggataactataggacatatgggtggggacataatgaactcagacctattgcaaggaaaggacactcccctaacatatttggtaagtttactttttctaattactatttccattttctacctccatcttttaaaacaagatgtaacttttcaaagtactttctaaaatctgagtatttctgtggaactataatttgaagaaacaggtatgattttttgcaagtgtcagtcacgattaagttccagttgctttggagtacacatatatgtggtagattttctatttacatatggatgctttagtcatttatctgagtatttaaaagcttttttttggcatttttttctttagtgtcaggaaaagtaggcacctacttgtcatttttttcttcaacacaatacctattctgatattcacattacagaggaagaggggagggataggaaattcttgtagttctgtgtacattttttaaaaaagtgacatacctgggatgattgggttactgaattcagtgggttatgttgtacattcacagttcctaaggaaaaattaacaatgtgttctgtgaatggaggtttggggaagagctgtgttcatcttgagtttgttcatcctactttccctgagctcagttcacttgtaaaacttcccagtttaacttaaccaatttaacaacttttactaaacccaaaggtaagtcttcagaattgttaagctactctttgtagtcttcactcctttcccccattttaaatgcttcttgatgtgacttgatcattatcttttaagtaatgatagatgaaggcaagaaaattttaatgggctaaaaagtcacaaactagttatatgcaatctgattttattacctgtagtaaaccatcacagtaattcaaataacagcaattttctttttgacactagggaaggatttttctaatgctgtgagttttcttataatttgttcattgttgcttgcttttgatcaaaaaagaaaatgtcttaaaaaataatttctgttgggtttgggagatgttgtggtagaggagtaaaggaaaaaagtttcctctaggtaatcagtgactactagagacttcataatatgatatttaatttatcagccattatgtaatgaaataaagtatattttcttaacagagttttggactggaaagttcttactgctttgtggatgtcacaatatgaggcgttagtgcaataaagacattaaatttaatagtcaattaaatttagaacctcccttcaagtaactatttttatgttaaactcaacggtaaattgtgagccttttaaaaagattggagtataaaaatgtattgaaaataaaaattggatgtcaattttttacttttttcaaacgatatttctcagaacatctaatgtattaatatttatcaaatagatactggtcctatctgtttatcagataaatattgatgctttagtaaactttaaaggtagaagaaaattaattttgacacttaggaaacatctattctgcgaagaaaattatagtgaaatggtagaaaaagaaaatctacagaattttcagtagtcaaaattaggtgctgcttattttttattgaatttttgagtggttacagtttcttttccagccagataagctaagtaggaatagatccattattatgttttgtcttatgtttgtagctatgcagtcagtttgttaaaggattattttttatagtttaatactttgtttcctacttactctgtttcttttgtgtatctcaaattcttgccagtaagtacaatttgagtttttttaatctattttttgatctttttcttttttaaaaaaacagtaaaagtctaagagaagcgtggtaagtagttctcagtgtctcatttgacatctcaaatttagtatgcctttacagaataggaatatgtaggtggatactgaacctttgcttgcaatattctagattttagggaaaacattaacttaaaacactctttttgttagccttgattattaaacaattcttttatatggtaactgagataggggctcctctgacttctgtctagttagttcttggcatcagagtcctctttacatgcagataacagaaaatccattgcaaaatggcttaaactaaaaagaaaacttaatcagctgaatgaattcctggtgtatatctgattttacctgagcttttttactttatcttttctgttttcctgtgttttgatataatcaagctggtttcttagcaggatggctgcagcaacttgaagcttcatatcttcatactaccacagctgtgggaaagagaacattgtagagaagagagcactcggatgtcttagaaatataattgaaatactcactgtttcttattgtctctgattaggtcttgtgcccattgttgaaccaaatgctgtgcttaggaggatgggacatgttctttttgttttgcttagttagggcctggctctggagccaggagaggggaggaggaaatgttgctggatgtaagttagcactgatactaattattctaacaatgattaatagttagaatggctgggtgcagtggcacatagtcccagctccgcaggaggttgagatgggaggatcgcctggggccaggagtccaaggctatggggcgccatgatcatgatgcctgtgaatagccactgtgccctaacctgggcaacatagcaacatagcaaaaccctttctcttaaaaaaaaaaaaaaaaaaaagcagaatgagttctttctatttagatattctggaaagtagaaagttttgttagggataggtctttttgcatgtagaagaaattattttaatttgtaaaaagtattctttgattttgcaatgctctttgaagggtgcattttattttccaggtgtgtgtgtgtgtgtatttatatgtaaatatgttccttttgttatttctgacttaactgtgatttgatttgtacatgttttgttgaagattgttgcttctatattaataagagatactgctctgtacttttcttgtattatctttgtcttgttttgatatcagagtaatgctggactcagaaaatgatttgggaagtgttttctgcttttcagttttctggatgagattgtttaggattggttttatttttttctttaatgtttggtatatgttgctgaagaaaccacttgcatctggaatttttttttttcttgaaggtttttaaactacaaacttaatttctctaatagtaaggaccattcagtttatctgtttcattttggttgagttttggtaatttgtggtttttgagtaattggtctggttttatctaagttattgattttatatgcatagaattgtttggagtattgccttgtcatttgaatgtctgtggcagctgtagtaataatcccctttcatttctaatattattgatttatgttttgtctcctctcttgtcctgctagaagtttattaattttattgatcttttcaaagaaacaacttttgggttcattgatctttgtaatattttctttgtgttttcatttctttgatttctactctttattgttttcttcttttgcatgatttgggttgattttgctcttgtttttccagtgtcttgaagtagaagcctagattattgaccagagatcctcttttctaatgtgtttattactgtaaactttctaactactgcttttgctgcatccctgaggttttgatatattttcattttcattcaattcagtgttttaaaattttccttgcgtaagtttaagtatttagagtttaaaaaaatccttctgttacagatttctcgttttaattttgttaggatcagagaatgtacttcacataattttcattcttttaaattatttttggtttgcttttagacacaggtttgtcttggtgaattttccatttgttcttagaaagaatggtatgtgtatattctgctgttattgtgtggaatgttctattgatgtcagttagatcccattggttaatggggttgttcaggctgtctctatcttagttgggtttctgtctcattctgtcagttactgagagagggatgttgaagtcctcaactcttattttggacttctttcagttctgccaacttttgcttaatgtaatttgaggtactcttgtcaggtgtttgtccattaaggatgatgtattcttaggagcaccactaaagtcctagtatcaaaaccagacaaagatatttataaaaaaaggaaactatagagcaatatcccttatgaacatagacataagaatatttaattaaattttagtaaatcttattgagtaatacagttgtcctttggtatccatggaggattggtttcaggactccagagaataccaaaatccatggatgcccaagtctcttttataaaatagtatataatatttgcatataacctaagcatattctcatatatttaaaattatctctagattacttagaatacctaatacaatagaaatagttgttatactgtgtcttaaaatttttgttttttaaattgctgtgttatttttaaaattattttccccaaatattttccgtctaccgttggttgaacctgtggatatgtaactggtgaatactgaaggctgagtgtatattacattatgactaagtggaatttatcatagagatacgtggtaggttttacatttggaaattagctagtgtagtttaagatatcagtataataaaagagaaaaatcataggattatcccagtagttggagaaaaagcatttaataacatttaacatccatcgatgataaaaactgtcagcacactaaactaaaaaggggatttctttaacctgataaagagaatttcaaaacaacaacaataagcaaaaaatgcaaaataccccccacatacttaatattgaaagactatatgctttcccctaagattgcaagctaggcaaaggtgtctaccctctcacttttatgtaacattgtactggagatcctagccagtgcactaaggcagaaaaaagaaaaagaaaaaaaaaaaagaataaagattggaaatgaagaagtaaaactatctttacatttttagtcaacataattgcccacagagagaatcctagggaatgtacccaaaaaaggtgctagaataaacaaatttagtaatgttataggatacaagtttaatatgcaaaaccaattatgtgtcttggtatacttgcaacaaacagttataaacacagtttaaaaaataaagtcatttgcagtagtatcaaaaaataagaactatatgtgtataaatttgacaaaatatgtacagaacctgcacatggaaaactttatgttgtttttgagagaaatttaaaaggacttaatggagagaaatgccatgttgatgaatttgaatattcaatattgttgggatgttaattctttctaaatttatgtttaaatttagaggagtccaatgaaaatgactaggcttttctgtagaaattggcaagttgattctaaaatctatgaaaatacaaagcacttagaatagtcaagtaatttttttaaaaaaaaccaagttgaaggatttgcactacctgattttataaattacagtaaagctacaattcaggacagtatggttttagcataaggatgggcatagagatctgtggaaaagaatagaaatagaagtgtacatacatggttaattgattttcaacaaagatgctgaggttcagtgattaaaaggatagcctttccaacaagtggtgctgggtcaactgtatatttgtatgggaaaagaatgagctttgcctcttccttcaacattgtatagaaaaatggatcacagagctaaatataaaagctaaaagtaaaaaaatttcagtagaaaacacttgagaacatctttgtgactttgaggttagcaaggattttttagaacacaaaaagcattaagtataaaataaaaatgttggtaaattggacttaatgaaaattgaagatttctgctccccaaagacatcaggaaattggaaagacaaaccaaagacttggagaagatatttgaaatatttacataaggatgtatccagaatatataaatacttccccacccaaggaggtatatgaatagccagtaagcacatcaataagcagggaaagtaaaattcacaccacaatggaatatttctacacacccattaacatgtctaaaatttgaggatcaacaataccaaatattgacaaggatgctagagcaactctgttatacattgtattgggaatgtaaaatggtacactgtggaaagcagtttgttggtttcttataaacttactgtatagcctagcaattccactcctaaatatttccttggtgctcacaaatgagatcaggtgtagttgtatgtttcttagtaaattcgatttttttccgccaatgatataaagaatttacaaattgaattttaagatctttttccctatgttatataaaagtttgtatagaataggagttatcatccttaaaattaaagtagtagtcattctatgaaacttctagaatatggtattttgatagcgggtagctctttgaaaacttttttatttcctgtgtttttcggtctgtttagattttctgtttcttctttcataagtcaaaaatagtatttctcgagaaagatcaaatttattgtgaatatatgaataaaatgggccttttataattttaaaaaattttctctgtgcttgtctgttgttacatttttatttattttgtgtttttgtcttgtctaccttttaaaaacgaggttaatggtagattcattgtatggttcttcatggaaccatttcttgaatttattatttcaataattttcttcatttctaattcatccatttctgcctttagtttttctcattcttctattattttgctcaaatttgttttttctttcttagaatattcagttattttcatttgttcttattaactagtataaatattttaagtgtttttgtgagaactgctttagttgattcacttgctctcatactaaatttttatgatgttttatatattttgcaatgtcatgttttgctgcttctttgacccaagaatagtgttaggctttttcattttttcctgttcaaatcttgacttcctctaggtaaacaatcatgatgatagccagtaatttcaattttacacttttcttccttgaagcctttagctcatggcacctagtgcaactaaccaagactggtacagaataggtgggtcaggcctttttccactccagaatagtcaataccttagagaaatatgtacttagaggactaaataaataactaggtaactggaggagcagaactatctacaaaaattaaaataaggacacaaacagtagtctcaaggatttaaaataagtttggtaaatgttttggatgaaatgctaaaattaaaagagaatacatattcaagaatttatgcaagagatagagatatatgagtgattaaatggcttgataccatttttatcgtaataaaaagctgaggaacgtaacaacacataactttctagataatatcaacatgaagggaactgagtaggtagaagaccaaggaatttatcagagtgtgttggagtatttgtcttgttagctaagagaagatagatgtattgataagttgaagaaattattaggaacacatgaacaagaaaatggcatgtaaattaagaacaaccatcataagaacaaatttgtgtagctttaaatcattggaagaaaacaatttctactcagtagaaagaggaatggaaaaagaaagaaaagaggagaatagtaaatggaaaatgtgaactaagtaatgttgaatgctggctctgaaaatgtcaccaagaaaacccgttgataagacaaagctgttaattattactttggtaaggagatcactacctcgctggagtcgtaacctttcagagttttggggtataaatcatcatttgatactttctgttgtagagttgatgggtctttaaagaagttcctggaatgaacaataaattttttttgcaacttttatctttctgagcaagagctcctggaacagtaaattcatgttgttgaagacaatgtaatatagtaaagccatgttaatgcaggcagtaagctgtgtggatcatttgcattttcataggacacaaataataattgcattaatgggattggggtgaacccatctgctccctgatatttatttttttgctgtactactagattttttactctactagtagcaaaacaaacctagtttatttaggatttgtagagttatattcattagtaagattggcctgttttcttctcttaagttttcattatctagttttggtatcagttaggctggttttgaattaattcttccctctcttcctccctttctctcttgctttcttcccctcagaacatttttttaatgataaggattatctctttcttaaaagtggatacattttattattttgattttctctactcatattttgtttgatggtttccttttttcaatttgatctacctgcttgttgattgttaaggattgttttttttccactgtggttatccagccctgttgtacatttattattatttttaaatatattttttgtcctttatatgaatttggaccagaccagaaggacatggttgtcttattacttagctttgtcattgtgaagtactctcctcttttcttgaattaatcctctttttttttcctttctcagttaagtagatagatatctcatattctgacgaggcagaaaattaaggaaaagtatgcttttagttttcttttatcttcctatttttagtaaagtactatttttagtaaaatatattaaactatgtatattatctaatatatacatataatttctaatgtaaaagggaacaatattgggtattctaaatttttagtccttatactcttactttagtttacctttatacataaataattaaaatacactgaatgtgaagggaatcttttttttccccccaaagagaacaggaacctaaagggatctttttaatgataatttttttcttcccaaatataggaagttcacaaatgggtgctaccatagtagatgctttggataccctttatatcatgggacttcatgatgaattcctagatgggcaaagatggattgaagacaaccttgatttcagtgtggtgagtgtatgattgataactaatctcttagattaaccatgaaaagacacaatgtctaactgctatggtctgaacatttgtgccttcctaaaattcatatgttgaaacctaatcactaatgtgacggtactagaagatggggactttgggaggtgattaggtcatgagggttgacctctcatgaatggaaaaaatatatatatatattttaaagttgagtaattagcacagcttcgatgaattttcatagttaggcctacactcattcttctggcactttagcatggtcaagtggcactgcttaggtttggcatagttgttaagtcacacgcccagcacagttgcattcttggtgtgcgacttgagaaagttccttatcttcctaaacctgtcataaaattgatattccattatagtattgtgaggattatttgagataatgtggtacatattaaatgctcagtaaatggtagcaattattttcattatcaccagtcttcacctaaaagatgtgtggactgttttgtcatattcacatcttttgtgatatttgtgcttgcttttccttttgactgtattatccttcactacttctctatgtacttctctctggcagactcttcgttatttaaattgtgatataagtccataattatttcttctctgatgccattcttggagctaactagacaaaaatggtttactttcctttatattactgtagaatttggacgtatctcaaagagaacaatttttattatcaattaagtttaggtttgatggtgagtgatagaaaacctaatataaaagagcttaaacaagatagatatttatttttttttcatgtaaatcaagtacagagttaagcagttcagggctggtttgggtggctccttgatcatcaaggatctaggatcatttgtcttgttgttctgttggcttcagtgtatatcttagacctcatgatatgaaatggttcctaaagatccagacattttatccagttgacagaaagaatgtgactgttctctaagaagacttctcaggaggtagtctccccatttttgcttttagagtttactaacacagcctcaactaactccaaaggaaagctgagaaatgtagtctttttttctgtgtagctatgtagcctttatacaacagattgtgctttttgtatcttgtttaagaaagccctactcctagatcatgaatatattttcttatattttattctgaaggttttaaagttttgcttttgtatttagtctttaatccaaatggaattgaattttttttaatgtaggatgaagtaggccactattagttgatcctagtaccatttcttttcctgctacttttatatgccacattagtcatatattagtcatattacagtttattctttaacattggcttttttctttatccatatgtcaatactaaactatcttaactacaattttttttataagaagcttgatgtctgtatctgaatctgttctctgttggtatctgatcttgttctctgcggaaattgtcttagttctcagctttttgttctttcaagttctggaaaactgtgtggaaattttgaggaggattgcatttaatttgcagattaatttggggagaattagcatctgtgcaatactcccattcattgacaggacagctttataatggctaataattcccttgtatatcattattatcagtcagggttcaatcaggaaccagactatgccatttattttaactagaggatttaatgtttagaattgttatccaactaatggggaaccaaaaaggcaaaaagagagcattgtgatatcaccagaagtattaactctaggaaacaggaaacagctgccacctgtggggactataagaacaatgggaagaggttgggatcattaaaatgcagtagcttgggctctatggaactggtacctgtgctgcccaggtgttactggtacctcaggaagactgtgtcagagctgagactcagaactctgaggaggagacacctagccaagtgcttgatatctgtaaaggaaaccatgaggctgatttggggattgtgtgtctgtatgtgtgataagggaacagtactctggaagcagttgccactgccagggtgaaccctggctggtgagacactatcagaaactagaagtaagcaggagggaataagactcttcttcctccagtcttgtattgtctttttagaacctcctaatgttagtgcctaaaagggagccagttggtaaattaaatgcatttgtgtagttccaactcccatataccaaagtagagtatagaagaatggatttgaacctgagagaagtagtgtaatcatcagcacagtcattttttgttcctttctttcaacctttaaatgtcattatgttttagctgcttattttgcatatatagtatgtatttgggttttgttatttttatccaaccttagagtctttttaactattaagtttgatatatttacatttactatgataacatatttggagttaggtctttcatctttgttttgctacctatattatgatcatacttttcatttgtttttagtttgttttccttattttggattaaattacatcatctctctttttccctctactagtttaacattataccttccatttctattgactttggagatatccttgagtttaaatatatatatatatatatatatatgtgatatatatgttttataaaaatacattaaaactgagttttatctcttttttgtgtttgtgctctggtgtcaggagcaaaacaataaacaatgtatgtttaaactttaagggtaactccaaagtaggcgtgcacacacacacacacactctctctctctctctctctctctctcatcaaagtatagtatatataagtatatataaactttaaggataaccctaagtaggcagtttgaaattaatcaatttcagacaaggagtcatggctcgtgtctgtaatcccagcactttgggaggttgaggcaggaggatcgcttgagcccagcttgggcaacatagtgagacctgaactctacagaaaataaatcccagctacttgggaggctgaggagggaggattgcttgagcccaggaggttgaggctacagggagccatgatcatgctactgtactctagcctgggcaacagagtaagatcctccttctgaagaatataaggattttagaatgctttaacttaactcatcccccttttgttttatgtgtcattgttgtctagttgatcccaagttatattttaaacttccaaattaagtaatagataaataaatgcacacatttatcaaatgcaacaggcactgttctagattctgtggatatagtaatcaacaaaacagagttttatctcttttttgtgtttgtgttctagtgtcaggagcaaaacagtaaacaagttatatatagtacatcagagggtgatgataagtgctatggagagtaatggtggggtactgctattagtattttacatggggtggtcatggaagaactctttgttaaagtgacacttctgagaagagacccaaggggagccatgtggatatacaactctgtcttaatagatattaaaactgagaatagaggtacagttcccttgtctttcctgcttctgttatactattgcaaagtgtgttttcagtttaattttaaaaaggcaatctgttttttcccttgttttaatattttattttttgctttgttgttctgtaattctattactatatgtctatgtgtgggttattctttaaaggactcataatgtttcatcaatctgaagacttacattttcatcaagtttagtaggttctcagttattacttctttcaaaaatgtctctatcctatttttccgttctgtccctctagaatttctgataccttttgtttctgtagtgaaggaagattgttttacaaatgaaactatttgattaccgtgtgattatatatagttagatgatgatgtgttaattagggaaataatgcaaggtaattggtattaatattttatattagatggtcagaaaaaatttctgataaggtgacatttattcagagacctataggaagtgagagtgatttgttcagttatgtgaaaggaaagcatccagataatagggtaacaattgtaaagctgacataggagtctcaagtttgacaattctgggtacagcaagtaggcccatataattaaatgaatcaaagggatattaatacaagggatgtcaaagaggttgtaggggatctgagcatgttggatcttattggtcattttactcttgagtgttatgtgaaggcatcgtaggggtttgcacagagtagtgatctaaactgatgtaagatttaaaaggctcattttaactatagtgtgctgaatagagggtaaggaggagggtaagtattaaagcagggactggttggaaggttattgttgcaattctggtaagagatggaggccctcccacccttttttccttcctcctcatatttagtcaatgtctgctatgtgccctgtagtatgttagatgttgggaatatatgaagtaatattaagcactttgctttcatggtgggatggaatgatgatcgtgttatcaaaaaattacattatattgtaaaaattctatactgaagaaatatgttagcagatgatgtgcctgcctatgaatgttggaaagactttagagtaatacagtttccttttaatttttattaaaattaactatgaatgtttttatgttagttgtatatcttctgtagattctttgattatgttctctgccacttctgcttttctttccatgtgttagaatatttctagcaatatctatatcaatatgtaaatacaaacatagagactctatttagtaaggttattaatattactatatttgtgctgtttccatctgtttgccatttagttttgtttatgattctttttcttataggtaatttgcattttagaaaaatttcatgtctgtcatcaatttatcaaaactattggttttatgcttaagtacctgctttctcagggaaatttatatattgccacacttctactttaaaaatttttttaaacatttatttccaaataatttagatttcattttgatatttgtgaaattagtatttatgttaatttcttacccaggaggcaattttctcaacattattattgaataatccatcattctgccatttttttggtgcctcctttaacacttattatatattctaggaaaaatacttaaaatccaggaggagagaggaagtaaaaattatgctgtagtgattagaacagaagaaaaaggaccaccagtaaagagtgctattctagaatcatgacccagaattctagaaatgaaggctttcatgaggaagggtaatagttaacagtgttaaatatcctgataagttcacagtactgtgtaaggtacataaaaaatggcttgttggtttcaggaattagggagctgtggtgacagcagtagagaagtttcagtaacattaacaaacgagaggagagattgcagttgcatgagaaatgaagatgcagaaagtagaaaaatattttccacagggtgtttgtgaaaaacaaatgaagtattgataatattttgaaaactataaagcattacgtatttgtgaatgttttcaatatgtttttcacagaattcagaggtgtctgtgtttgaagtcaacattcgatttattggaggcctacttgcagcatattacctatcaggagaggaggtgagcaaaatcaagcaatgcattgtttgttttggaggggagggttggaatttaataaaatgaacaatttccctagaagcatattagttttctaaattggtaatattgaaccagtctagaactggttgcttcaggcagaactattccttgggaataataatttttccattttgaggctctcaataaaacatgaattcatcacagatcctagctttatatacaccatgtctcctttgcaagagtgatccttctccaggattttgccattgcaattaattccatggcccaagtaaagggggaaaataaactaataaggacaaaattaaataacaaatcagaaagaattaatatggatcctcctaagaccaaaaattagtaattcaaacttactgtttagaaattgaatccagtttttggctataaataataacaactctgaattctcctctctggaaatcttggtacagaacacatggagacacttgagacctaaggtgatggagaagtgggtgtaggaaattcccttttactattgaaataggttaaagaatgaggttgaagagtgggagaaagagaaactaaaggaagaggttataagtcatttatttgttttttgagcaactgtttcacccatattttggtttgttgatctagacaatttgtaagagctctttgtagatttaagaaaatttaccttttgttatatgtattataaagatacatatctatgttagctgtattttgtttaatttttttttgttgttaatgttgaagtaatcatttaaaggatttttttttccccccagtgttttggcttctagattttggtccttagaaagcctttcctatgtctgtgttattacaaaacaaaaattcccattttcgtatggatttttatgactttatatacttttatctatatatttcatttattgttgttcctttgtgtgtaaagagtgagctatttatgtactaccttttttttttagaagaaatatgtttaaagatgctggtatttaatatattagattacatttatcttaatgtgtaattttattgtcaaattatattgtgtgatttgtttatacctctaacatatatttctatagtcagaacatttaaattcacatttaataaaatagaaaaaaatgatatatactctggccaagaggttatcaaactttagtatgtattagaatcacataaggtgttttataaaaatgaggattccaagccctgcccaaaggaccgattcagtgggtttagcgtggagaccattatcctacgttgttcatgccaaatactccttgttaaaggtgattttggaaacattggttctatattttgagaaactctgacctggcttataggaataaaatcattgtgaattaattgttatttttagtaaggtttattgaggtattatttacgtacagtaaaattcagtatatagttttatgagtttttacagtgcatagtattgtaatcaccagcatgatcaagatacagaattttattatcctagaaaatttccatttaccattttataattaccctatcccattgccagcccctgataattactgatctcttttctgtctctacagttaagaatgctggcttcttttacttagcataatgcatttgagatttatccatgtattagtagtttattcctttttactgtattacagtactccattatgcattttatatatttatcagtggaattatttacagttttggagattgtgaataaacctgctataagcatttgcctatagatttctgtgggaaaataaatttttatttatcttggataaatacataggaatgggatttactgagtcaaaggttaagtgtatatttaactttggaagaaactgtcagattcttttccaaaaattgcctctcattgttgtgagtactttgtattgtgagtctctttattattgttagccattctaatagatacatagtagtatctcattgtggtggttctattttgcattccctgatgacaagtgatgttgagcatcttttcctatgtttatttgtcatatgtattttttgaattagctgctcaaatcccttgcccatttaaaaatttttgttttttttgaattattaaattgtgatagttctttacatattttggacataggtcttttataatctatacatttgcaattattttctctatctgtggcttgtctttccagtgatttaacagtatcttttgaagaattgatgttgttaatctggaagtacaatttactaattttgtcttttatggttcatgcatttggtattttgtttaagaaatgtttgcctaatccaacatcacaaagattttctcttaagttttcttccaaaactattatagctttactttatttgtacttttaagtctgtaattgattttgagttaaatcctatatatgctgtgaggtataagttgaagtctacttttttccatatggatgttgaaaagactactttttcattaattgactttgtacctttgttgaaaatcagttgattaggtatgtgtgggtctactctagacattctgttttgttctcttgatttatgtgtctgtctttggtactaccacattgtattcattattatggctttatagaaagtcttgaaatcaggttgtgtgagtcctccaactttattccttttcaaaattgttgtggctgttttagttacttttcctttttgtataaattttagaatcaacttgttggtttctataaaatctactgagattttaactgggattataaattttgagtgatttgacatcttcacagtattgtttcagtccatgaataatggtatatctctccatttatttatttttttattggtgtttctactttttagcatacagatcttgtatgtattttgataaatttatacatatttcatgtttttggtagttctgtattttaaattttggtttcccattgttcattgtcagtatatataaatacatttgatttttaaaaaacctttaataaagacttaaattctcagttgtctcaggacattttgtttcttctagaaaactttgtgatactatcattttaaaaaagtgctaaaggtacacaacataaaatttaccattttaaccattttaagtgtgcagttcagtggcattaaaaacaacatttgcattgttgtgcaatgtgcaattgatttttctttttttctttctttctttcttttttttttttttgagacggagttttgctcttattgcccaggctggagtgcaatggcgcgatcacagctcactgcaacctctgcctcccgggttcaagcgattctcctgcctcagccttccataattgatttttatattgactttttaccctgtgatttttctaacttcattaattaattctagtagctttaaaatatactttaatagattcttcaggatttaccttataaacaatcatgtcattagtaaatagagatgagttttatttttctgtatagagaatggttatttatttatttttgttcttttcctgctccttctcctgaggcagagaatggttttatttgtgtggtccttttctttttcttgccttactgcattgcctaggacatctactacaaagttgaatagtaatgggcagagtaggcatccttgcctggttcctgatcctaggaattgcagtgatagctttattctcttccacgatcatggcatatggcttcaaaagtactgtaatccaagaatgtttattatttctgttggtctgctcctttaactctccacctttcgtacccataagatttttgcctggtttgtcctttctgtgccctggaacgaagatagttcctggaaaaactagtcccagagggagagcttttgctcatgacttgggaaggagtgcttttgctcatgacttgggaaggagtgggatttatgatttggacctctagtctctttcagtcccctcagctctcctatatgcgtttcactcctctgccttgagtctgcagtctgctgcataccccatcctccatctgcctcagccttacatacaaacagtaggtctgggctcttcctctcaaaggtcactcagagaggtgcctttcttcataaaatctttgggatttagatttccccgggaaggatggaatgttcattcttgggtctcatcttttccccttgacccaaaacttcttccccacagaaatgtctttaagaatcttctgagctgcttcatctgctaactgccagttctctaacactgaaatgtggtaggtaactggacatatttgaaggacatctttatgtaagtgatatatggagtcaggagatagccaccttcatatattgctctgtgccaagagaaataaaaccgatttctttttccaaaagaaggagacaaaacaggagagggggaagggaagaaaaggagggggaagggaggagaagggaaagggggaaggaaggggaaaggaaggaagaaaaggagggcaaaggggggagggaagggggaaggatcagaactctatctataaaaagatgcaaagttttaaaacttggaaaggaaaaaacaaaactcccaacccaagttgcttcactggcaaattctaccaaatatttaatatcgattatatgtaaatttctccagaaaaaaaagaagagtaatttttcagctcattctatgaggccagcattaatcctatgtgacacacacacagaggtattaaagtaaaactatagatcagtatctcatgtgaatattgtagatgcaaaaaattctcaacaatgtatcacaaaatcaaatctagcaatatataaaaagggtaatacatcatgaccaagtggggtttcttcccaagaatgcaaggctggtttgatgttcaaaaatcaaccaatataattcactatgtcaacagactaaagaaaaacatcatataatcttattacataaccacagaaacatctgacaacatgtaacgtctattcatgataacaacttgcagcaaactagaagtagaagggacctttctcaaggtgataaagggcatctacaaaaaacctatagctaacaatattctttttatctttttgtgtatgttgttattattatagatttcagttttatgctgcaaatccatagtacattgctaccacttttaccttaggtgatcagttatcgtttagaactattaaaaataaaagaaatgcctttttgtcttcatttcagtcatttttgttggtcttttctttttgcaggttcaggtttctgatttttcaggtttttcaggtattttattccttctgtggaaacagcttcctttaacattttttatagtataggtctattggtagtgagttcttttagtttttgttagtctgaaaatctatttccactatatttttgaaaaattttctttgggtataaaatataggtttacagtttttcctgtcaacactttagaaatgtcactgcattatcttatagcttgcatagtttgtgatgagaaatctcctttaattctttattcctctgtatgtaataggtcttttttttttcatttggttgcctttaaaattttctgtttatattttgttttgtatgaagagtctgagtggtttttactttgtgtgtgtatgtgttgggctgcaggggtatgagtaggactgtttattttgcctgaggttctttaagctgctggggtctgtgggttgatatctttaattattttctaaaaaattctcagttattgttttttaaaatatagacatccatcgacttatgataggattatgtcctgataaacccattgcaaattgaaaacatcctaagttgaaaatgcatttagtacacctaacctaccaaatatcatagcttagcctaccttaaacatcctcagaacacttacattagcttacagttgggccaattgatataacaaagcccagtttatagtaaagtgttgaatagctcgtgtaatttattgaatactgaaaacgaataacagaatggccatacgagcacttgaagtatagttactactgaatacttattgctttcataccattgtaaagttgaaaaaatcatgagttgaaccatcctaagtcaaactgtcataagttagtgaccatctgtattttttcttatcaatactttaaaaatgtcactacattatcttatagcttgcatagtttgtgatgagaaatcttctttaattctttgttcctttatatgtaatgtctttttatatattgcaagagccccctgccccacttctgggattccaattatatacatatactaggctgtcatagctcttggactcattgttagattttgagtttagccaaatttaagtgctttttaaaacaaaaaatgtgcacttctcagaagatataacagaatcagcttcctgtaaagcctatcaatcacagtgatcaggatacagtttaaaattactcaatgtatgaaaaaaatagggaaaatgatccatttttttttttccaaaagtcaatcaatggtgacctgttctaaggtaacccagatactggcattagttgacaaggatgttaaagcagctgttataactatgcccagtgacataaaggaaaatatttctgaaatgaccaaatagatgaaaatctcatcagaaatgaaataacatggaaattctagaatgaaaacttcagtgtttaaaacaaagtcatcatgttgactgttgtcattggaagggtgagagtcagtgaacttgtagatagatcaatgtaaattatccagtgtgaagaaagagaattaaatatttattaaaaatgaatggagcttcagaaacttataggacagtattccaacatacatataattggaatcctgtatgaagagagcagatagctgtaaaaaatagttgaagaaataatgactatattttttctatatttggtgatggacctgaatttcaagaagctaagtagatcctaaacatgataaataccaaccaaatgtaggcatatcatggtcaaacagctgaaagccaaatacaaagagaaaagtttgaaagtattcatagagaaatgacacatgttatatgtggaggtactttaatttgactgatgactgaacactcatcagaaaccacagagattactttttcaaaatttctttaaaattatgtgaatgcttaggcaaaaaccatagcattttatattgggttataacatacatagatgtaatacatgcagctgtggaataaaagagggagggaggaaatggaactacaagattgtaaggtttctccattttatatgaagttacaccatattactcttaatagtctgtgaaaagttaaggacataattaatccctgggacaaacattaaagaaaaatattgcagacacgtatagcttaaccaccaataaataaactgtaaatctctctctctctctctctctattttttttttttgggggggggaccgagtctcactcttgtcacccagactggagtgcagtggtgtgatcacggctcactggaacctcaacctcctgggcttaagtgatccttgcacctcagcttcctgagtagctgggaccacaggtgcacgccaccatgcttggctaattattttattttttgtagaggtggggtctctccatgttgcccaggctggtcttgaactcctgggctcaagagatcttcctgccttggcctcccaaagtgctgggattacaaatgaaagccactgtgccctgcctagaaaatatttaaataaaaaaaacagaaaggaaggaatagaggacaacaacaaaaagcaatggaaatggcgaacagaaaaccaaaaataatatcatacacctatatccagtaatatcaataatgccattaagttttagtgaatgaaatattctaagtcaaaggcaaaaatagttaaaacgacataaaagcaagaccaaactattcacagtctaaaaaagacacacttaatagagaggttgaaagtaaatgaatgggaaaaaagatacatagtatatgaacagcaagtgtagaaaggtttaaatgactacatcaatatcagagtatacttcaagatgaaaagtattgtcagagacaagaggagacctttctttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcatatcttgcaccgcccttaatccatttaaccctgagtggacacagcacatgtttcagggagcacagggttgggggtaaggtcacagatcaacaggatcccaaggcagaggaatttttcttagtgcagaacaaaatgaaaagtctctcatgtctacttctttctacacagacacggcaaccatccgatttctcaatcttttccccacctttcccgcctttctattccacaaagccgccattgtcatcctggcccgttctcagtgagctgttgggcacacctcccagacggggtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttcataatgaaaaaaaggatccattcattagaaagacataatcacaacattaaaacataagcaaatgtgtaggcatcaaataacagagctttgaaatgtatgaatcacaaatggaagaattaaaaggagattcctttttaattttttattaaaaaggtaattccacaaagattgttggatccttcaacattcttctcttcaactgatagaataagcagacagaaaatcaaagatgatgtagaagtcccgaatgacagtatgagctattttaaatgaattgatatttatttatacagcactttactcaacagctgctgagtacactttcttttcaagtgcacatggtatgtttaccaaaaataaattgtatgctggatcataaaacacattcagtcaatttaaaaagttagaaatagtacagagtatggctaggtgcaatggcttatgcctgtaatcccagcactttgggaggctgaggtgggtggattgcttgagctcaggagtttaagaccagcctcggcaaacatggcaaatcctcatctctacaacaaatacaaaaattagccgagtgtggtagcatgtacctgtagtcccagctactcaggatgctgaggtgagaggattgcttgagcctaggaggttgagtctgcagtgagctgtgatcacactgctgcacttcagctggggcaacagagcaaaaccctgtctctcaaaaacaaaaaacaagcacgatctttgaccatgatggaattaaattagaaatcaataatagacatcaggaaaaacttcaaatatttgaaaattaagcaatatgtttctaaataaatagacatcaagtaagcaattacaaaggaaattgaaaatattacaaagttgattctttgaaagaatcaacagaattgataaacctttttagctaaattgatcaagaaataacagaagacagattaccaatagcaggagtaaatggtattgccaatatgaggctatcattgcagattccacatacattaaatgcataataatggaatattataagcagtttttttgcaaaatttaataatgtagacaaaacaaggaaaatattacaaagtcgattcttttaaagtatccacagaattgataaatctttttagctaaattgatcaagaaataacagaagacagattaccaatagcaggagcaaatggtattgccaatattaggctatcattgcagattccacatacattaaaggcataataatggaatattataagcagtttttttgcaaaatttaataacatagacaaaacaaattttctaaaacaatcttattgaaactgagtcaaggtaaagcaagaagtatgccatttgtagtattaattgaattggtaataaaaagctatttcacaaaattaactccaagttaaatggctttattggtgaattatatcaaataagaaagaaatatcattcttccccagaggaacagggaacattttgcagctctacttcagaggccagcatagcactaacatcatagcctgaaaggcaatatagcaagagaaaactacagaccagtatactttttaaatacattagcaagaatcctgaacaaactattaatacttgtaaagcatagctagcaataatataaaagatatatatattatatataagaatataaaagataaaagatatataaaagatcttttatattctttttatataatataaaagataatatatcaagaaaaatttcttttattgtaggaaagcaaagttaaagatttgaaaaagcagttaatgtaattaatcatattaattaacaataaaggagaaaaatcatataattattgcaataaatttagtaaaagcatttgataagatgcaacacccattcatgattaaaatcactcagtaaactagtacagcgtgataattcccaatccaaaaacctgaaatgctccaaaatcctaaactttttgaacaccaacatggagtgcaagggaaatgctcattgtagtgtttaggatttcagattagagatactaaactggtgtaatgcaaataattcaaaatttaaaaaaatcgaaaattggaaacatttctggttctaagcatttcacataagagctactcaacctgtactaaaaggtaattattatttttcattctgataagggacacctacgaaaactctacagcaaactatatgttaattataaaatattaaaatgtttttacccaaggatctggaataaaggaaggtgttccattttcactatttacatttagcattgtaatgaaaatcttagcattgcaagaaagcaagaaaaataccttgttcatattcacttatatagtttttttgctagattccttttgatttctgagatacacagtcatattgtctgcaaataatgacagttgtacttctcctttttttctaaattctgtgtagccaggaatgccatcgcaatactgattcattgtagtcattactgcacacactttgcagtttgcactgatggtcccactgatactgaatactgtccttaaaaatttttggaaatgagatgaacttgccactacctattagctgaattgctaaatggattccccaccatctcctgtctctaacttccccttacctaacctaatttgcatactacctgagtaacaagaaaggccgtgttgcttactaccttagttgcagaggaggcttggaaatgtgattatatggcatttgcagcagctttaaggtaatagatggaatggagtttcttgtttgtcagacagatagaatgacagtttccatagaaagtagagggagtactttctaaagaggtcaaaagctgtaaaagagattatctgagggatctatttactatttcctaagattctccagacttgacacttatattaaaccacagtattgtgaaactatttatttagaccacattgttttatctccctgtgtttatagagctatatcacgattttctgtctgtaatagtctctcacccttccacattctttgcctggtagagactttcaagaccttactgaggttaatttatatgcaataaaatgtacctatgttgtatgtataatatgtaattaaatgtatactttgcattttaacaaatgtgtgataaattgttagaatataaattgatactgtcttttcagaaaataattcggctgtgtgaagtaaatatttaaaatttaaaatactctgacccagcgacccacttctaggaatctattatctaaaagtaacagagtagatacacaagggtatactcaaaaggatgtttaattgcagtaccgtttgtagtagaaaatatttgaaaaagacctgaatattcatccataggagagtgactgaataaattgatatatctgttaccataggataaaattaaactataaacctaaatttgtatattttaacgaggaaaaatgtgcttgatgtattcagtgactaaagcaagttatagaccagtagttggttacagctgtgtgtgtgtgtgtgtgtgtgtgtgtgtgtgtgtgtgtgtgtgtgtgtatccattcagtcagctagtcatcacagtattttgccaagaaataatggcaccttggactaagatggtgttgtagagatgagagatataaatgatttcagggtattttggagataaatttaaaaggattgggtgatacgtggaggggggtataaaacagaaggaattgattttgtctctcaggtttctgtttttggtgctagattgatggtacgatagttattaaatatcaaatgcttaaagaatactagattagagggggaagatcatgagttaattttaggtattttgagtttgaggatttttttatatttaagcgaaaataagtagtagagagatgtaatgggtctggtgttcaatggagaagtattgactggagatataagtttgggagtcagttgctgggtagctgataattgaaatcaagcacattgtgaaattgtccagagagacaatttaggataggaagagaaaggggcctagaattaagccccaagaaatacaacatcaaaggccagatagatgaggataaaccaaaggaagcagggagattataggattattgaacacagaggaagcatgtattttaaggaagaactcgtgaataataacaaaatgcttttgctcacatgtgtggtcaatccttaataagatctgtttcagtgaaatgatggcagcagaagccatgttggaataggttgaggagtgaatagaaaggagaggatatggatatagtaaattagacaattttgtaaaactggaaaagttacttgtgttattatgtcagtagcagccaaacatggaataaaaatccagctacttaattgtatgttatgtatagaaaaaaaggatggaaatacataaaaacattaatgtatttggttcaagatagaggaactgtttatgatttaaacttttttattttttctatttttgaaactaagcaaatattttgtaatagataataaaatatggattattggccttgcgcggtggctcatgcctgtaatcccagcactttgggaggccgaggcgggcggatcacctgaggctgggagtttgagaccagcctggccagcatggtgaaaccctctctctactaaaaatataaaaattagctaggcgtggtggcagatgcctgtaatcctggctactcgggaagctgaggcaggagaatcacttgaacctgggaggtggaggttgcagtgagcctagatcacgctgttgcactccagcctgggcaacagagtgagactccgtttcaaaaaaaaatgtatatggattatttatttttcagaagtctagtcaagagacagaatccatctagttacttgaacagagaaaatttaatataaagattaattaggtataaagttgttaactaggtaaatgctagattaaaaagaatactctgtaggaatcatagaggtggctcctacaggaagcaaacagggttgacataatatggggaagaggttttaattagtaaaacttagaaaccttaagaggaaggggtatccgaagctgaaactcagacccctgaagagagtgggctagcaggttattgctggtgctgatgtctttggggtgggtgataatgactgatgtctttgagggtgataaaactggttctacaagtattggaaaaacttccaaatggatccagctgctgctataggaagggactccccttgctgatgtgaaggcttagaaaagcaatccagcactggggcctgagcatatccctgcacatttgtgctagaagtaccaggaatgcaagtccctgactgctctttatccatataatcacaattgtgcttgtagggatgaggtaatgtccaccctggataaacaggcttactttcgcttactatagaagagataccacaagctgagtgttctcctataatgtaacccactgtgtgtacaggcattcatcatgggccctgtgcatcatcccagtgtgattggggtggaggtggggcatgtatagtccaatgcaaatgaacttgaagctttggctgctacttttctataaataataaagccttttatctctgacccagtagtcttgtgtcttctgccaacatttataaaactgtgaaaggctgacttattagcttgcaaatataataaaatcttagatttcattatgagttttaaaattattatttgcaggttcattttaagagggaagtgtgtgtgaatgtgtttctgtctctttgtgttaaccctcagttttgcagtgaccttcacttggttctgaggaacagccatctagcctttaagggtactcgtgctctctcagtgatactgaaaaatttatccagaatgaagtatagagagtcaaagagggaaaataagcaaaagagttgagagatgaaaatagattgagaggtttcagagaatatttggaagaagtctcagatgagtttaatggaacaaataatatgtgaaaagataagaacaaagaggaaatattaaaagctaccaaagagaaagggctgattacttaaaaaagaatgacagctgacagtggagttctcagtagtaattgaagtcagaagattttagagtagtatctttaaactgctgagataaaatagctaccaacccagaatttgaatctgtcattcaagagggaaggtacaagataaaagacaaagaggtatacacatcaattaataaaatatttttgaggaatttaaatattaactataaaaattaagattagataatgcaaggtgtaggagtgtgtgtgcgtgtgtgtgtgtggtcaagaacatggactctagagctggattgtctaggtttaaattcagactaactgcttaactacctgtatgaccttgtgaaatacattacttattcattttatatcagtttttctactctgtaaaatgggggcaaaattaatacttatctcactggcttgttgtgaggattaaatgagttaatatgtttgtcatcatcatcaccatcattatcccaacatttttgtagaacatattaaaaagtccttaaagcccttgtatattaatatcacatattagggggctagagttggtatggaaatgggaggagaaaatttgtttattttaaatctccaccttttgtcttaatttattcaacacttgttgagcatctgctatatgctaggcactcttctaagcattgaaaacaaatttaaaacaaattgttgtacccctatggcttatggtttactgtggggtaataggcaataaataaataagatagatatgtgagagagcatgtatgtatacacatatacagtcatgtaccacataactgtgtttcagtcaacaatggatatgttggtggttgcatgaaattataatggagctgcaaaattcttatttcctagtgatgttttaatgatcctgaccctgtgtaggcctaggccaatgtttgtgtttgtgtcttagtttttaacaaaaaagtttaaaaagtaaaaaaaaaattttaatagaaagtagcttataggatcaggatataaggaaagaaaatctttttgtacagctgtaaaatatatttgtgtttttaagctaaatgttattataaaagagtcaaagagttaaaaagaaaaaccctaaaacgtttatatggtaaggttacagtaagccaaagttaattaattattttgaaggataattgtaaaaaataaattagtgtagcctaagtgtacagtgtttaaatctacagtaatgttcagtaatgtcctaggccttcacattcactcaccactcatcctctgactcgccagagaattttcagtactgcaggtttcgttcatggtcagtgccctgtacagatataccatttttaatcttgtattctgtatttttactgtactttttctatgtttaggtaaacaaatacttaccattgtgttaaaattacctacaacgttcgatacagtaacatgctatataggtttgtagtataggagtcataggctgtaccatataacctagatgtgtggtaggccttaccatctaggtttgtgtaagtataccctatgatgtttgcacaatgacaaaattgcctaatgatgcatttcttagcactatctctgtcattatacatgatggaacatacactgttagcagtaagcaccaaggagaaaaataaagtgggatggggcataaaggagtttaaatttcaaataggatggttagggagtccatgaaaaggtaacatttgtgtgaagacctgaaggagattagtgggtgaggatattttttgtaagaacatttaataggcatagcaaataaaaagacagtgaaacgaaaacatacctggcatccttagagaacaacaaaagaggcgagtggagctaatgtagagtgactgagggacagagtgaatgaaggagagtgcatgaaggagggggtgaagccatagaaggtaatggggatacatctttgatataggtatatacccttattaaggactgtggcttttgctctgagatagggagccatttgagggttctaaactgttgacttctatttaacactcccacattgactgctagattgagaataggctgcaaaaatattatcttagtaacttaagtactctaatagagaaaacaggcataagaagcatatatagatcctaatgtcacttccctcctcaagaaactacagtggttctatgttacctattgtgttgtcttacttttttttttttggagacagagtcttgctctgttgcccaggctggagtgcagtggcgtgatctcggttcactgcaacctccgcctcccgggttcaaatgattctccggcctcagcctcctgagtagctgggactataggcgcgcaccaccacacctggctaattttttgtgtttttagtagagatggggtttcaccatgttggccaggccagcctcaaacctctggcctcaagtgatccacccacctttgcctcccaaagtgctgggatgataggggtgagccaccacgcccagcctaactttcgttacttatactttaaagctctttgtgttaacaagatatcatgaaaaagccactcataaattgctggtagaagtataaattagtaaagcatatatggagggcaaattggtagtaacttaccaaaatttcaaatgcttatactgattgagacaacaaattcacttctggaatttatcttagatagccatatactgtagaaacaaattaaatgtccattaatagaggactgagtaaataaattacagtgtatccataaaagaggaaattctgcagccaccaaagagaatgagctggtagtcctttgtaggctgctttggaaagctccccaaggtacaaaacaatatgttaaagtaacaagttcagaatgtgtgatattctgtgttagagagagacaaagactctgagtgtgtgtaaattgcaacagaatttctgtttttgtgaggtttgggaatgaggattttatgtgacatgaccaggaaccatgtataccatgggactgatttggcacaaaatacaaagaagctaacaggtggttgcattgtaaaaggaattgtgtggctgagggacagaactgaaaaagagacttaattttttacttttgatactttttggattttgtattatttgcctgcattgcatactgaaaactaatttgcagttgcctaccaaaatatttttctgaaaatagggaagataagtctaaaatatattgttaaagagtttatatatttataaattaagatttatatactatgtaagggattttttctcaatgacattagggtgttgttttcttttagacctgtctactataactgtttatatgttaattgctattaatgatacaatatttttagttgaaaattagacaatatattattggtttattctggaagtgaattgagcatgctttctatttagaaaaagttcataggtcattttatcagttttaattttatatgtagaaaagatatgatacaaaatgtgtgattaacaaagatatagtattaatattagtttctagataagaaagttgatttctttgtctttatggtaaacagaagcaatactgtttgctctataaggtaacttgtgtttactaacatgtaaatgttaataaagagagaactgattttacatttgcttttcctaattaatgagatgaatatgagaacattattacaactttgactttaaattataatgtttttctttggggttttgatgttaaagtagatattgaaggaaatggtaaattgtagatgtgtgaatatatctaattaaaagttctgctaagaagcttgtgccttgttgagggaactttggaacatcttaatgagggacagagtgaatgaaggagagtgcatgaaggagagagtaatggggatgcattacctctatgatatttccttatctacttgtacatatttctctctaatattttctatccccagtaatgttggtatgctttgttataatataatctcaactcaaaattttgattcattccagatcttcaactacttattatattattagaagaatctaataatatttttatcaaaagtatttggctgcagtaaaaagatggaattttaaataactactcaatttggagaccatttgagaggggatagacttgatgcatataagagaatgtgctacttttcctaatagaacattatgacccagtcacagtttggaatctgtaagtcagtggtctctaaagttacgtacacacacttacctattgggatatactaagaaaatagtagaaatttttctatatacatcttgataatactacatgctaagaaaatagtagaaattttactatctatatgattttaaaagtttggaaaccactgatatttaggcaattatttttggataccaaaaaagcagcaattggaactgacaaatgaagcatttataactctcaaagtaaacttagtatgtgaactcaaatgttttctttccttttctatcatatgattaaaccttgatggaaaattttgagacataacatattcagagtaatttaagggcatttatgcaaattgagttacctctttcttttgtttatattttgaactaaacctgtttaccttggatgaaaagtccatagcctaatgtttcttcttaaattttttgccagatgaaaatagactatcaacaccaaaactatgtccttccttttcaattaattgttgttttaggccttttgcatggttagctttccttagtatccagtttgcaaacatgctctctgattgccaaatgctgcctggtaccaatgagatgctttttcctaccctgtgctcccgtgtacccagtaccttgtgctatgtatactatgagagagagagcaataagtaaatgcttactaatggctataatttatgaatattcatgttttaaatctcagatattcaagattaaagcagtgcaattggctgagaaactccttcctgcctttaacacacctactgggattccttgggcaatggtgaatttgaaaaggtaactctatgtgggtattcttattctggaagaattattttgacctttttagtcttagaaatttctaatgagtcacccccacattttttttaaagacatattgtttttctctctatatataatctttgttttcttttgtgtatatgcataaatgtgtttctttaaaacattttctgatttttaaaataagtcctttgaaacaggttaattgtcttaacttgattgcagtttttactactcgtttctgtaagtctagatttctcttcctcacctgtatggtatacaatatttgtttcttttatttgcttattcatttccatttagtgctagaatagagtcaaagtacatcctccctctttttctttttatataccacctcctgatcttctaagtgaaaatagaaaataatatacctagaaatgagggcttcctattgctgaatgtcatattaaagataaagaaagacgtaatttatgatgttgactgcggggtttttattatagcatctacactagtgaagttcaaagtgaactcttaagcatcaatctttataatctgttttctaatcgaaaacattggttttttacttagaaatagatgaaatgttttctttggacaactttataaattatgtagagatatacaattaacatttgaataatgtcaacatatttgaacttgcatttaagtaatttatgctgactgaaatttgttgtgctcattttttctcctagtaaaatttattcatcataatgttggaatttggaaattacctaaaaatttgattgttgttctctttgcactcagaccctttagaataaaagttaggaacatttatttttctggagatgtgaatctatgacattatttttagaaacgactcgactttagtaaaatttttctaattgaagaactttattgagtttagatttacattgagatgtcagcagcatttaatactgaacattaaatctaactttactatctctgatttcatgcactatgtatagtgcagattacctctttggtgaggaaaaagctggctgaagttccagagcaagctccatggaaggatatggccaagtgatgttgtgtatacgcttgttctcgttccttagttttgtgacagattttgtgatatttccttcaggatcatcgtcagaatcagacattattatctacttagataataattaaaacttaattccgataggaagacagactggaggctctttttttgtctacatagaggaaaagaacttgaaaatcaagattaaattgcagaacttctaatttaagattgagattaaagtaaaaaggtttccaaggaccatgttgtgagctttttataagattaattttaatttaatttctttggtatgtaaacaaatacataattttacttgagtttttatatcatgaatgtaattatttacctatttaaaactttttaagtaaattttttgcagagaagggatcttattttgttgcctaggcggatctcgaattcctaggctcaagtgatcctcctacctcagtgctgcgattataggtgtgagccactgcacctagcattatttacctgtttttgaaaatttttttttttttggctggggtctacgcatttcccacacataggccttcccttagtcttgatgactgaaagccaacccatcttaataatctatcatatttatcttctacaatatgatacagcagacagaaacaaaagcagagctttttttgtaatgtttatttggtttatcactttaatggcttgcttttctgcttcttatctttctcactcaataatactccatggaaatacgattccaggttactcaataaagatctaaataaatctttgtgatgaataccaagtgagaaatgggatagttatactataatttattcattaattttcatatcagtggtatttgtttccattattttcctaccacaaacattgctacaatagcatcctgttatacatgttcttgtgtagtaggaattttatttcttggaaaatggttctcaagaatacaattgctggattaaaaagcatctgctttttttttttttttaatctgtgggacagatttctagatgtagcgttcctggatcaaagggatatgtatttttaaatttaatagatattgccaaaatgtgttccagaaaggctgtagtacatttccaccaacaatatgtgagagtctctaaatgtctgcaggtataaattctttttaatttttgacacgatggttgctataaaatcttcattgtattttctgactagtgaattttgaacatccttttcataaatttattgggcatgtagatttgctttttggtgaattgtctattcctaagtcttgcttgagttctttgtctttttctaattaatttataaagtgttttgtagattatataattaattctcctctctctactcttctgttggtctgttgtctttataataatatatgactcataagttttaagcttatatatacaaatatatgttttataacttttagtttacagtcttggttaaaaaattgtctccatctatattttttacattcttcgagatttccataaaagctttgaaatactgcttttctaaaagaattgaagtatggcattagttgtggagttttcatcagttatatcaatttcctttatcacattgaggaaatttccttctattcctatttcactgagatgttcttgttgttgttttatcatgaatggatgttaaatgttgccagatactttttttccatctatggagataatcataaggtttttcacctttattcttttaatatggtaaattacttgtaagattttcaaatgttaaatcaaccttgaattccttagatattccttggccataatgtatcctttttatattttgctgtattttatttcctaataccctttgaaattatatgatggatattggtaggaattttatttttggaatgcctttgtcagattttggtgtgagttacctggtcttattaaatgagatattattaaattattaaaatttttgtttgcagaaataattcgtggagtgctgtagttacttctttcttaactgtttgatagatagacctaaatgcaactacctgagccagaaattttctttgttggaaagtttttaataacaaattaaaatttgtgtgtgtgtgtttggagggggctggtttagagacaaggtcttgcgcttttgtatcgactggagtacaatggcacaatcacagctcactgcagccttgacctgccgggcttaagtgatccccccatctcagcctctctagtagctgagactacaggtgtgtgacaccacacctaggtaattttgtttatttttgtagaggtgggctctcactgtcttgcctagtctggtcccaaactcccgagctcaagtgatcctccctccttggcctcccaaggtgctaggattacaggtgtgagccactgcaccctgcccaaattttcatatttgtgtgtgtgtgtgtgtgtatgtgtgtgtgtgtctgtgtgtgtatatatatatatatatgtatatatgtaaatttatatgtatacatataaaagaaaatttatatataaatttatatatatttatatatgatatataaacatatatcttatattcagattttgttttattttgtgtcagttttagttaattttaaagaaatttcttcatttcacttaaattagaaaatttggtgtaaagtcgttcttgtgttactttgttttacctttcatctttgtagattctatagcaacaaccactttcattcctgattctagtaatttgtattctttcttttctctttactagtttaatgaggcatttgtcaattttgttaatcttttcaaaaaagtacttctgtttttgttaatttttacttttttttggttttattgatttctggtttatttttattatttccttctcttttcttattggagctactttgctctttttctggctccttacattggaactgtaggttgtatctttctacactgatcttatatctttctctcttttccccccataaactactgtttttctatagagctataaatttccctccaaggactgctgtagctgcattccagaaattttgattttttttgttattattcagttcaaaataatttctcatttcctgtagaattttttcttcaatgcattagttttttataattgtgtggttcaattgccaaattttaggacgtttcttagatatcttattgttttgatttctaatttaatttcattgtgatcataaaaattacaatttgaatcctttcaaatttattacaacttgtttatagctccgcatatggtctttcttggtaaatacacttgataaggaagtgtattctgcagttgttgggtataacattctgtatatatcagttaggttaaggtggttaatggtgtttagatcatgtatatctttccagatttttttttggtataattgttttatgtattcctgaaacgaagtgtcaaaatatcccaagtatgattgtggaattgtctcttctctatttctgtcaattttttgcttcatgcattttgacgaagctttactcttaagtacttacacgtttattatatgctttctgattacttgagccttttgttattccactgtgtcttcatctctggtaatgtttttgtcttgaagtttatcagatattaatgtagctgctctactttatgcttactgttttcatggtttatctctttttttccatttattttcagcttcactgtattgttttaactatagttctgcttttggagacagcatatagtttggatcataatacaaattttgttattcagtctgacaatattgacattttacatcatttagcaatagatctaaaaaattattctgtatcaacactttatatataatctcattatttttaagagcttcataatataatgcttatgaaaatgttgtgacttaaaattaattctgtattagtgaactattagattatttctagattttaatattatcaaaaaatattggaagaagtatcctgcatatgttgggaatggtgtgtgtgtgtatgtgtacatagacatgtgttggtatgactttagtagaaatagtggatcaaagaattaaatacattttttctgttgataggtactgtcttctagagaggatatgccagttgacatttccttaataagtgtgtgagaatggctcttatcgaaccttttgaaaatatggtttacttttatttatcagatagataaatataaaatcttgttccaatgtttattaatttttgagtgagattgaatttattttattcagtagatagcctttttatgtcctttgtttgttttttattggctattttttaaaaaatcagtccttaaggtatttttgtgtattagctagattagtactttgtcatataaattgcacatttttttgctattagtagtatagtttgaagttgggtaatgtgatgcctccagctttgttctttttgcttaggaatgtcctggctatccgagctcttttttggttccatatgaattttaaaatagttttttctaattctgtgaagaatgtcagtgatttaatggaaatagcattgaatctataaattgttttgggcagtatggtcattttcgtgatattgattctttctatccatgagcatggaatgttctcccatctgcttgtatcctctctgagttcctggagcagtggtttgtagttctccttgaagaggcccttcacttcccttgttagctctattcctgaatattttattctccttgcggcaattctgaacgggagcttattaatgatttggctctctgcttgtctgaatatgtttaaaagaaaactgaacatgttttaaagaaagaaaataaaattcagatatccaacaatatacttttataatatccgtaatccaatccaaaattactttactttatggcatgcaaagaagcagcagaaaaatgtagctcattattctgtagcccagagaaaaatctgttcatagaaacagacatggaaataacagaggtgatggagatagcagtaaaggactttacatagctattgtaagtgtgcttgaggatttaaaggcaaatgtgaagaatgagaaaagagattttaaaaaggaccaaagtggaacttctaaaggtgagaaatatatgaaataaaaaatttacttgacaagcttgaaggcagatttgacactgcatcagaaaagatcagtgagcttgaagacaaaacaatagaaaccacctaaactgaagcacagaaagagaaataaaaaagctggagtatggagagaagcatatccagtgacctatggggcagtgtcagatggtttaacatacctgtaatggagtgatgggagtggcgaatttgggagtgggaggagtggcagaaaaactacaagcatgaattgttttattgtgcttcacttaattgttctttgcagatattctttttttcctttttcttttttttaaacaaattgatgatttgtgtcaactctgtgttgagcaagtctatcggggctatttttccaacagcatatatcacattttgataattgtcacaatattttaaaacttttcattattattacatctgttatagtaatatgtgatcggtgatctttcttattactctagggcaccatgagcaagcagtcatagatgatggcaaacttaatcactaaatgttgtctctgttctgacggctccacagattggccattctcccttctctctccttctccttgggcttccctactccctgagacagaacaatgccaataaataacctttcagtggccttgatgtattcaagagacaagaagaatagcatgtctctcactttaaattaaaagttagaaataggctgggcgtggtggctcacacctgtaatcccagcattttgggaggctgaggcatgcagattgcttgagcctaggagttcgagaccagcctgggcaacatagtgagaccctgcctctacaaaaaatacaaaaattagctgagcatggtggtgtgtgcctgtagtaccagttacttgggaagccaaggtgggaggattgcttgagcccaggaagcagagcttgcagtgagctgagatcctgccactgcactccagcctgggtgacagagccagaccctgtctcaaaaaaaaaaaaaaaagctagaaataattaagcttagtgagaaagtcatgtcaaaagctgagataggccaaaagctaggcctcttgtgccaaacagtccgccaagttgtgaatgcaaaggaagagttcttgaaggaaattaacaatgctatgccagtgaaacacaagaatgatgagaaagtgaaatagccgtattgccaacatggagaaagtttgagtggtctgtgtagaaggtgaacccagctacaacattctcttaagccaaagcctaatgcagaggaaggccctaactctcttcacgtctgtgaatgctaagagaggtgaggaagctgcaggagaaaagtttgaggcttgcagaggttggttcacaaggtttaaggaaggaatctgcctccaaaacttaaaggtgatgggtgaagcagcaagtaccagtagagtgggacatcgctgaaaagatgcctgaaaatgtggaacaactttggaactgggtgacaggcagaggttggagaagaagaagacaggaaaatgtgggaaagtttggaacttccttgagacttgttgaatggctttacctaaaatgctgatagcgatatagacaataaagaccaggctgaagtggtctcagatggaaacgaggaacttcttgggaaatgaagcaaaggtgactcttgttatgttttagcaaagagactggtggcattttgctcctgccctagagatgtgtggagccttgaacttgagagagatgatctagggtatctggtggaagaaatttctaagcagcaaagcattcaagaggtgacttgggtgctgttaaaggcattcagttttataagggaagcagagcatagaagttcagaaaatttgcagcctgacaatgtgacagaaaagaaaagcccgttttctgaggagaaattcaagcctgctgcagaaatttgcataagtaacagggagctgaatgttaacccccaagacaatggggcaaatgtctccagggcatgtcagaggtcttcatggcagcccctcccatcacaggcccaaggcctaggaggaaaaagtggtttcgtgggccaggcccagggtccccttgtgtgcagcctagggacttggtgccctgtatcccagcctctctagctgtggctgaaaggggccaacctaaagctcagactatggcttcagagggtgcaagcctcaagcttccatgtggtgttgagcctgccagtgcacagaagtcaagaattggggtttgggaacctctgcctagatttcacaggatgtatggaaatacctgcctgtccaggtagaagtttgctgcagggacacgactctctctcatggagaacctctgctaggggagggccgaagggaaatgtggggttggagccccaacacagagtacctgctggggcaccacctagtggagctgtgagaagagggcaactgtcctccagaccccaaaatggtagatccaccaacagcttgcatcatgcacctggaaaagctgtactcaatgccagccagttcaggcacccaggaggttgggctataccctgcaaagccataggggcagagctgcccaaggctgtgggagtcctcctcttgcatcagtgtgacctggatgtgagacatggagtcaaaggagatcattttggagatttaagacttgactgacccaatggatttcagacttgcatggggcctgtagccctttgttttggccaatttatcccatttggaatggctgtatttacctaatgcctgtacacccattgtatctataaagtaactaacttgattttgactttacaggcatgtaggcggaggggacttgccttgtttcagatgagactttggaccatggacttttgagttaatgctgaaataagactttgggggactgttgggaaggcatgattggttttgaaatgtgaggacatgagatttgggaggggccaggggccgaatgatgtggtttggctgtgtccccacccaaatctcatcttcaattcccatgtgttgtgggagggactcagcgggaggtaattgaatcatgctattcttgtgatagtgaataagtctcacgagatctgatggttttaaaaaggggagttttgttacacaagctcttttctcttgtctgccaccatgtgagatgtgcctttcaccttccaccatgattgtgaggcctccccagccacgtggaactgtaaggccattaaacttctttcttttgtgaattgcccagtctcaggtatgtctttatcagcagtgtgaaaatggactaatgcagcatgatggtgcatgcctgtagccccagctacttgggaagctaaggtaggaggactgtgtgagtccaggaggcggagcttgcagcgagctgaaattgtgccactgcactccagcctgggggacagagccagaccctgtctcaaaaaacaaaacaaaacaaaaaaacagaaaaaaacccagccaggcacagtggctcacacctgtaatcccagcactttgggaggccgaggaaggtggatcagctgaggtcaggagttcgagaccagcctagccaatgtgatgaaaccccatctttactaaaaatacagaaactcgctgggcatggtggtgcatgcctgtaatcccagctacttgggaggttgaggcaagagaatcacttgaacctgggaggcggaggttgcagtgagctaagattgcgccactgcacgccagcctgggtgacaagagcaagactctgtctcaaaaaaaaaaaaaagttggaaataattaagcttagtgaggaaggcatgtgaagtaattaagcttagtgaggaaggcatgccaaaaactaggcctcttgtgccaaacagttagagtagttgtgaatgcaaaggaagagttcttgaaggaaattaacagtgctatgccagtgaacacatgaatgatgagaaagtgaaatagttatattgccaacatggagaaagtttgagtggtctgtatagaagatgaaaccagctacaacattctcttaagccaaagcctaatgcagagcaaggccctaactctcttcacgtctgtgaatgctaagagaggtgaggaagctgcagaagagtttgaggcttacagaggttggttataaagtttaaagaaggaagctgtctccaaaacataaaggtgacaggtgaagcagtaagtgctgatgtagaaattgcagcaagtgatccagaagatctagctaaggtaattgttgaaggtggctacactaaacaacagattttcagtgtagatgaaacaggtttctactggaagaagatgccatctcatagctaaagagaagtcaatgcttggctttcaaggacaggctgactcttgttgggggctgatagagctgatgattttaagttgaagctagttctcatttactgttctgaaaatcctaggacctttaagaattttgctatgtctactccctgtgtggtctgtaagtggaacaacaaagttcagatgagagcacatctgttgatggcagagtttaagcccactgttgaaacctactgctaagcaaaaatctctttcaaaatattactgctcattgacagcgtacctggtcacccattttctacagtgaagatgcccaagattaatgttgttttcatgcctgccaacatccattctgcagcccatgggtcaaggagtgattaagactctcaagtcttattatttaaagaatgaattttgtaaggctatagctgccatatatagtgattcctctgacagatctcagcaaagtaaatggaaaatcttctggaaaggagtcactattctagatgccattaagaacatttgtgattcatgggaggaggtcaaagtatgaacattaacaggagtttggaagaatttgattccagtcctcatgggtgattttgaagggttcaaactcaagtggaggaagtaactgtagctgtggtggaaatagcaagagaaccagaattagaagtggggcctgaagatgggaccaaattactgcagtcttatgataagacttgaatggatgaggagttgcttcttacagatgagcagagaaagtggtttcttgagatggaatctattcctggtgaagatgctatgaacattgtcaaaatgacaataaggatttagaatactacgtaaacttagttgatgcagccagtgtcaggatatgagagtggcctccaagttggaaagaatttttactgtggacaaaatgctgtcaaacagcatcacatgctacagagagatctttcgtcttgcagagaaatcaaacaggaagaatcaatcaatacagcagactttattgttgtctcattttaagaaattgccccagccaccccagccttcagcagccaccaccctgatcagtcagcaaccatcgtcatcaaggcaagaccctccaccatcaaaaaagagtatgacttgctgaaagtctcagatgatcatttgcatttttagcaataaagtatttttcaaattaagatatgaacattatttccacataatgctgttgcacatttaaaaggctacagtataatgtaaatataacttttatatatactgagatacgaaaaagtttgtgtgactcattttgttgcaatatttgctttatggaggtagtctgtaaccaggcccataatatctctgagatatgcctgtttttaaagaagtaatgtctagaaatttttcagatttgttaaacagctgtaaattcacagattccaacatttgatggaacccagcaggataaatataaagaaacatgacgtctgaaaatctgtgactagaaaaagaaaagttaaacagccagagaagaaaggcatttacattggggaaccaaaatagaaatacttccttcttatcataagcaatacaatccagaaaacaatcgaatccatcttgaaagtgttgaaagaaaaaagtcgatctcaaattctatagccactgaaaatattctttaaaaacaaaggtgaaattaagacattttcaggcaaacaaaagcttagagaatttattgccagcatacctgtattgttagaaattttaaggaactttctaatgacaacagatggaaaaacagatttacacaaagaagggaagggcactggaagcagtaaatatttgaataaatataaaaggcttattttttctgttttggtctttgtttaaagcaaaaataataactcgcatagtggggcctatagtatacataggagaaaaatttgttaccacagtagcacagaggatagtatggagacgtgaagcccttacattatatgtgaagtggtataatatataaaggtctactgtgggaaggttaatggtttatgttgtaatgcctagagcagtcataaaaaaataagccggtaaagaaaatggaatactaaaaactactgaatccaaatgaaggcaggaatagagaaggaaacaactaatgggaaaaatagacaatgaaaaggcaagatagtaaacttaggttggtaggatgtaaaatggtagagacactttggaaaacagtttgactgtttttcaaatgtttatcacatcaataggatataggtaaatagttgtcatattcatccaatggaataccatttagccataaaaagaatctaactgctgagacacacagcaatatgggtgaatctcaaagacatgttgagtgaaagagccaaacacaggagcatatactgtatgatgtttgtatgaaattctagaacatgcaagactaatcagtagtgagaggaagcaaattgagaattgtttgagacttggtggaggaagtgtgtgtgttgattgcaaaagggataaggacatgttttggaaggattgacttggtttgtataccagtctttgttttcatttgtcataacccattgaatggtgtacctgaaaggatgcatttttgtatgtaaattatacgtcagtatatacttaaaaagaaaaataaaccagatcctacacttggctgaggggctgtgtaataacaaaaaataacattaccttataattgaaggacaatcttaactttgaaaacatatttagaaaaaagtttgtaaaaatacagaattaaaattagaagagaccagtgagtatttaaaatgtaatagacaactcaaattatgcttatgcagttttccagaaggatagatgagaatgtgttaacagattgctttggtactgagagtgattggaagaggtagagggcttagagagatacttttttttttttactttatgctttttcagtgccatttaaattttaaatcatgagtatattacatatcctctcaaattaaatgaaaatgtaacaaaaatcagacttcattttaaaataaaaattaaagctgttatattcatctgctgtcaaacaaggaagtttttacttaaaaaatttttaaagcatctgctataataaaaaggtgagaagaaagccattcttacatttcagctttacttgtagactagtgtattatctgtcaaaagcccttaaagcttgtttcttttgacccagcaattcaacctttgttaatgtgcccgaagaaattggatgtatggactaaggaagacatctacaaaattatgtttatcacggcgtatttcacaaaatcataagtacaggttgaacgttcaagagtaaggtcatttgttaagcaaatttggtagtccataaggtaaaacaatatgttgccacataaatgatatcatagataaaatatttacagtatattaaaaatgttttataagccagattatggcatcatataatgagaatgaccatatagtgtgttgttcataagagtacaatttaagaatgaatgggggagctgaaataattaaaactatttaattttctgagtatttaatcactgacaaattggttttattttattgggtatcctgtaaaataattctgctataaacctattttctaaaatgaaattattaaaaacatacattcttgtgtatttatctaaatttgaaattattggcactttcaattgactcttgtatgcttttattagagaaggtattctccctacagttgctcagagcaaattctgcttaattttaggatattctcaattctaaatttttgcatattaaaatgtttaaatatttcagaccagatatttttacaaatcccattcttttgctttcattcagaataccttccacaaatctgagatatttttacattgacttttatttgtaattattttaaataatcatccagtttagatgatacagaatcatagggcttctcaatttcattccattgaagtatacaatataaataaatctaattgaaaataggagctccatcaaaccattattcctacaaatgaagatacttcaacttaagcttacacattgagtgttttaatttcttcagttcattctttgcttttgtcggaatgcatttcaatatcagtgtgtttgcaagctttgtttctaataattgcagtttactgaaagctttactccattctttcaatacattgattaaatatattcgactgactttgaacaaaatgcaaaccaaaatatagaagactcattatcaaaacaatttaatatgattgtagaccacttagggtgatttactgtcaagagtttaccaaacatttttagaatctttccttttgctggtggtcaggtaagagaaacatacgttttgcttgcttgtttttgttttttggtattcattgcaaattttttgttactcaggttctctgagtatatacgtaaattttagtatccagaccttttattttgatcagttgagaaaaaaacataacatttgcatgaaatgatgatccggttattttttggcagctcatcatcattttatagttggaaattttgtcctcggcagcattatatcttgttcttagggattttcttatttttctgagttgctaggatatatgtaagtatcaaatttaatattttagattcttcctgtgacactatgtaaaaaatttaaaaaccttatttagaatttagtattttgaaaagtgttactttttgacttttggcgagatgttctttttatagagaatggcaaactgttggacttcctaagttttgtttttatacttgaccacactataattcatccgctatgctgaaacctagttaatctttctaaatggtatgctttattccttaagtattatgttataatccttaaagttattcatgactttccatcacacttaaagactaaaattttaccatggcctacaaaattatttcatagtccagattataccttgctttctaacctcatcctgtgtcattcacttccccttactttctgaactctagccaaactagcctccttcctttccctcaaggccattacatctgctgtttcccttactgggaattctgttcttccagatattttcattagtggctcctcatcattcaggtctcagttcaaatcatatcattttagaaacattttctctgaacataatatgtaaaaagccttttttgtaactcactttctatctctagtactcaacattctatttttcctttttaattttcttcacagcaactatcactatttaaaatgatcttatttattgtaggagcaggaatagtatatgtcaggttcaccactctctcacagcatagtaaacacttacatttgtgaaatgaattactgtcttatgtagttactatatccatatttattctttgattctcacttctagctataaaatatcctagtggtatttgccttccatattttcagacagtttaaaaatagcaccaaacaatgaaggaactttaagcaaggttgtgatatgttcttacatctattttaatgttctctaaacacaaataaaatataacatattgaattgacagaatacaagtgaatataagatgagaaatatatatatatctatatatatatatagatatatatatatttttttttttttttttgagacagagtttcgctcttgttgcccaaactagaatgcaatggcgcaatcttggctcactgccacctctgcattctgggtttaagcgattctcctgcctcagcctcctgagtagctgggattacggcgcctgccaccatgtccggctaagtttttgtatttttagtagaaatggggtttcaccatgttagccaggctggtcttgaactcctgacctcaggtaatctgcccacctcggcctcctgaagtgctgggattactggcgtgagccaccgcgcctggcaaaaatatttatatttatacttctcccaaaaaataagacaagatcctagagaatggtctagagttcttgtaggaataatccaggaactctgctgcttgaatcatctagacttccagttccaaccaggaaatactgtttatcagactacccttctaccaaaagcagtcatgaaagctagacaaaatatataaaaccaaatggtttgaagacactgaaatgcaattaggtagagcttgaggggctgtgatcctaaggtcatcgccatataaacattggctttttccctgaggatatgttctaaaacatgttcagagcaatagaggccatatctaaagtggcagtcatttcgggcagaggagacaatggtcaggccccagagctgctaaaatgactgaaacatagggacaaaatctcatatagaaagaaattgcagaggaaaagcccaaaatttatggacaaatttccctgaagtcattggtgattccataaccacatatatggggcaagcaagactcaaagaaacccagcagaaaatagcagaagaaatttaagggctaaggaggaaatttaacagccacatgctagtggggaaacagaggttaggctgcttaggtgcccttggtaaatacccctggcttccaactgaaattcccagggccatttctggaagttggggtaaaaacggaaatggactatttttaacaaaacctaaaacacaatgtaatctgcatttactcagtctgtgttcagaagaaatttaacctttttagaagataatgtcattcaaagcctctacaatttttcattttatgtagtttgccttcagataaaaaattactagacagattaaaaaaataaaacgcaagagcatattctagagattatatctgcacaaatgaaatgtttatgagattattcactgaaaaatgttcatggtaacaaaatattggaaatagcccaagggaccatcaatagggaatttattaaattgtgtatatttatgtaatatattaattttcacacaggcactatcatcgtttggtgcaagccagttctttattgtatgatactgtcccgatcattcactacagggcagtttataactttggacctggcacaataagtggaggttgcacattcaaattttgagacaactcaaaatgctcccacacattttcatgtgcctctagggtggggcattccacttgagaatcattaatattatggaattccgtacaactgtaaaaaaaaaaaaaaaactgagaaagttgtttgtgaactgatatggaaagaccaccaacttgctatgttttgtttaagaaaggaggacaatgagcatatatatttggattgcctacatttgcataaaacattctgtagtaatatgtaagaaacgaatgaaagtgattttctgtggagcctgatgaggtgaatggagatgagaatgggtgaaatgtatttactggatttaaaaactactgttttaatttttagaacatggatttattacctatttaaatttttaatacaattttagatataaataagctatcgtgtcagatataataatttataagagatctatttaaaatttacatattcattaaacgaatgttttggtcttttcccaatcctgtgtctccttttacttttccttttcattcagtggagtagggcgaaactggggctgggcatctgcaggtagcagcattctggctgaatttggtacactacatatggagttcatccacctcagctacttgacaggggacctgacttactacaaaaaggtttgttttcttgccttctattctttgtttgttataaagagtcctttaagattggcccaaagatttgattaatgcttaaaaggtttgcctttctagatatatgtttattagggctgtagcctttattttttcttttgaagttactcaaagaaatgtcctttctatttagaacatatttaaaatatgtattgttatttgagaagttataaccactgttacatttttcaaaaatttcactgctatttttatgcagcattgtgctgcggtacctacccagcctggtaagacaagaaaaacaaaataaccagatgtttaggaattgaaaaggaggaaagaaaacagtagttattcacagattacgtgattattgacctaagatattaagacagtctatatttaaattactagaaataagagtttaatatgtttttttaaatagatgatcaatatggatgttaaaaatcagtagcatttctctacaccagctacaaaaggcaagaaaatgtcattttgcaaaaagatatcttatgtaatagaacaaaagtatatatgtttcctacaaataaatctaacaaaagataaagttcaaatttttactcagccatggaaaagaatgaaatcctttcatttgcagcaatatggatggaactgctggaggacattatgttaagtgaaataagccaagcttagaaagacacgtattatgtgttctcattcatatgtgggagctaaaataaattgatctcacggaggtagagaatagaatggtggttatcagaggcttggaagggtagtgaggagagaaggataaaaaggggttggttagtgggtacaaaagtacagttacatagaatgaataagatctaatgtttgatagcacaatagagtgactataacaatgatttgttgtatatttcaaaatagctagaagagaagacgtagaatgtttccaacagaagaaatgataaatgtttgaagtgatggatgtttcagttactcaaattttatcattatacattatatgctagtatcaaaatatgtataactctttatatccataaaaattaaaaataaaaatttaaaaatacaaaactttattaaatgatattgaagaggatataaataaatggagagatatcgtatttatatataggtaaacaatatcataaaaatttcagtcatccccaaattgatttatagcataaattcagtgccaataaaatctctaatggcctttttcctcccagtggaactcgaaaagacacttctagaatttatacagtaaagaaacattctagacacttgtgaggaaaaacacactggctggatttacattgcccagttatcaacattgacagtatagtatttgttaatagggacaaacagactgacaaacagaatagatagctcttaaacagacctacatatatgtagaaacttgttttaacaagtgtcgcactgtggattataatagttaattccaggaatattaaaggcttaactttaaaatataaaaccctgacactttgagaataaaaaaatatatgcccttggggtaaagaaggatttttacaatgggaaacaaaaaatattacctagtaaaaataccctgtaacccagcaattccattattcggtatgtacatttacattgtatacgtagaagcattgtttatattggcaatttatataataaaatacaaaatagtaatgaaaaatgaattatgtttatatctgttagttaaaagaatatgatacaatttttataaagttcaaaacaaagctgaacagtatattggttagggattcaaaatggttttgataaattgttgaagtaaaaataatatatagagatgaatctctaaattaaatgttttatttggaagcacagaactccaattcagggcatacacacagagtagggtggttggtcctcagtacatccagagaacaaagagaaggttggaagttttattagaaatgttatgtatagttttgaaaggaaatgtgttgacacgagtaaagcttctagaagctgtctggctctgattggtgatggcagtagataaaactataatcttagggttatagcagctgagcttgtggaaaacgtaatttttggagctggtgttatgtgccgcaggtgattttctgctgggccccttgactctgatttagttgggtatgacaagaatgacccaattcgtataatttgctttcacaaagtcaagataatgacaaatatgaaactcaagactacagatacatctgggatatggggaatagtatgtgaatgggcagtgaacagaccatcaaaggtgttcgtagtgttgtatttcttaaattgagatgtgagtagagtcgagatatatatgtatattcctttctgtgtatgaagtacttcatcaacagagaagaattttcaggaaaatggaactagatgacataattttccctgttctgactaaataaataataaaaattaaatatttttatattaattatgttaaaaattatttttatatcaattatattaataaaaatattaaagacagtacaaattcatcaaaggcaataaaagaaggaaaaaatgtaacttcatgtcatatttgataaccaaaataaacaaaaacgaaaagatttctgatttctggaatgagacataagtctgcttcctaccgtatcctgaaacctttctgggaaaagagagtcagccaactcctagtattccctatctgtcttgccagggagaccagtgcccagggcgtcaaatatgtaattgcctacagctccagcagagttctcacctctcatccttcctgaacacataggcttcaagtgatcaagtagaagtacactagtactccagatctcaaattgtatccaagaagggagaaacacacacatacacacacacacacacacacgaggaactcaaggagaaatcaacaaagttcaggtcagaactgaccctggtaaatgtgaacaagataaaacagaaagcatggcaattgtgcaaacatactgctagaaacaaaagcagagtggtatatagcatgtagaagactgataaagaatccagtttcaaattttaaaaacagtaaaaaaaaaaagtcaccatgagtaattcataccataatagaaattaaatttaacagagttagaactcagaaccaaaataaaacaataaagtgatacaaaaatattgtggagctaaagaaacaagctgagacctaaaatgatgtatccccatagctaatggaaaacaacaaagaactcgttgcacatagttaaaaactgaattacttacatggaataaaagcaagagatagtcatagtcaaaacaaaggaaaagcagagattaaaaagataatagatttgtaaaataaacataatttaacgtatgggccttcctgaagtagaagacctaaatcataggaattaacctaaaagctgcaagaagaagaaacactgctgggcacagtggttcacacctgtagtaccagcactttgggaggctgaggtgggtggatcgcttgagctcaggaattcgagacaagcctgggcaacatggtgaaaccacttctctaccaaaaattagccatgtgtggtggggcgtgcctgtactccccagctacttgggaggctgaggtgggaggatcactgaagcctgggaagcagaggttgcaatgaactgagatcgagccattgcactccagcctgggcgacagagcaagactctgtcaaaaaaaaaagaaacagaacactgcaaattccatttctaacaaaattaagggatacttgatgcttcataacaccaaataggaagaaaagtaggcatataagcagtaaagatcagagagaggtttggtataaatggaagagaggatgtttgggtctgcagactgaaaaatacaaagccagtagagcacaattctctaaattagatggtgtaacttgacatacaaaactcaaattctcatgagcagcaatgagaacaggatcacaggctaatggtgagtacttctttggaccttactagatataatgtgttgagaagctggaaaaacagaatcgagtaaggtttctcacagacaagctgtttgcgcctgcgaactttggtgagggaagggaatgaatgacagattcactattgtgctgcatttccaatctcaagtggctggggagaagcaaagtctaaaaaaaacatttatgtctggactcttacctggtgttttatgtcaaaactttcattcaggaaaatagtaatgagtaatttgttaaaaaagaacaggtacagaatttatacaaagatattaccagaaaaaaggaaaaggagggaaaattgtgggcacaaaatacgtaaaagagcaattgaaaattccaagcaaatatcaccatgagagaaaacatagtaaagccttcatctctgtagaacaagtatataaacagagatacaagagctcagagacaataagatgtgatatcagtaacaaagtataagaaaaaatagttatcaacaaaatgaaggccaaaatggaagcaatacaaagaaaaacagtgttcaaaatataaggagcttagaagacaaaattgagaaaagctagtaaatgtgtggaaataaaaggagacagaaagaaaatgatagataaggaagaaaaagaatagtatacagtttttggatgacagaagagttaactttctcaccttttataacatcattcagaactatctaaaaagtggtctatggaatttttcagattgagattgttatacatagtgttggtctcaaatgtgaaagaacacaggtaatatagacagcatccctgagtccattcctaaaactacttaaagacaaaatccagccaaatgaatgacgatgggaaaccttgtggcagaagaattgatattgtactcaggtccagaaaagtgaagtatatatcaggtcctctgaaaaagaaagttttcccaagtttataccagccaggttattcatcaaatgtaatgacaatattctcaaacaaataagagtacaaggaacataacacctcctcccacctccaggggcccccttaaaagcacttacaaagttcacctaatctatagttgaatcaaaataaatccctaggaaagtctccagcttcttaatatatttcatgatttttctttcccccttactctcagggagatattttaaaatttggaatttcaggaacttaaagatatctattgtgggaacaatatttaaagttcaacagtttgttttacttcatttacttttttatctgttcaattcaaattaataacttttcaaaatacaatggcattttatgattcaattcctgtgaagttatttctgttcttatatttgaatatatatgtgttgactgtgtctagaatgatgtttaaaataactgatgtttcagatggtatttctaggtagtagcatgttgagatttaaaatggtttctatctgtgcagttttctctgtattatttttattattgcttgattttaaaataatgaacacatatcatcttataaaaatgagtcatttaagaaatagaaggcttccctgacttccccctgcccctccaacacacacacaaaggcagggaataggtgtagattctgagtaagaaaaaacacaaagcctacattaaaaccaagccttgatgacacttatttttattaattgcattcttaattttattttactcaggttatgcacattcggaaactacttcagaaaatggatcgtccaaatggtctttatccaaattatttgaaccccagaacagggcgctggggtcagtgtaagtattctagtatacctgaggctttcttaaaaaattatttgtctgaaaactctttgcttgatgttgtaaaaagtacactacgtggagttagaaaccctcagtgtctaaccttgtggtctgctggtgctgttcttaggcatgtttctgatctctcttagcttcagttttcccacttataaaatggaaatgttaataacatgtctcctaagagtattttatttcctgtattgctaaaatatagtgtggcagtttgaaggttgtacttaaaaactcttattaataaattatatcttcatgtaaataaaagcactgcttaggagagggaggtagaggaggagtatgaaaaacaaatgagtatttactagaaggggggcagttgttcttggataagccatgtctgttcattcattttagaagagggcatcctggccttcattatttaccagtctctgtgctaagttcttagaagagattgagatggagaaagaacatagggcttggcctgaattcacaggctggcaggataggctgacacataaatgttactgtacaggaaggaaccaattgttatatgaaactgtggtaaaaatgattccctctgcctgaggggaaagtattttgtttagggagagggtaatttttcttattagaactcatttatttttgaaggaattgatttttaaaagtaacaactaatatttctgtggaaatgtggaacttacagaattttagtaattgtaggtttatcaatgctattctcttttaaaagttaggaaaacaaaaacaaataatagagattgcaactttgccgctaataaaacatgattcagttatttttgagactaatgaaatcttaagtagtaaataagagacaaaagtaatgatcatttaattttagtattgaaaacactgctgattctgccagtaagaaaataagctggtgtgagtaccaagaataggaaaacatttgccctggaattgtctttttgttcctttctaggaaattgtcttttattttatgaaaggaaagcagataggtcaatataattatgtctttcatggatctgggaatagatctcaatcttctttgactctttttatacttacttttcctgtttcctgaaattatttacatatgactcatttttctctttattttgaagaagataaaagctctaatgcctagactgagtgggaatgatattttctggaaaaacaaaaccctgagagctgcatttctaaaatgtaaaaacgtagttttcttatttcagataagagtgactggattggatgtctacttagtaatttggatgaattctatcaatcataaatctttacccctgtgagttgtattgagatttgagaatattatgataatataatgatataataatgtatatgaaaaattatgttcagttcctgtcttagactatatgccagtgtatattctatatggtattactatttaaatgtaaaagatgaaatcataaaagtactaaaaaaagggttgaatatataatcaggaaagccttttctaagcatgtcatgtaaaacagaaactacaaaaaaaagatgtcagttttcctgtatattattgttaacctctgtattagtctgttctcatgctgctataaagaactgcctgagactgggtaatttataaaggatagaggtttaattgactcacagttccacagggctggggaagcctcagaaaacttacaatcatggcagaaggggaagcaaacacatccttcttcacatggtggcaggaaggagaagtgccaagcaaggcggggaaaagccccttataaaaccatcagatcttgtgagaactcactcattatcaagagaacagcatgggggtaacatcttcctgtacccactctccagagtgtatatatttgtatgctttttgagccagcaactcatttccagcaatttattccaaataaattttcagagctatatattaaagtttatttacaataatcttggggttgtttataatagggataatttggaagcaatctaaagcagttctatctaacagaactttctgtaatgaggaaaagatcctattatctgtattatccaatacagtagtcactagccacatgtgaccatggagcacttgaaatgttgctagtatggttgtggaattacatattaaattttaatttaattaacttacatttaattagctacttgtagctagtgcttctacattggacagggcagtttttaaacgtcttgtaatagggatttggttaaatacattttggcctgtccagatatagtatactatgcagccattaaaagttatattttagaatacctgacatagataaatgacatatctagaaagatatttagaaaaggagaggaaacactatagaaatagaaaccaaagtgttatgtgtggttttctttgaatttgtgtttttattttctccttttcatttactgttactatccagatttgattatgaacatctattacttttgatgttagcttaaaaacatttttaaataaaaagagaatcccattttccatgccagtataaggatactcagaaaagtaaatcacagtttgagaattgccagccttaaaatgatcaaaagtacaacattgatgacatggaggcaggagagtcacttgaacccaggaggtggaggttgcagtgaaccgagattgtgccactgcactccagcctgggtgacagagcgagaccctctctcaaaaaacaaaataaaacaaaaccaaatccaaaaaacagaactctttctcttcaacgttgtgttgagaaaactggatagccatgtgaaaaataatgaagttgaacccttactctatattatctacaaaaattaactcaaaacagatcaaagactctaaatttgagaaccaaaactgtaaaactcttagaagaaaacataggggaaaatcttcgtgacctttgatttgacactggattcttcaatatgacaccaaaggcacaggtaacaatacaaaaataaaagataaattggatttgattaaaattgaaaatttttgtgcatcaaagcatactatctatgagaaagaaagacgacccacagaatgagagaaaatatttgcaaatcacatgtcttttaagggtctatacacagaatatataaagaactcctacaactcactaacagaaggcaaactacctacaactcaacaacagaaggcgaatcaccaaattaaataatgggtgaggacttgaatagtcatttctgcaaagaagatatgcaaatggaaaataagtacatgaaaaagatggttaacattaaaatacaaataaactcactgagataccacttcacagctactaggaagactgtaatcaaaaggatgaaaaataagcattggcaaggatgtggagaagttggaacccttgtacactgctagtaggaatgtaaaatggtgcagctgctgtgaaaacctagcagttccttaaaaagttaaacatagaattaccatatgacccagcacttcatctcctctgtatatacccagaagatttgaaaacagagactcaaacagatacttgtagcctagtgttcattacattatttatgatatccaaaaggagaaagtaactcaaatgtccaacagatgaatgggtaaacaatatgtgagtataaacatacaatggactattactcagccataaaaaggaatggagttctgatacatgctataatataaacaaaccttgaaaacattatgctaatcaacaaaagccagtcacaaaaggacaaatattgtatgattccacttatatcaaatatctagagttgtcaaatccatagagacagaaagtagattagagttgaccagaggctttggatgagaagaaagtggagaagaaaatggagagttattgctagagtttgtatttgcagtgatgaaaatttttggaaataggtagtggtgatggttttacagcactgtgaatataattaatgctgctgaatggtacactttcaaaatagttaaaatggcaacttttgtgttatatacatttcatcacaataaaatttacaacaaaaaagataacttttattcctctgttttttcctcacaaaataaattcaaattactttataatatattcactctcagcagtttttaatttcagtgttatagaaagagctattcactggttattttggcagaagatctttaaaatcctagcgagctgccctgatatccttttagcagctgtagtccttacagaattgtccaatttgttccttttaatgtttttgtatattttatatcagcctctgaaaagtatatcaaattttattattatctttgagctatatgcatctgtcatatttataaatagtctgcaaaacaaacatttaattgaactgaaatttaacaattcagctttggctaactgtattataattagagtaatgataatgtctgtgacatgcacatagcaatcacagaaaataattactggtaattaccttcaggaaaagtgcttggcaacagatgtaaaagaatatagcaagaaacctagatttaaaggcaaattactagtttttttttcttttctaaaacttttttttttgctagttttctaagcacaatacttagcctatgtcatttaatgattaaagtgaagaaaatataggaaatcagtcattactgattcattgttttatattactaaatttataattgtggaaaaaacaagaatggacatgttatgcccctttgagttagaaaatgaattgattgtcttgcttaataatttagataatttatttaacttctctatgcatctttatctgttctcattgtacttatttaatagaaaattcatgtggatcatatttataatatgtttgaaaatgcttcaaattagtttttattctagaatttcccataagaagacttcaagaaatagcttctgttagaaacctgccattaactgtataacatgttgaaataaatcatatgaatcattgctatttaggagtattttataatatgttaatcaatttctgaatatcaaaaggaccttagagtgacatggtttatcaaatttgacatgtaggcatataatctacaggaaagagaagtagcttcaagttccttagtggtatccttttgctttaatgtaatttcagatgttctgtaaagcaagatggacagaattctcacttgagaaggttttttttttgtttgtatattttgtttttattgaagataattgacaagaaaatgtaaattctctgttcaataataaggttaattttgttttaatatgatttgttattataacatttctaattcacattcttccttttgcactcagtgaatatatatactctgttaaaagttaaacaaggcatataccataaggtgtcatattcagatactgagaagaaaccggatcaggttttgagaaaactaatgaaggaacaagattagttttattctgttaaaactgtctataaaatacattgtaataaataggctaaattaggaaaaggaaaggcttacagcagaaggacatactagaaagctaatataatacggatctggatctaggatagctgtctgtgggagtggtagtcatcatagattttatctttccctttgtatcctacattcattcttcactaagtcttgtcagttctgactatttctgaaatattcgtttccccattttaactgcacctttttccgtttggaataccttccgccttctctatgtcctcttatcaataaattcctacctattcaatgaaaacagaaaaggaaaatcctaagttaaataaactatttaaatatagtaatctctcttgcaaccacctgttagggaaaaggaaaaatattagggtatatatataaatacccattaaaagattaatatcaattttatgtgtgatagtattataggaatatattttctctacaggatgtttgcattcactaatttcactgatactaaatatcaaccactgttccagatgctaggtatatagatgtgaacaagtagacagtgtccctaatacccttggagaacttacattctgctggagagatatgaaataaacaaatacatgatgtgatgtaatataatggtaagaatttcttttttcttaaagcacttttagtttctaggacaatacattcttttgcttttctcatagccttacttagcttcatgcttcactcagtctttttattattattattagttttctccttttctcctagcctcttagtgttggaatgccttagagcaagcttgcccaacccagggcactggatggctttgaatgcagcccaacacgaattgataaactttcttaaaacatgagatttttttttttacaatttttaaaaagctcatcagctatcattagcgttagtgtattttatgtgtggctcaagacagtgcttccagtgtggcccaggaaagccaaaagattggtggacaaccctgctgtagaggtcagtcctccattctctcttctctccagtgtcatagttttaaataccatttacatgctggcatctctcaaatctagaactctagtcctcaccttgtccttggcctctgtactcatatatccaattatctacttgacatttttacttaaatatcttatagatacctgaaacttaatatatctgtaaatgagctcttcctaataattctatccacctcaaaacctgttattcctccagtctttctcatttcagttaatggcaggtctattcttgctcatgccataaatcttgttgtcatcctttacttctttatctcacaccccactccagtttctcagcaaattctgttctgtctgcctttgaaatatgtctagaattcaattgccactaccctgagccaagtcaccatctcttgcctggattgttataataaatagcatcctaattggcctttctgtttctgcctctgcccctttcagtctattcctaatacaggagccagtaattttttacaaagtaagtcacattatgccattttatttaactcttcattacttttcatgtcagagtaaaagctaaagtccttttggggccctgtgatctggttcttattatctcttttccttcatttattcttctccaactacattggccttctgtcacttgttgaatccattaggcacttcaccaccacagagctattgcagccactactccctttgcttggaatgatttttcgagagatattcacatagctcaatccctcactttcttcaggtttttttactcaaaagttaccttttcaatgaagtcttccctggtcaccttacgtgataggcggaagtacagaaaattgaaagacatgttttatagatttcttccaccgagtggtccatattttctctgtgaattagaaggcatttaactgctgatagcagagaagaaggtagagcagtaggggacttaagacaaataacaaatatcttcttcaggaaataggaaagaacattaatgaaggagttataaaaaagttgacaggcagtgttgaggctcatgttgatggtgaaaacggtaaatttggaggtaatagtaaaacagactgacagctgggctgacccacagttgatgtttaactgtctgggtacaacaggagaacagtggagtaagggtcttgaatggttggacaagtgggattacctgttgcttcctttcgtattcaacctgactgcataggatccaaacttatttgagaatatatatatgtatacttttctctttctattttatctaacaaatcccaaaactcgtatcaacccagccacctacttttcccatttacatacagagtcaactaagcattgctggtgaaaataacagtacagattaaagttactataaacgtacaatttccagttttatgtggatcaccagtattccatgagttttttttttttactttgatcaatttactttcctattctttactctccttaagttttctatgtaacccctctatccatctccagctcttattttgaccatttctttattttcaagttcctaggcaattttagtttagatatatctttagtaaaaatagtatttatatagatttaaaaaatttcagtttgagagtctcagtgttttaaaaactgagtcaaaacaactaaattggtggaggttactgatagatttggactaattccaaatattctttggttttgtttatttttgaaaaactgctttattaagatacaatttacatataataaactgtacatatttaaaatgtacaacttggtgttttaaaataggtgtacacctatggaaatcatgatcacaatcaaaatagtgaacatatctatcaccccttttcctcatacccttacatgttccttctctcaacctcctcccttccccctcccccaaaacaactactgatctgctttctgtcattaaagcttgggttgccttttctagaatcttagataaatggcatcctttatttgtactctttatgtggcttctttcagcataattattttgagattgatctatgttgtgtatatcagtagttctgagtggaattccactgtatggaataccatagtttgtttatccattctcctgttgatggacatttaggttgtttctggtttggggctattacaaataaagctgctatgaacactgacttacacaccttcatatgttctcacttctctcggggaatacttaggaataggctgcttttatcaaatagtagatgtgtatgtttaacttttttaaggaactaccaagttgttttccagagtacatataccattttacattgctatcagtagtgtttctccatatacctgccaacacttgatatgatcagtcttttagttttagccattttattacattgtatttttttttcctttttttaaaaattatacttgaagttgtgaggtacatgccagaacgtggtttgttatgtaggtatacacgtgccatggtggtttgctgcacccatcaactcgtcatctacgttaggtatttctcctaatggtattcctcccctaccttcccacccaccgacaggccccggtgtgtgatgttcccctccctgtgtccatgtgttctcatttttcaactcccacttaggagtgagaacatgcagtgtttggttttctgtttctgtgttagtttgctgagaatgatggtttccagcttcaaccatgtccctgcaaaggacatgaactcatccttttttatggctgcatagtattccatggtgtatatgtgccacattttctttatccagtctatcattgatgggcatttggattggttccaagtctttgctattgtgaacagtgctgcagtaaacatatgagtgcatgcatctttatagtagaatgatttataatcctttgggtgtatacccagtaatgggattgctgggtcaaatggtatctctggttctagatccttgaggaatcaccacactatcttccccaatggttgaactaatttacacttccaccaacaatgtaaaagcattcctatttttccacaacctctccagcatctgttgtttcctgactttttaatgatcgtctttctaactggtgtgagatggtatgtccttgtggttttgatttgcatttctctaatgaccagtgatgatgagctttttttcatatgttcgttggctgcataaatgtcttcttttgagaggtgtctgttcatatccttcgtccacttcttgatggagttgtttttttcttgtaaatttaagttccttgtagattctggatattagtgctttgtcagatggatagattgcaaaaattttctcccattctgtaggttgcctgttcactctgatgatagtttcttttgctgtgcagaagctctttagttgaattagatcccatttgtcagtttgggcttttgttgccgttgctttttgtgttttagtcatgaagtctttgtccatgcctatgtcctgaatggtattgccgaggttttcttctagggtttttatggttttaggtcttaggtttaagtctttaatccatcttgagttaatttttgtctaaggtgtaaggaaggggcccagtttcagttttctgcatatggctagccagttttcccaacaccatttattaaatggggaatcctttccccatttcttgtttttgtcaggtttgtcaaagatcagatggttgtagatgtgtagcgttatttctgaggcctctgttgtgtttcattggtctatatttctgttttggtaccagtaccatgctgttttggttactgtagcctcatagtatagtttgaagtcaggtaatgtgatgcctccagctttgttcttttggcttaggattgtcttggctatatgtgctcttttttggttccatatgaaatttaaagtagttttttctaattctgtgaagaaagtcaatggtagcttgttggggatagcactgaatctgtaaattactatgggcagtatggacattttcacgatattgattcttcatattcataagcatggaatgtttttcgatttgttcgtgtcctttcttatttccttgagcagtggtttgaattcctggacacatacaccctcccaagactaaactaggaagaagtcgaatccctgaatagaccaataacaagttctgaaattgaggcagtaatagtctatgaaccaaaagaagcccaggaccagacagatgcacagccaaattctaccagaggtacaaagaggagcttgtacctaccattccttctgaaactaatccaaacagtagaaaaagagggaaatcctccgtaacttattttatgacatcaagatcaccctgttaccaaaacctggcagagacacaacaaaaaaagaaaattccaggccaatatccctgatgaacatcgatgcaaaaatcctcaataaaatactggcaaaccgaatccagcagcacatcaaaaaatttatccaccatgatcaagtcggcttcatccttgggatgcaaggctggttcagcatacacaaatcaataaacataatccatcacataaacagaaccaaggacaaaaaccacgtgattatctcaatagatgcagaaaaggccttcgacaaaattcaacactccttcaagctaaaaactctcaataaactagataatgatggaatgtatctcaaaataataagacctatttatgacaaacccacagctaatatactgagtgggcaaaaactggaagcattccctttgaaaactggcacaagataaggatgccctctctcactactcccatacaacatagtactggaagtcctggccagggcagtcaggcaagagaaagaaataaagggcattcaaataggaagagaggaagtcaaattctctgtttgcagatgatatgattgtatgtttagaaaaccccatcgcctcagcccaaaatctccttaagctgataagcaacttcagcaaagtctcaggatacaaaatcaatgtgcaaaaatcacaagcatttctgtacaccaataatagacaaacagagagccaaaatcatgagtgaactcccattcacaattgctacaaagagaataaaatacctaggaatccaacttacaagggatgtgaaggacctcttcaaggagaactacaattttagccattttaatagatgtgtagtggtaactcattttggttttaattagcagttcccaaatgactaacgatgttgaacatcttttttatatactctttgctatccatttatcttctttgatgaattatctgatcaaatctcttgtctactgcctattaaaaacattattttcttaattgttgagttttgagatttcagtatatattctggatacaattcctatatcagatatattcttggaaggtattttcaccccatcttttaattctcttaatagtgttgaaaagcagaagattctaattaggaagtccatttttccaatttgctttttatgaattatattttatgtcatatctaagaaatctttgcctaactcaagcacgcctaacccaagcacacaaagatttcttcctatgttttcttctaaaagtttatagattcgggttttgtatttacatctgtgagacattttgagttgatttttctatagggatcaaagtttattttttttacatataaatattctattatttcagcatcattggttgaaaaggctttccttttttcactgcattgcctttgcagctttgttaagaatcagttgtacatttaagtgtatgtttatttttagactctattctgtttgttattaaatctacacaatcaacacagtgtgtaccatcctgttttgatgagtgtagatttattataaatgaagtcaaatagtgttagccttccaaatttgttctttctcaatagttgtttttgctctctaggtcctttgcattttctttctttctttttttttcttcttcaacttttattttaaattctgggctacatgtgcaggatgtgcttgttacataggtaaacgggtgccatggtaggttgctgcacagatcaacccatcacctaggtattaagcccagcatccatgaggtattcttcctgatgctctccctccccctatacctccaaacaggccccagtgtgtgttgttcccccatgtatccatgtgttctcatcattctgcactcacttataagtgagaacatatggtgtttggttttctgttcctgtatagtttggttttctgttcctgtatagtttgctgaggctaatggcttccagctccagccatgtccctgcaaaggacatgatcttgttcctttttatggctgaatagtattccatgatgtgtatgtaccacattttctttatgcagtgtattattaatgggcatttaggttgattccatgtcttcactattgtgaatagtgctgcagtgaacataagcttgcatatatcttcataatagaatgatttatattcctttgggtatatatccagtaatggggattactgggtcaaatggtatttctgcctctagatcttcaaggaatcagcacactgtcttccacaatggttgaaataatttacactcccaccaccagtataaaagcatccctttttctctgtaacctcaccagcattttttattttttgactttttaataatcattctgactggtgtgagatggtttttcatggtggttttgatttgcatttctctaatgatcagtgatgttgagctttggatcagtttgatcaattgatcagtttgggattgattttgattcaatccttattcttattgtgcattatttttttttgcctctgcatgcctggtaatttttgactagattctatgtgctggatatttttttatccctagaaatcttcttgaactttgcttagggttacagttaagttacttggaaataatttgacctgtttcttgttttgcttttaggattttttaggtgaatctggtgcattgctcagtgaggcaagatcttcctgagtactctactaaatgtcctgtgaattatgaatttttcttgtctggctggtatgaacatccactgttcccagtaggctctttgtaagcaccaggcagtgttcccaccagtcctttcatgtggttctttccattgtctcagttagtttcttcacgtgcaagtgctgctcagtactctgcttaatactcaagggagatcctttgcagatctctggggttctctttctttgcacatttgttctctctggtatactatcctataaactgtagcttccccagtctttccagactcagccttatttctgaaacttagagagtccataggtctgtgccttaattttttctctctgtgcctttgcctgaaaattttcttgatgcagtaatttacaggcaataatgggactcaccttgtttgttttccatcatttagcgattactatcctctgttgtctgatgttcattgtcttgaaaaccagtgtttcatgtattttgtccaaagtttttggttgttttaggtttcaggctaagctcaagtacccattactctattttagccagaagcacttttttaaaaaaaaagtcaattcctattatgttatttttcctcctatttactgggcattcttaaaatatcctaccccatgctgcctcatttttttactcatttgagtatttgcatatatgtatatttccatctttttctaacagttgcccttgaattttaacttacatcttgtttatattttttctaacaacatctagacttaatcattactgtatcttccctctgaacaacatgaaaacttgtgtactttcactaccccattgcctagccttatcatgaacttgaggttcaaagagttaatccctctgttcattattgctttttgcacactccattctattctcttagattttttgctgtaatttttagaacacttcctctaggagtttctaatggttcgttacctacacctttccctcaaccccacccagatgacctaagtcaagatgaaagaaaagatccttctgcaagaaatctctttacctatcaactcatttatttgcccacttgatcttctgtttctccagtctcagagaatccagcatccactgttctgcccagtatttatccattgacctgtgctctgtctggatcctatcttctctcaactcttgaactttttcttttttggtgtttgcatttacttatgctatattaaacctcttggttcctttctcatagccagtaggttcctctctctacttcaactgtttttcaatgccatagattccttctggcaaatattctgtacctcttcttcatgtcttggtaaagcctatttaaaaaaaaaaaggaatagtctatttttcttgtttgccttctgttcacttctcaatacattgcattctgggctctgctccccatcacttcactaaaaataatttgaccctcttactgtcctatagactagtccaaaaaaaggacaatgtactaggtattgctgtataacaaacccctctaaaatttagtagcttaaaacaattttttatttctctggaatcaacaggttgcctgagtgattgtgcttttctggcttgggctttgcttatcttatctgggtttgttcatgtgtctgcaggtagatgacaagttggctgaaggctagcttggccccactggggaggactcagctctgcttcatgtggtctcatcatctatcaggagataccatgctttttacatagcagtgatagttccacaaaaagaagtggagcatgcaaggcttcttgaggcttaggattgaaactggcacactgttaacgttttaccagattcagttaaacaaagcaaaatgcaaggccagtccagtttcaaaggatggaaatttgtttcatgttctttacacagcttcttaaatgttgatattcctagaaatttttcttctaaccctttccattttgcctcaccaacctcatctctttttacaggatgacaaaatttgccctatatattggtgacatccaaatcagcaattagcaaactatgggagaccagcctgtggcctgttgttatatggcccactagcttagaatggtatatatatatatgttctagggtacatgtgcacacgtgcagggtttgatacataggtatacatgtgacatgttggtttgctgtacccatcaactcatcatttacaactcaccgtatgtctttacagtagcatgatttataatcctttgggtatatacccagtaatgggattgctgggtcaactggtaattctagttctagatcactgaggaattgtgacactgtcttccacaatggttgaactaatttacactcccaccaacagtgtaaaagtgttcctgtttttccacatcctccacagcatctgttgtttcctgactttttaatgattgccattctaacttgcgtgagatggtatctcattgtggttttgatttgcatttctctgatgaccagtgacgatgagcattttttcatgtgtctgttggctgcatatacagacatatatatatgtctcaaaagaagactgttttgagaagtgtctgttcatatcctttgcccactttttgatggggttgttttttttcttgtaaatttgtttcagttatttgtagattctggatattagccgcttgtcagatgggtagattgcaaaacttttctctcattctgtaggttgcctgttcactctgatggcatgcagaacttctttagtttaattagatcccatttgtctattttggcttttgttgccattgcttttggtgttttagtcatgaagtccttcccatgcctatatcctgaatggtactgcctaggttttcttctagggtttttatggttttaggtcttaggtttaagtctttaatctatcttgaattaatttttgtatgagatgtaaggaaggcatccagttttagctttctacatatggctagccagttttcccagcaccatttattaaatagggaatcctttctccatttcttgtttttgtcaggtttgtcaaaggtcagatggttgtagatgtgtggtgttatttctgaggcctctttctgttccattggtctatatatctgttctggtaccaataccatgctgttttggttactgtagccttatagtatagtttgaagtcaggtagcgtgatgtctccaactttgttctttttgcttaggattgtcttggcaatgcaggctcatttttggttccatatgaactttaaagtagttttttccatttctgtgaagaaagtcattggtagcttgatggagatggcattgaatctataaattactttgggcaatatggccattttcatgatagtggttcttcctatcaatgagcatggaatattcttccatttgtttgtgtcctcttttatttagttgagcagtggtttgtagttccccttgaagaggtccttcacatcccttgtaagttggattcttaggtattttattctctttgtagcagttgcaaatgggagttcactcatgatttgggtctcaatttgtctgttagtggtgtacagaaatgcttgtggtttttgcacattgattttgtatcctgagactttgctgaagttgcttatcagcttaaggagattttgggctgagacgatggggttttctaaacatacaatcatgtcatctgcaaacggacaatttgacttcctttcctaattgaatcccctttatgtctttctcttgcctgattgccctggccagaacttccaacactatgttgaataggagtggtgagagagggcatccttgtcttgtgccagttttcaaagggaatgcttccagtttttgcccattcagtatgctattggctgtgggtttgtcataaatagctcttattattttgagatgcgttccatcaatacctagtttatcactggtatgtgtttcaggtatggggagggattttgcatcaacttttaagagcatcttgacaaataatcattgtataaccacagttgacccttgaacaacacaggggggttagagtcaccaaccccttgtgtaatcaaaacttcacatataacttttgactcccccagaagttaactactaatagcctaccgttgacccagaagtcttaccaataacatagtgcatatttcgtatgttatatatattatatactgtattcttaaagtaagccagagaaaataaaatgtcatgaggaaaatcataaggaagagaaaatacatacacagtactgtactgtgtttattgatgttgtaaatttatgttgtctgtttacaagatgaatagtctgtgtcaaatggtggcaactacagtggcaaacctcaatctacagtacaaatcaaacagtccaactttttgttgtaatatcatgacttttcgctgcttcttgggaacactttcagattgctagtggcacttcatatgggtcccatggtgtttttgaaggtttacactactgtgccaaacaatgaaaaatatgcaagaaccatgagaaatcgctttttactgcaatatgcaatttactgaagacacggagatgattagtgtcacaagttgttttaagtggatgctcttaacacttgagttcactgcatagcaaaaagaggtgtctgtgaaattattacagtagtaaagtatgtactgcaataaatcttacacatttatgatttaatactgcatctttacatttgtttacatttctcttgactatcaatggcaccatgtatgtctgtgtatatgtaagttttaatacattttaactttttataatagatttgtatttcatgatactaaatggtaaaatagactagtatctacacatatgttattcattcgtgacacactcaactctttcttaatattttctctatttctaggccatgtggcttgtctatatgtttttccacattgttgcaaatcttaaagataatttcaatatatttatttttaaaaattcacgtgtaagtggatccacgcagttcaaatctgtgttcaagggttaaatgttttatgatttttcaaaggtttttctgtgcaacacattttaaaaaggttttctatgtaaaatcatcttgaataacaaagtggttataaacttacaagttccatgccataaataaatacaggaattaaaccaagattcctttagcttccatgtgctttggtttttattcatgataggacaaacaatgggagcagattatgagacagaggaataagaagttaagcatgtatagtattaactaattgcagttatcaaagaagtagtgaacttgataaggttatagtagtacttctgcttcatggaagaagattgaactataacgtcaccactgtggccattcatctttcttgagaccataatgaaatgaaagtagataaatatttataaataggcataaactcataataataaaaagatttgaaggcaagggggaggtaataatggacaagatatttcaacaaatttgcagaacatagagtggctgggaatggctacagagggactacaggaaaggtaactgatggaatcccagagagattttgggttcataaacaatagataccagtaaacaaatatattcaaagtacagcaaaaaccagatatttattcaaggtcgttatgtggaacatgggctctacctgaaatccttatgttccacctccatccctggtatttaccactagaataactatacagccctcttttttaaaaaatcacatgatttcattgaggaaagttaaagctttcaatatggatgttagtttcccaaaataaagtctcccttcattgtgaaatttaaccaggtccacagtccctcaatatccattcctgattctgaaacaaagcctaccagttagcccatccttcctcaaagtattctacatagaaagcagccagtcagtattcccactcaggggatagaattagtgacaattaggtctactcagtggaggaacacctgctattcagtagaggaaacccacactagctacccagaactttattcttaagcacggataattaaataatggttgactactacagtgggataacatacagaaatgcaaataaatgatacatagttacatataacaacatggttgaatcttgagctatagaagctggacatgacaatacggttacatttaattaatatattaaatataccaataggcaaaataagctcatagtacttgggagagggtatcagatggtaaatgtattaaaaattcaaagaagtagttaccccaaaagttaagatattggttacttttttggtgggtgggaattatgattttgtgggatacatggaaggtattgttctgactgtgggttatacaagtattctctataataaggagaacatttatgttttatatgcttttctgtatacatgttaaatttcacagtaaaaatatagtcaaaaaagggatcccacaggagacagacaattctataaacatttttaattctccactttagtcaaataactcggagaagttatattcatagagtaaaaataggatgctatgaaaaggaagcaattagagaatgaaaaaagagttcagattaaaagtatgattgctgacattaaagcttcagtgaagagactaaagataaaattgatttaataaagttcctggaatatacagggagaataaaggactaaaatttgagagaaaataatagaaactcagtccaggaggttcaatttccaattaatgagcgtttcagaggagataactgagaaagtggagtacagaaaatatcaaagaaatagtagaaaagatttttcccagagctgaaagatactgatctttagtttgtacctagcacattgtacctagcacaatgactgtaagaacaaacaaataaaaaaaagactatacctaaatttaatcagtgtttaagtgaagattctaaaccttggagaagagagctgagtgtgagtaagtaagattgggaacatattaagcctattaaaaataacatcagatttcttatcaattatactggatgttagaaggtattggaatggtactttcaagaagctctgggggaaaattatttccaaccttaaatttgatacccgtatgaaataaaattaagtgagagagcatagcaatgacattttcggatgaaagggtttgcatcccacacacttttgtgggaagttatttcagaatgtgattcagtaaaacaggtgtagacaaagacttaggactgaagaagcaataggcataactctggaaagcaagaaaagagaagtggcaagatgacagctgtggagtatccctagaaaatgaccagattgggaggaaggtctctagcggagtaaggagggaggggtgactcagtataagtaacatggttgataggctaggatacaataaatgattagggaaagtgatgggagacaataggaaaccagttagaaaatctggagaaaactaaaagctatacaagaaagtcatagttaaaacataaggacaactaaaatgtagcatgattttacgcagttgatgtctaagaaaagactgggcagctgataaaatggtagcgtcactgaatgagtcaagacattttaacataaccgcaaaatagaggttgtaatattgatgggaatattttgtcatagttgttttgatatatacatatttcaaaatagttaaaatgtaaaatcactgctctcttgtttattaccaaaaaatgtgctgaaaaggtaccactaacctttaccccatcccaaatgcccattaagtataagggactctccctatctactctattcatttctgtattgttttaatattttacaagttatgtgttaacttttatgatttttttgtgattataaaatgtgtcaatttgttagaattaatttagcttctaactataatctattgtataaatccatcatacattaccatccttataaaattattaatgtaagtatgatgagtatggaaagctattcaaaatttaattgtgaatttcttgttctatctgaaatgtagaataagacatcttattattgccctgtcttctactcctccaagtgacttctgtaatacccagccacttaatgtttgacattcaggaagctttcataaagcagaggtgtccttttagatatttagatggaaaataaagaatatcattaatcttagttgaaagcaaatggctttttttttttttcttgagacagagtctcacgttattgcccaggctggagtgcagtgttgcaacttctgcctcctgggttcaaggtattctcatgcctcagcctcccaagtagctgggattacaggggtgcaccaccatgcctggctaatttttgtatttttagtagagatggagtttcaccatgttggccaggctggtatggaactcctgacctcaagtgatctgatcacctcggcctcccaaagtgctgggattgcaggcgtgagccaccatacccggctgcaaatggccattttatatagtgttcaaaacctggcaaaacaaatttatggtgataatagaaattagaaaaaaatggtgtcattaggtattgactgtgaaggccacatgaggaaaacttttatgatgccagaaatgtactatagttttatcttggttgtggctttgttggtatatacatgtgtaaacatcaaaattatacacttagcattaaattaaaaaaagtgagaagtaatagcatttgagatgaggtaaaagtgaattatgggaatattagcagacatactgcttaaggtgaatgatagctcttttcccccatttattactttctacaacgaaagatgatttttaattatataagttacatgtatttagataattgtaagtgtctaaagttaaaattgaagggctccttccttagagcatcgcttagcccaggagtttgagatcaaatcttttctatgtatacaccaacattctttaaaaacacattttgagaagtatcaaactatatagataattctgaaatttgctccttctgcccactcaacagcatataatagatatcttgcagtgttggattatagattcaccctgattctctttaatgattgtgcagtcctccatagtacgtttatatcgtaacttagcctcctccctaaacatttcaggttatctttagttttttattaatgaaaataattctgattaagttcttttacatttatatttgtatatttctgcaaatattgttataggataattccagaagtacaattcctaggttaaattttgttagcttctgcaaaattgtccttcagtttcaacaactgggaaccataatcttgccaacattggatattatcagtcttttaaaatgttcactgatctaatggacaaaaatggaatctcactgttttaatttgcctttttctgatcactagtgaaattgggcatcctttcttatgttaattataaattgatgtttctttttttgttgtgtgtaccctattttaattttccttatttgtcaggagtcgtcgtttatgagagtaatccttttcttgttacgtatgttgcacatttcttctccaatttctagtcttttagatttatttgtcttttagctttaacgtacgaagctatccatttttcctttatgactccttcattttgtatttcgcttaagatcatttacttgggaagaccagatatgttcttatattttgttctggaaacttattcttttgcattttacttttaaatgattaatcatccacaagtgtgttttgtgagctaaatatatgaatattaatatgctttttctttcccataatggatagccagtttttgccataaatcactgaataatctgtcttttcctcaccaatttaaaaaccagggatattactgtatgagtgaatgagggttataagaaatgtactttttttttttttaatgcagagaggaggatgtcagttttgaagcagagttcaaggatatagggcagggtttgtagaaaatccaggataaaggagtgtggttgccttgggagctgtagtgtcaaattggataggtttaaaagtataggtgggatgaagtaagaatatatctaggacaaacaaatataggcatacccatatgtttatatgcttagctatatgctttgctttactgcacttcacagatattgcagggtttggtgtgtgtgtgtgtgtttgcaaattgcagatttgtgattaccctgtgctgagcaaatccgtcagcatcatttttttgacagcatgtgttcgctttgtgtctctgggtcacattttggtaattcttgcaatatttcaaattttttccttagtattatgtatgttatagtgatccgtaatcagtgatctttgatattattattgtgtttgttttgggcagcatgaacagcacccatagaaaatgacaaacttaataaattatgttgtgtgtgttctgactgctctaccaactagccatttccctgtctctctcctttggtctccctattctttgaaagacaacaatattaatataaggccagttaataaccctataatgtacacctagtatgcatcaatattaatctttcaatggcctctaaatattccaagtaaaagagtcatatgtctctcactttacatcaaaagctagatgtaattaagcttagtgaggaaggcatgtcaaaagccaagagaggccaaaggctaagcctcttgcaccagttaggcagattgtgaaaggaaaggaaaagttcttgaaggaaattaaaaatgctatgccagtgaacacatgaataatgagaaaacaaaatagccatattgcaggcatgggaaaagtctgaatggtctgggtaccattcagaccaaaccagctacaacattccctgaagccaaagcatcatccagagcaaggctctagctctcttcaattctgtgaatgctaagagaggtgaggaagctgtaggagaagagtttgaggcttacagaggttggtttatgaggtttaaagaaggaagctgcctccaaaacataaaggtgacaggtgaagcagcaaatgctgatggaaaaactgcagcaagtgatccagaagattttttttttccagaagatctaactaagttaattgatgaaggcagctacactaaacaacagattttcaatgtagatggaacaggtttctactggaagaagatgccatctcatagatgaagagaagtcaatgcttggctttcaaggacgggctgactcttgttgggggctaatgcagctgttgattttaatttgaagtcagtgctcatttaccattctgaaaatcctagggcctctaagaattttgttacatctactccctgtgtggtctgtaaatggaacaacaaagttcagttgagagcacatctgttgatggcagagtttactgaatattttaagcacactgttgagaactgctaagcaaaaaagatctctttcaaaatattactgctcattgacaatgcacctgatcacccattttctgcagtgaagatgcccaaggagattaatgttggtttcatgcctgctaacaacatccattctgtagcccatgggtcaaagagtgattcagactctcaagtcttatttaaggattgcattttgtaaggctatagctgccatatatagtgattcctctgtcagatctcagcaaagtaaatggaaaaccttcgggaaaggagtcactattctagataccattaagaacatttgtgattcatgggaggaggtcaaagtatgaacattaacaggagtttggaagaatttgattccagtcctcatgggtgattttgaggggttcaaactcaagtggaggaagtaactgtagatgtgatggaaatagcaagagaaccagaattagaagtggggcctgaagataggactgagttactgcagtcttatgataagacttgaatggatgaggagttgcttcttaacagatgagcaaagaagatggtttcttgagatggaatctactcctggtgaagaagctgtgaacattgtcgaaatgacaataaggatttagaatactacgtaaatttagttgatgcagcagtgtcaggatatgagagtggcctccaagtttgaaagaatttttactgtggacaaaatgctatcaaacagcaccacaagctacagagagatctttcgtcctgcagagaaatcaaacaggaagaatcaatcaatacagcnnnnnnnnnnnnnnnnnnnnagaactgggaggtccttcaatcatagacttgatcagagagcagtatacatacagagtgacgattgatcagctcatggtattgagggtcactcagtgagaagtacgtagtgtatgaaaagcagagaccagattagagtgggccgagatagactagttctcagtctatatagactgaatggatgaggagttgcttcttaacagatgagcaaagaagatggtttcttgagatggaatctactcctggtgaagaagctgtgaacattgtcgaaatgacaataaggatttagaatactacgtaaatttagttgatgcagcagtgtcaggatatgagagtggcctccaagtttgaaagaatttttactgtggacaaaatgctatcaaacagcaccacaagctacagagagatctttcgtcctgcagagaaatcaaacaggaagaatcaatcaatacagcagactttattgttgtctcattttaagaaattgccccagccaccccagccttcagcagccaccaccctgatcagtcagcaaccattatcatcaaggcaagaccctccaccatcaaaaaagagtatgacttgctgaaagcctcagatcatttgcatttttagcaataaagtatttttaaaattaagatttgaacattgtttatttaaatatagtgctgtcaacacaacttttataactactgggaaaccaaaaagtttgtgtgactcactttgttgcaatatttgctacattgcagtagtctggaaacaaacttgcagtatctctgaggtatgcctgtgtgtactaaaatttgtatgaatagtaatcaaggggagcaagtcaacagctacttatgttatacaaggtgatattataaaggaattcttgggctttttttctttttgtagatgtattttaatttattatctttggcttaggaattaccattaaccattgtataggaacatgtctaagagtgagctctttttgcttaacatcagctttaagttgagctttcatatttagacataacttatttatttaaagctattaatatataaaaggtaattatcaattctggaaaagtttggctctatgacagtgaacaaactgtaattcaagaaaaagactactaagtatgtgaagcaccacatccagagaaaaaagattttctagcaaattggatacacatatagaggaaagtgattatgtgtgattacttctgggactaaatttgaagtatgttggaaatagggttgtcaatgtaattttaaaattattgacctctaacatagtcattataattgaaaatgttactttatttgtcttgtcttcccttgcctttacctctatccttctgttttctcctttgttacagatcatacatctgtcggtggcctgggagacagtttttatgaatacttactgaaagcatggttgatgtcagataaaacagaccatgaggcaagaaagatgtatgatgatgctattgaggtgattatttccagaacatttttctacttaatggattgaatgtacagtgtattttgtagtgactagatgaatatcttataaccattttattatagacattcagtaaatacatacaaacattttattatatgcattcactgtagagtttgttactattttaatagaaaagcctcatattaagtcttcttttatttgtgacatttttaaagaaatttttgaagaaagaatttattgtagtccaggtgcagtggctcacgcctgtaatctcagcactttgggaggctgtggtaggcagatcacttgaggtcaggagttcaagaccagcctggccaacatggtgaaaacccatctctactaaaaatacaaaaattagctgggcatggtggtgcatgcctgtagtcccagctacttgggaggctgcggcagtagaatcgcttgaacctggaaggcagaggttgcagtgagctgagatctcatcattgtactccagcctgggtgacagagcgagactccgtgtcaacaataaataaaataaaataagaatttattttagtgtattcatgaaaattgattttatttacttttagttaatgtttacagagactggaaaaacttctgactttatatacattttcataaacatttttctttcaaatgaacccttgaatctacacattgagagccttatgggtaaatacttaaataatgacaacacacttatatagtattttctacatgccaggcactgttctaacccttcttacatatatgagatcatttaatcattatcaccattttacacatgaggaccttaaggaacaatgaagttaaagtaacttgctgaaggttgcattgctggtaattgatggggcgtggaactgaacagtctggctgccgagccagtgtttttaaccactgtattatattgtttcatatttaaatgacttcataccatgatattgtgacagtttataattggaacaagattcattctaggaagaatttatatggagtatttctaagaaaaaactgtgaaatagaaaagtaagtcagaagtgtgttaagtgtgtttagcaggttattagcttcctgctctattataaactgatacccacttaacaattttagttattttttaaaagttgtatattttgtatataacaactctgctgatgtagtcagtaattagttgtcagagttataatttctgtttggtttgtttttttcattaaaccaagaatcttatccattttatatccctactgttcaggcacataatttgttacaattgtttttaaaaaatgcacaggagttgaacttaatatgtggctcacagtgttttgcccattataggtactcaacaagtgtttattgagatattgtgttaaataataaattgaactaaaggtacaaccaagaatataaattttagtaggagaactttattctcttttattaaaatttaaacgtagaaagttgtatgatccaagatgggttattatctgggaagaatttaatattcttagaaccatattgttgaaaatagctcttagtaattcccactagactgtggcctcctttgagggcagagactaatttatttatcattatctcagcacctagcacaatacttgaaacataataagtattccgtagtatttgataaatgcatgaatatatttaatattatatttgagaacatgtgatatatcatataccatgtaataaattaattttgtctgttttcttgtaattttctttaaaactattttgacttttgcttaattttttccaaaggaaaaaaattgtatttgtcattgttttttttaatcatacatgctttgaaaggcatgataactgctttgaaagttaaccttataaattcacactatttttcatgaatcatctgctatatgttatgtatcttgtaaatatttctgtacttgctttcttttccctgtttttattagttttattagtttattaaatcaagaataggtacctaataaatgttttttaataacagttgatcagctttcactttgagacatgatctcaagtatgcagtctttgcagtgttaattattttcaaaaactattctattagcgtattataaaataaatgacatatggaatgtatgaaagagataggaatgaccacttaagactcattgtaatttgaaatacattatttttaaactttgtctttctgagctattttacttaaattattccatacccctcctaccttcccctatccttacagatacccatattctttgtttctactttcttttaaaattattggtaaaaagccctaactgactgccttttactttagttctagtaagtccaggtggatatgcttggatatcttttaattgtaatatggtaagatttaggttacaatgaacagaaatgacaaacatatggataccatctttaggcatttttggaataccttatatgtggaaaacatggtactatcatgaggttcaaaaagatgaaaaataccaccccatactcaaaaaactaatctttttgtgcttcagagtgctatggttaaaacaatgacaaaaacttataatccaaagataattatcattttggttatcagccacctctcattccccaacatcaaatacaattatctaagagcaccattcatttataaaattacttaataattaaacatgtattgagtgcacactacattatatgccttctggaatacaggtgatgagtaagacatagtcactccagttctgttaaactcacattattattatggagaatacagagtaaaattttccaaggctgattgttactaaacttgtcagagaacaactgacagtaaaaatactcttttttttcagaaagaaaagttaaccactaatcatgtataatagtttctactaaagaaaactgagttaatggccattgcttatacttttccatagaaatacctctaaaggtagaaaatagctcatctcagcaaagtctaagaacatattccaaaggagcaaagctcttgaaaatctcattttaaaactgaaatgtgattgttatactctgatatactcaagtttaatatagactatttctctcaccattcctacatcttttgagaaaaatgtatgttccagtagggtagacagtgtttataatatggcttctcttatccatgacaaagcatccaaaacaaatgcctaaatttgagaagtaagggactaaagataatattatgtagaaggtaatctttaggccaagtctctcctcttccactctgtcttattatggtagtgattcagatattggttccagattatatgcaatttgatcacccactccgacacttgctgttaattaagtctcagtttgggaaagttactactttatagactatcatattacccaggttttataatggccagaaggatatagtaagtttgaacactaatagtttgcatctaaaattttgaatatcttttctttcctgtaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactggtaagaatattaataaggctaattatatagtctaaaataatctctaagttaaaaatgtgttcagcaataagaaggagaatatataggcactttttacttccaaatagtttacaccaacaaggcaaatcattttcttaagaacttgaattttaattctggaaatgtgtctctgcattattttttaaattctgaattctgctgctgtttctgttaaagattttgaagtaattgttttaaagacaagaatcgtggggtatttgggaatatatggaataacttttaatataagaatctatttttgccatttcagcttctataaaaacagttacttaaaagaacataaaattgactgacttcagttatattgccttgcctatcctcttgtgataagaagaataaccaaaagataacaatatttatctttattggtatctggctaactagtagtttttcaattagttcaccagtagtttttggaattgtttatggctttaactaaaaagatcctctgacattgcattgggcaaatattttctgaacttcagtgtccttacttggaaaaggagatgattcctaaatggtgacaaaaattgttttggttggggctgagaaaatttttactctttttatgtataaagcacagatatacatatagtcataaatagatacacagtatatatttggtattaaaattttatggagggagaaggcaattaggcttttttaaaaaagacaaaaggtttcttaggggtgcagtaatgaaaagggggctgaaaaacactggactagaccttccaaggttttctctggctttaaaaacatgagtttctatatgaagtaatagataatgagctccctgaaagccaaaaaactagaaatttctatttgatttcggaagttgaattgttgattttattaaataacaatttctgttttagggttaatttatcatcagataccatgaaacaaatatgattgacctaaaatttatgctagttcataaatctgtcaagttatttttatacagtaaggaattaaacttatggcaaaattgattcttcagttctcattaactaaataagggttccatttcttgaaagaatataagtcaagaggacggtgaagtagtgttattttagggtagtttaagtgttgttgtataatacatataatggcagcgatctgagttcaaaatagaggctaaattaaattatcgtgttgatacagaatgccaattatgccttaaaatatagctaaaattagtaaaacattgaggaccaggatggatattcaattttatattaggatccatgagaataaggattgttattttgcagattttgaccaaaaatcaaataatagacctaaaataattgaatttcatatagcatacattctaaaatatggtatatcatagttactataattaaatatttactccatgaaacagggaacagccattatatgccaagtattatgctagatgcttataggttaaagtatgaacaagatacattccctgcctttcagaaattcatagtgtaccagagtttgaaaggatttccttatatttctgattttaatgtttcataatgacattgctgatgctgattcttgttctgattgtcattttcacattgcaagttgatgaacccatgaccctctttgttatggtaaaccaaaaaatgattatttgatttgtgtcctgtattttcaagtcttctgttgtttttacttgtctttaatctcaatttagatcctttaattaaaaagtacaatcctagttttgctaactttccagcaggttattatatcctctgctgtgttttcttatagctgtgctataatttttggccaccatattttaaaatatccattcatttttccttagtagttattccagctaaatatatactgtaattatctacaactaaatcaattcataatctaagctctaaaatgttttcttatatgtgtgtattatggcaaaatgtctttaaaattaccttgcctttaaaaaaaacatccacacagtgtcattatctatatacttttattttagaccacaatggactgtatgatgtgcaaatgtctagtttgcatttgtttccaaaagattactagactctttttggtagaattagatttagcagtatgttgatacacattattctgagaaacattttatgttagaataacaggaatgtttataagtctattttaagaaaaccaaatgtggatcttttaaaatgactcattttgcactgagtgcaaacagcaacaataaaaataaacaacaaaaattacttcatattctgttctttcagggaagaaagaagtccttgcaaacaaacataaatggtttattttgctcagttatttcttttgtcatgttacagcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggtaaataagccaatattccattttatctgcaagagtgttaactcatgccctcctatgatgccacataccctcacccatgttacctcatttttagtatctgtagggcagtttttatttatctgatgaagaaactcttagtcaatttaagtttctggggcagtagaaataaatcttacgatatatattaaatatatattaaaatatattaaaaatatataaatatatatatttcaaaggaggaatttttaatggttagttaagtaaaggaagcaagtggtttactcttaaagtctttcagggaatccatagctatcagtacctagggaggaaaaaactattagtcttttatgaaagtatagcttattcccagggtaaggggttgttttattctttgagatttactaattgtgataaatagcactaattatggtgactattcgtattcaaattgtttaacttaagcttacaatctagatagaatgactaaggacatcccaaatgaggtcagtagtgctggtaaattgcccagacaggaatgtatgagatatattttaaggcaagatgtataccagtttatgtaaagcgaacgtttcacagtggcaaagtgggagagaagattggagccattatgtagacagccttacacaccaaatcaaaggttcttagttgttcaggaaataagacgtgtgcacaactccctccccgtaatacacactctcttagttacttctgtcagctactgcgttaagtgctgtcatatgggaaatggtaacagaaagttctttgcttatccaaaaagcccttcagatcttacttttcttttttccttagcatcttctacctgcaaaagctccttgacttttgagaattccttacagaactgctaaatgttttataagggggaaggaactcctgaaggcttttttcagtggggagtaacaaagcaaaaggatctgattgtaatccacaaattggtgggtttgggagaccacagccataacctaggaataatgtgagatcttgaactaaggggagtacacttatttttcacctgtcattcagacctagatagtcctgctggactttaacaataagagcatattaatggaaacaagtggttacacaggacaggaacagatgcagcatttattgatgctgcttttccttggccccttggctccagaattgggagcacagctactagtgaaattctctgtgtaggagggtgctgccacagttgagaagacagccaaactattgccacagtggtttgggaatagaatacacacacacttctattgttagcagtggcttactaatgcttccgtaaattaagcactctttcatgtaagggaaataggtaaaataatcatataatgaatctgtttcacttgaatgtcccctgatatttaatgctccttatttacaggaatgagggggatatgtctgaatcacgtgaggagtggaaagtggtggcagaagcactttttgtcattgaggaatactttaggataattcatccttttcctaatgtccttttttcctgtgtgctttcttcaagtatggccctacttttgtctgttaaggagaggtgtgacagggtcaaactttagcccatgtctgtctaaatttgaattataggaggtagaattttgcttttgtagcctatatgcacaaacacaaactcaatgtataatcggtcaagaacaagaactagagtagttatactctaaattcaagtttcagaagtgtgcagtggaagtgatgagaagagggaggaatggaggcaaaagaggcggtgtcatatcttaaatagtatttgctcatgcatcaccattggcctctcctcttgggtgcgaagaaagcaaagggaaggctgggtgaggcagaatagcagtatagcgtgtcttctgtagccttagctattctgtttacatattcaaacttccaaacttgccctcatgactttaaatgtcttaaagattagtcatgcctccccactactttcttattattcttaaaccattttgatagttcatgtggtggtgaagacacatgattattgtgaagaaaagtacttaaaaactcttgtatccaaaatttctttagaatatattagagaaaagcaccaaaccccttaaatttagttataatcaaaatggagctataaaatgagcagattgattaaataaacacctttttaatgttaattagcttttcataggaaggagaagcccagaagagtaagaaaagtagcaagactaggaacaacaagccatggcagacagcgatggttagttaagtaaccatgccttcattggatgaccttgcagggttaggtagaatagaaaaacaaaactaccacatgtgctttccacttttcatgattggttgaattctggactgtgctgtacctgcataagcagactgtttggttgctttgaattaaaaaataaggttgtgaatagattccatttgattcagtatattttatttaggcatgcccaaagatgcaaaaagagtaagaattttaactctcagtcaagcagtaaagcacagtagttaataatgtagagcaaattactctgtgcctcagttttcccatctgaaaagtgaggctgttaacctcatagagttctgaaattcaaatgtgactgtatttaaagctcttagaacagcattcagcacatagtaaataccttataattgttaactctttatattgtaattattattgtagtaggtgggctctttctgccagttggtaccacctgtaatggctaactcataggattatgataatgcaatgtctggcatatggtatgtatttagtaaatattatctcttaccgctattactatagagtgctcctaagtaatattttttagcatgttgtgggttattgtttgtccttggaagtgataaaattgcattaaaaattgttaattgaaactgacctccatcttgatttgttagaactaatggacctttattttgccagacagacccctcatttagaaaaaatagcctaaatttgatttctaagttaggaaaatataagatgtcttaaaaagattaaagagttttggagacagagaagttctataggaaacatcctgtttctcgtatgagttaatttttccagtatgagaatatttccttttgataatatattattcttaagccatcaaattttcatacaaatctttatgagcttttgactattgtccttcaaagttttgttgtccttcaaaacttgaaattctacggaattgcttattttgtctgatctctttcataggccattgaaaagtattgccgagttaatggtgggttttctggagtcaaagatgtatattcctctactcctacacatgatgatgtacagcagagcttttttcttgctgaaacattaaagtaagtatatagctttaaaaaatatttttatactagactggttttgctgtgtgatcactagatgatgaattacaactatgtgacaggttacactaaattttgttgtaaatatctttttatgtaattgggtgtgtaaatttttagctacatctcaaaaagaatgacttagactataaggtaggtattttatcaaaaaagtacttagtacctgttaaaattttttgttctttgctctttaatgtgcattaaaatcacctggaaggcttcgtaatacacaggtaactaggtccacactcacaaagtttcagtagatctggagtttagcttaaaaatttgcatttctaacaagctcccatgtgttactgataatgctggtcctggactcatacctgagctccctactgtagctaatgaaatctgttaggaatgatcatgcagttttgatagtactaaatgaccatagccactcatccacccgatgagccttactgtaaagatacacataaaaggaacaatggaaaagagtagacaactttattttcgtcttatactccaaaccccaggtagaggtctctgtaaacagacctggaagagatggagattgtaaatatgtccacttccctaaagactgaccaaataaatatctcttcatactcgctcttaaatttattatttgtatttcttgcatatctgtacatgaaagccttgtaaacattttattttttcaacaaatgtgtattaccaggcactgttcaagccacttgaggatgtttcagtaggcaagcaggacaaaaattcctgccttctggattttacattctagtatacttgtagtttacattctcatatattacaattaaaatgtaccgttctcaaactaagtttctaaatgtctatcttattctaatttttcttttattaccccagtactgttgttttcctatctttttagcttatacattatagaatcatctgcttcctccttttaatatatcaccaattctttatgcttctttctgttacatttttttattttgctccctcctttccatttctacaatttaccctaatccagccccttattactgctgggatggtttagaacatctgcctggtactcagtttcctacatctagatgtttcttattctgacttatcctttgtgattaggcttgagactgtagaagttgaaagagcactagactagaaaataaagtgacgggaactttagttgtacactagctacatctagctgaatgaacatgtcaaaataaaattttttgcttttggtttacatgtctgtaaactatggaatttggcccagattgtgtagtatctctcctgttttttttttttttttaaacttcagaaaaactgtaagataggacaatgattatttgtgtcttttcacctagttttgccacatttccttctctttctttctgtgtacactcacatatacacatagttttactttttttttagctttttattttgctggacaagttgatggtgaccagcaatatatttcaacagtaggtttcaagaaaaggtcatcatcttacataatcaccattcagttctcacacttgcgaaccttaatattcatataataatgttgtctaatatgtaatcccattttcaaatttctccaattgttccaataatgtactttatttttgtttaatgccaattcaggatccagtatgggatcatttgttacgtttggttgtcatcgtctctttagtctcctttaatctagcacagagttttcctgtttttcttttatcttttatgaaattgacatttttaaagttttcaggctagttgctttgaggaatgttccccattttagatttttttctaattgttccacatgatcagatttaggttaaacattttcagcatgaacattatatggatgctgtgttcttatcattgcatcccttaaagagacacataatagtttagcccattattggtgattttaaatttgagcataggttatatttgattattgtcatgtaaacaatcttttttctttttgtaattaataacttatctgtggagtgataattttgagactgtgaatattcttttaatcctagattctattcttaacccaacctaatgtacattcaaatatttacgtatatataaagtttcttctcttgcatttgtctattttatatttcattgcttctggcaggaatgcctttatcctttctatcaattaatgcctctctctcatttctaatttcagttcaaatttcacctctttgcagactggctttcataattaattctcaaatctctcatcattacaacttggagcactttagtacatgcatggcatagggctggaaatagatggtatgctgcctcatccccttctagtacctatatggaatatcaccagttaatcttggtacttttccttgccaagttcagtcagaactcttctcaacacaacagtatgctaggtaaccagttatttatgtatatctatctatatatatatagatatatatatttgctacaatttttgcttttagaaaaacatatatctggagcaataaaagtgaaaaaggtcaaacaaaaagaaacatacaaataattataacatcacctaggctaagaaaattgtcacagttgagcagtacattcagcattgcacttcctggcagtacattcagcattgcacttcctggcagctaaagcaaaaaggaatcattctgcacagtgtcattatcatttttgggagttgagggagcatattactttgacaaatgagacagaattttttatgttgctaaattataaaatgacttaaattggataactctataaaaatattgaactattaagtgaaccatatgaaattacccttttaaaaagggtaatttgaatattggcaatttagtatagttcaacctaatacataatggtaatggtaaatattttgaaaatatttattttgtttgaaacagtgatcttagggaagatacaaaaacactcaatctgatttactctttataaaaactgatggcataatattaaaatacaattgaataaagtcatttctgtgaagatctaaattaatgtagctgtagttttattgtaaaaatagagcttaaaactttatagaggaatgaagatagtatggtctcttaaatatttctcaaatatcagttaatttaaataggctttgtcagaagctgtcagtttaagattatgtattctcccaattggtgggaatttactgcggattcattaaaaggcaacaatcaatgtgttttagctaccagagatggaaactgattgtcacggcagtggcaaagttaaatgaaaaaacctgtattcttgacgtaagttgaggctcattttaccttttacatgtgtcataggtgctataccatggagtagttattgctataggcatacttttttccccagaagaggccatgtctcctactttttttgtttccctcaatagaccttacttcatggattaatatttatctagcatatatactgatggcataacaaaaactatgtaatgaggaaggtcagagatagattccttcaaaggttctaaaactcttatactctagtacaggaaataaaacacaagcaatatatacaacaaattttaaatacattaagtgcataagagaaatattaacaaaatgcagaagtcttttagagaagaaagagtttgcttaacctgaaaaacaagggaatacttcctggaagtagtagcatttgaaccagacttgaaggcaaggtgggtaaaataggatgaactggtattcagggtaatagctataaagtagaccatgggatattaagaatgagatgagagctctaaaggtagaattgacaaacctgaatatctaattagatatgaggagattcagtaagaaggaagaatcagagataatattaaagtttccagtgccaacctgactacagtttctaatcagcatgttagtgccttacttttaaatattaataaacagtattgacttagaaatgtttattgaacgataaacatgtaagatttggcatatttgtgtatgtgtgttatactttgacttttaaagtttaaaatatgaatataacaaggttaagaaaatatccaaaaatagaaggatatgtttccagcttgaaagacaccatcaagatcccagcatagaagatgaaaacagacccacaacaaggcacagcaccttggaatttcaaaaccactggggtaaaggaaagatctcagcttccacagggagagagaatagaataaagtctcgtagatctggattcagagtgccttcagacctctcaagaacagtcatgaaagctagaagcattggagcagttgattcatgagagaaaattaattccaacttagaattctgggtttttagccatgtaaggtatcaaaaatccacttccaatcctctttctcagtaagtttttggaacatatgctccatgaaaactggatataaaccaaaaaagaagacataaatacaggaaagaagtgaaaggaagataaagggatactgtattgagattgaggaggacagaggctctgagagatttcttcaagattaaatgtatagactgtttatttctgagtattttgagacaagaattagttgctgaagattttaggtgcattattactaataaatacaagtcagcttgctttttaaataaggggaggagtcatgtaagaaagaaaagccatgaatagcttttagttaacatgtgaacttgtttaaagacacttggttggagtcttgattgttttgtaagaagagctaaatggtactactgtcccctctccagctgcaagaaagagaaatatgttctttgataatggcttttgtccctccaaggattgtcttattcattggattcagtgaaatagcagttggtcaaaagtctcttaagctgaaagaattgcgaggaaattagcagatagaacaccaagactcctaggagcggttctctagtagcagcacttgaattgctgaatgaatatctcccacgtggattctctatggttctatcactttataccatttactgtcataagcctcttatcaaaaactttgaaggtgtgtattattttatatatgtaccttagtgtctacacccattcacctagatctttctttgaattagattttcattgcaccttacctcaattctgttgcacatttatttaaagatctgataaactgagaaaagtatacattttgaggatacatttcaaccatttttttctgagttcatatatatcaggcattaggcagctcagaaatcacaagttggaaacatagtcttaacaaatttgttattaaaggaaagagaaatagcataaaattaagatcaaatttatcaccacagtatgtctactttcactggtatcagagtctctggggcagaaattatgtctgtgtctcttgcttgtgtgcttttttcctccctatctcttgaaattcaaactttgaatatagtaaaattctggaaagctatataagaatatgtcttatattcttatatatacttatatacttaagaataagtaatcttaaataatcagagttatggacaaagatttatgtacagagatgtttattgctgttataaaaataagtcattatttgttcaataatagctgaatggttaagtaaattatggcacatccacaatagtatcatgaagccaaaacaattgcatttttatagacttttcacagtataatattaagtgggctattaagtccacatgtgcatacgtaacacatagatgaacatgttaatagtatttcaacaatatcaaaatgtgaactgtagtttagcttaattgaagttattttagtttttaaaaatactttttgtttttgtctctgtaaatatttaaaaacatctttaaaaatactctattttgaaaaaaataggctggatcactgctaagtaccaaaactaagtttctatagagcaaagctttaaatattaaaaaaagaaataaaatcatgaaacaattggaaagtttttttcaaccctagggatgaagatggcatgatacaaaacccaaagatcattgaagaaaagattgagaattcaattacataaaaataaaaaacatgtgtacaaaaaaagagcactaagtaaagtaaaagacagatggcacactgggaaaacatttcttaaaattagaaattattaagaaaaaatactaagcctactaaaaaaggtagtagcagttcttagaaaagaaatggctgtaaacacatgaagaatgcttgatccacttgtaagaaataaatgaaataatagatcagatgctatgttttatttactttcacactgcttaagatttaaaagtttttgttctggtgttggcaaggatgtaagaatctagtcactttcaaacaccctaagtgagagtacactggaagtatattctttttcgttgttgttaaggaagcaaggtccacctgtggcccctgccccgacttggaagtatattcttaaaatatccttaagtgtgtattatcagtacttcatttgtcctgatagtctatgtgaaatattaatattctcagtgctttagtttagtgtttgagttagaacaagcatgcatgcaatcaatgtgtttgttgagctatatatacataacagcatagcacttgtcatattaaaatcagttgtttaaacactataatgtgtagctcctaaaaaatcaagttgtttttaatacagctttttttgaattataaaaatagcatgtggatattgcaaaacgagttaaatagtgcagaactgaagaaatgacaaaaaaaaaaaatgagtttctttgtgcctcacatccaatctcacttcccaaagagaataattattaaatagttcttgatatagccttctggaaattttctgggtatatgcaaacatataaaaatatatataatatatatcctttagccttttttctccatatataagattatatatacctattattctgaaacttgcatttccacctttttatctaggaaaggtttccatattggcatatataaatccactgaggaatgttttataatttgtttaatcagtaccctattgttagatatagaacttggttctgtttttttgctcttataaacagtgcttcagtgaatgtccttttacatatatctctgctccctgtgtgaagataaatgttggttagattcctagaagtaaaatggatgactagggcagtggcatgtgcatttgacataactataattaagcaaaataagctgagagagcgaacttttcagaaaacttctcagagagtttcagaaaattaattagaaatggttaaaatcagatgggtattctgagaagtatggagacatttaggcactacctgataatgtgtagtaagatttgaatgaacaaaccttttgttttaagtaaatcttagacaacagagtaaatcacttaaaacttgttttctgtaagttaagaacacagatgaaaagtcaaacaatcagattcttaggaagtaaatggaatgacagtttcagtgtttgctcatccttttaaactagtgctttctggaatccttaattccacctctttgttctttatcaagatgtgagctctttttctactaagtaaatagtgattaaaatatataaacaatacaaatgtaatatatgaaatgatttatccaacaaatgtttgttgttaagtgcctgatgtgtgccagctgttttgtatgctagggctgcatcaatgaatgtaaaataatcctgacataaaataacttacatcctaaaaatttcattcactctccccctaacttataattatgctgttttgagtgcctgcctgtaaaaatatgccctatgtgtattatccaaacccttcattattctctgtccttgccctcctttatttttcttcataacactaacatcatctgtattagtccattctcacactgctataaagaactgcccaagactgggtaatttatgaagaaaagaggtttaattgactcacagttctgcataactggggaagcctcaggaagcttaaatcgtggcagaaggggaggtgggcacatcttacgtggtggcaggaaagagagcatgtgaaagaggaactgtcaaacattataaaaccatcagatctcatgagaactcactcattatcaggagaacaatatgggggaaaccacccccatgatccagtcacctcccaccacatccctccctctacatatggggattatggggattacaattcgagatgagatttgggtgggacacagagccaatccatatcaccatctgacataggtgtgtggtgttcttgtttggtagagatgcgggtcttgctaattgccctggttggtcttgaactcctaggctcaagcaatccttctaccttagcctcccaaagtgctgggactacaggtatgagtcatcatgctcagcctagatggatttttttttttaatctatcttccagtagaatgtaagcctcatagccgtagggactttttccttttaactactatgatctccctagcacctagcacatgaggcactcagtaaatatgtattgaatttgttgataaatttttagtctgttaggcaagaaaagaacttggctatttgcatctttactctgatccctctttagtttttaattatatcattttatcagttgtgtttaaggcattacctgatcatcctgtatacaatgtcaaattgttcccttactccctcttacttttccctgctttacttttcttcatagcacctatcttccaacatagcacataattttcttaagcattccccaattagaatataaactacatgaagagtttacagtatttttgtatatttgggttattgttttatccgcagtatctacggtagggccactcatatactatgtatttcagtattaaatgtttgctgaataaaggattgaatcatttcatttcaaaggagacagctaaaaaaccccagcaattttataagatcttgtatataataagagtaggagggggaaagagaagagaataatagacctactttatttcctggttggggcttagagcttgatctcagaattcacttagttttaggaggtgtctgataatgagtcaaagaattgataaagcaagaagaagggacccaaggcaaaatgtgaaagctgaggatgtcagggctgcggatttgttttcagtagagagtcaaaggtccagatgcccacataaaggagaaaagcagaaacagtaccaactaattgttgttagaagttacacaaagttggtaacctagaaaagtggttctcaaacctgagtgtacatcagaatcacctggaaggcctcttaaaacatgggatgctgggctctgttgagtttctgataaataggtctagagtggggcctaagaatttgcgtttttaacaagttcccaggtgatgctgatgctgctggtctgggggaatcacactttgataaccactgacatctgtgacccagtaaaacacttatggagacaattagggattaagaaattaactatactggcagagaacctagcataaagtcaggtgggcaagtctttgcttaactgctgtatttatgtagttcagtctcttcaaataggtatactggaagaccagaaccgtggtctttacatttttaagtgcttcctatgtcctaatacaatgcaatctaaatattaggcactgggatacacacacacacacacacacacacacacacacacgtaggaacacacaaagtgaatttcacttctactatttaatataagcatttttccagtttcaaaaatttaatctttgaaatatgcttgccaatttcttttgctacagtagagggagctacaacccaaattttactaatgtagcaatacacaataaggctattcttctccatccttgttcattagtctttttaaaaaaacttttaaaatcagctttattgaaatatgttaagtgtacagtttattgcattttggcaaatgtttaagcctgggtaaacatcagccttacttgatgcatggaatatttccattctaatttggcagtcagttctacccacccccaaactctaatctgctttctgtcactataggttgctgcttgtgaaatttcatataatttgaatcatgcagtattagggaggaggtaaaggataatcattgtttaaggggtatagagtttgagttttacaaggtaaacaatgtgaatatactcaacactactgaactgtacactttaaaatggttaaggtggtaaattttatgttacgtggctttcaccacaataacgtttatgtttggttttttttacataatattttttaggttaatccatgttgcatttatcaatagttcattcctttctattgatgagtattatgctcttgtttggatataccacattttatttgtccattcactttttgatggtccgttaatcatgtgtttttgaaaggaatcagaaaaaaagaattgtttaccatttggctacacttaatcttgctcttaattttttctttctagtaattttcaaattcatcccttaaaagtaatttcatctaatttactattattaaataaatattataaaataatttgctatttattaaataaaaattctaaatgtttttaatctggtgcttctaaaagcagaaatgtaggagctaaaatttgtggcaacagtttttctctcaaaactcaggtaaatattgttgcctgcagtttattgccctaagtttgtctggctttttaaaaaatttcattgtcttctagttcttcctttgcaaacaattttactaagcaagttattcttgatatttagtttggtttgctaacttagctactttttctaagggaacatattgtagtattgtaaagaaagctagtaataaatgaatagagtaatagatttgtgataccaacttgataccaatttgtgataccagcttacctctaggaggtaagtatatgtgcacttcactgtaaaattcttccaacatttctatgtttggaagttttacaggctgggcacagtggctcatgcctgtaatcccagcactttgggaggccaaggcgggtggatcacctgagttcaggagttcgagaccagcctggccaacatggtgaaaccccgtctctactaaaaatacaaaaattagccgggcatggtggtgcatggctgtaatctcagctacttaggaggctgagacaggagaatcacttgaacccgggaggcagaggttgcagtgaaccaagatcatgccactgcactccagctgggggacacagcaagactccatctcaaaaaaaaaaaaagaagaaaaagaaagttttataaaatactgggggccaaagggaggggaaaactagtaaattatccagaataggtattggtactgatgttattgtcgtatcctctcatagttttaattctcttttttactgctgttgttatcttcatttgcttatgaagttattctcagtataagcaaatgaatgcacagttagctagctatcagactattaaagcaaattccctgagcaaggttttgaagtaagttcagagacaactctgttagtggctttgtccataaaacatcaatagtagtatgacttttaaatttctgagcacaagtgactaagtaatatattttggagagagagaatcagtgggatcattgtgggtgaggattctcagatgaggggaaaaaacggttagagaagactgaaaaacaaagccactatttcctttgtttatcttttatcttgtctgcaactggatcttgaagttagcctcctaccatgagagaactgtttttccagctggatgaaaagagtagcatcaagtcccctattctgctgttttctgctcacttactcctggagacaagctaagtcaaatcaatatgtacttataagtacctgctttctcagagttgtatttgagaattaaagtatatgaaatgtatactctacccataaatagcttggagtctggtttagaaatctcttacctttaggcatggacaaatttaataaaagtacaaagtatatatgcagttggccctccatgtcaatgggttcatggattcaaccaaacatggattgaagatatagttttttaaaaattacatctgttttgagcatgtatatacctttttcttgtcattattccctaggcaatataacaactatttacatagatttaaagtatgtgggagcatatgcattggttatatgaatatactataccattttatatcaaggatttgagcattcaaggatttttgtatctgcgagaggtcctggaaccaatcccccatagatactgagggacaactgtattcagtgctaaatagaaaataaatgttttagaaattcagagaagggaattttggtgcaggccagagtagtcatgaagaaagactaaaatgatgctgaattagtaagatgttaataggtggggtaaaacagaaagtagctttgtgaaaagaaggattcagcctgaaaaaatacctttaaaaaaacactaaagaaactagaccgactaaagtacattcactaggagaagtagtaggaaataagagctctagaatcaaaatcagggaagcagcatggatgacccttgaggacattatgctaagtgaaataagtcagccataaaaagacaaatatggggtgattccacttctatgaggtctctaaagtagtcacatttatggaaacaaagtagaatgttggttaccagggacctggggaggggaatggaaatgagttttagttttgcaaagaacagtgtgaatatacttaatactactgaactatacgctgaaaaatggtgaagatggtaaactttatgtcatgtgtttattaccacaataaaaaaaatataaggaaagcaatggcatgctaaaaagggaattataagataaaatgcaaagcactcatactttaactccaacctcctctcctctaaccccttcaatccaacttttcccttctttaaaattatctttttcctatcccactgcttccctccattattcctaaaatattaatattaattgcaaaatcacatttgaaatagtatcttgatatataatttatttggattcttgcagtaatttaaaataacagattatattccaggtaaacaaatatggctaagatgaaactagaaccccaaaggaagaaaagtaactgattattttaaattgctactacaaatgcagttggattgaagaaaatatagatgtatttaatgtccattttcacaaaattctaggaagtcatggtatgaagacagaaaggaactagtcatcatgaagaatcagaaaggatttctaagaacaagttcttgctggaccatctaatgttctttttggattggattaataatagacttgagagtaggggattccatgaacataattacatggcattcagcaaattgtttgacacagtctctcacaatggatgagtggaacttctgcttactctaaagatggaaccagatttacccttctgcctgaaataaatgacaaaatatatgtgaaataatggttttgaaacaccagacaggaggcaatgaaggacagtaatctctgagaaacaggaaacaaatgaagtaagccctgtaattgccccagctgtcttgatagagtttccaggacatgatacagggaggggacttgagacaaagcccagcgtgctccctgaggagatgaagctgtgagtgtggggaaactaaggtagctagaattcacaggacagtaccagagagaagagagctgcagagagaaataaccaagggaatgcactggagtgttcagcagagtgctgatcatcacatgcatgtgaagaacctacctgaggtgagggaaagaatcatcctagaggattaaaggcagcagtttctggcactcacacagggccacatagggttgcaggaacagtgcctgttaccagcaaccagactgtaaaaattcatattcaagtggcactgggtagagtgagtactcaggaaggtcctgcctcaatagtggggaataacctgctgctttggacctatgtagcaaataatgaaagcaagacctgaaaggatcagactgtttctaagtgatctaactacatccctgaacaaaactcaaggtttatataaaggaatataaaaataactaccacccaacaaagtaaaatctgtaatgtctagcatcttagtcaaagattaccatgcatgccaagaggcagtacaatgtgatcaataattatgaaaataaaaccaacttagaactgataaagatgttagaattagtagacaatgacagttaaaatatttatgataactatgttccctctattcaaaaagttgagacctagaagatataaaaacccaaatcaaatttctctaaacaaaaactgtaatgtttcagttgaaaaatataccagatgagattattagcatgttagacattgcagaagtaaaaattagtgaacttgaagacttagcaatgaaactatccaaaatgaaacaagagcaaaaaataagaatcttataaaaatagaaagttgtcagtgatgagctatgagacaacttacagtggcttaaaatacatgaacttagaatctccaaagaagagaacacaagaaggtggacccccaaaaaaaccctttttttgaagaaataatggcaaaaaactttccaaacttgatgtaaactatttacccacaggtccaagaagctaaacaaactccaagcacaagaaacatgaatgaagaaaactttaccaagacaccttataatcagattgctcaaaaccaggggtaaagaaaaaaatctttaaagcaacagaggagaaagaaaaattaggtaaacaggaacaaatataaaaatggcagcaagaatcaaccatggaattttaaaccatctgatataggaaatggaaagacttaaagtaattttacagaggatctttatatcatgacagttcatgaatttcataaaaataaaaatatttgccactgaagattgatccaaattctgaaaaagcaagagtttactataaaacaaagacaaaaacctattataaagaagctcgtctgattacccagtgaaaatgcataatttaaaagaactcaaaaagtaccaacatgaactatctaagaataaaagaaaacttgttatttagcagcgcatatactttggcaatgaatactggagaaaagataaaactatttttacttttcacattattcttggaaaatcactgttcaaatcccttttataagtacatatttactaataaaaacatggtaacagaaagggatgtagtatattttaaatggtgtatgttttcttttatgatgaaatgttatggatggcccacatcttttatgaggtgaaaccattttgtaaaaatattagcgaaagaaagtaaaattgatttaaaaaaacagtaaagaagaaaaagtttttaaaaagaatgatagttgctttaaactttaaaacaacagcaattaaaagagacagagggacattatataatgataaaaggtcttgtccaacaggaaaatatcacagtcctaaacatatatgcacctaacactggagctcccaaatttataaaacaattactgatagacctaagaaatcagatagacagcaacacaacaataatggaggacttcagtactccactgtcagcactagacaggtcaacaagacagaaagtcaacaaagaaacaatggatttaaactataccctggaacaaatggacttaacagatatatgcagaacattccatccaataaccgcagaatacacattctattcaagagtgcatggaactttctccaagatagaccatatgataagccataaaacaagccttaataaatttaagaatattgaaattctgtcaagccctctctcagaccacagtggaataaaactggaaagcaactccaaaaggagccttcaaaaccatgcaaatacatagaaattaaataacctgttcctgaatgagcattgagtcaaaaacgaaatcaagatgaaaatttaaaaattctttgaattgaacagcagtagtgacacaacctatcaaaacctctgggatacagcaaaggcagtgctaagaggaaagttcacagccctaaatgcctacgtcagaaagaccgaaagagcactaactgacattctaagatcacacctcaaagaactagagaaacaagaacaaaccatactcaaacctagcagaagaaaggaaataaccaagatcagagcagaactaaatgaaattgaaacaaaaaaaatacaaaagatgaatgaaacaaaaagctggttctttgaaaagataaaattgatagaccattagcaagattaaccaagaaaagaaagaaaattcaattaacctcattaagaaacaaaacaggagatattacagctgacaccactgaaatacaaaagatcattcaaggctactgtgaacacctttacacacataaactagaaaacctagaagagatggataaattcatggaaaaatacagccctcctagcttaaatcagggagaaatagataccctgaacagaccaatagagaagcagcgaaattgaaatggtaatttaacaattaccaacaaaaaaaagcccaggaacagacggattcacagcagaattctatcagacattctaagaagaattggtaccaatccttttgacactattccgcaagacagagaaagaagtaaccctccctaattcattctatgaagccagcatcgccctaataccaaaaccaggaaaggacatacccaaaaaagaaaactacagactgatattcttgatgaaccagatgccaaaatcctttacaaaatactagctaaccgaatccaacaacatatcaaaaagataatccatcataatcaagtgggtttcatacaagggatgcagggatggtttaacatatgcaagtcaataaatgtgatatcccacataaacagaactaaaaatcacatgatcatctcaatagattcagaaaaagcatttggcaaaatccagcatccgttttatgattaaaactctcagcaaaatcggcatacaagggacatacctcaatgtaataaaaccaactgtgacaaacccacagcaaacataatagtgaatggggaacagttgaaagcattccctctgagaactggaacaagacaaggatgcccactctcaccactcctcttcaactagcactggaagtcctagccagagcaatcaggcaaaagaaagaaagggcatccaaattagtaaagaggaagtcaaactgtcagtgtttgctgatgatatgatcatttaccttgaaaaccctcaagactcctctagagagctcctagaactgataaaataattcagcaaagtttccagatacaaaattaatgtacacaaatcaatagctcttctatacaacaacagcaaccaagtggagaatcaaatcaagaactcagccgcttttacaataactgcaaaaaataaaaataaaacacttaggaatatacctaaccaaggaggcaaaagacctttacaaggaagactacaaaacatgctgagagaagtcatagatgacacaaacagatggaaacatcccatgctcatgaatgggtagaatgaatattgtgaaaatgaccatactgccaaaagcaatctacaaattcaatgcatttcctgtcaaaataccaccatcattcttcaccgaactagaaaaaacatcctaaaattcatatggaacaaaaaaagagcctacatagccaaggcaagactaagcaaaaagaacaaatctggaggcatcacacttcctgatttcagactatacctcaggccatagtcaccaaaacagcatgatacttgtataaaaataggcacacagaccaatggaacagaacagagaacccagaaataaagccaaatagttacagccaactgatcttcgacaaagcaaacaaacaaagtggggtaaagacacccttttcaacaaacggtgctgtgataattggctagccacatgtagaagaatgaaactggatcctcatctttcatcttacacgaaaatcaacataagatggattaaggactttcagacctgaaactataaaaattctagaagataacattggaaaaacccttctagacattggcttaggcaaggatttcatgaccaagaacccaaaagcaaatgcaacaaaaacaaagataaatagctgggacttaattaaaccaaagagcttttgcatggcaaaaggaagagtcagcagagtgaacagacaacccacagagtgggagaagaagatgtaaaagtggtccacaaacatgagaaaatgctcaacatcactaatgatcagggaaatgtaaatcaaaaccacattgcgacaccaccttacacctgcaagaatggccataatcaaaaaatcaaaaaacactatatgtgggcgtggatgcagtgatcagggaacacttctgcactgctagtgggaacgtaaacttacacaaccactatggaaaacagtgtggagattccttaaatcactaaaagtagaactaccatttgatccagcaatcccactagtgggtatctacccacaggaaaataagtcattatacaaaaacgattcgtgcacatgcatgtttatagcagcacagttcaccattgcaacccaaatgcgtggaaccaacccaaatgcccattaatcaatgagtggataaagaaactgtggtatatttatacgatggactactactcagctataaaaaggaaccaattaacagcatttgcagtgacctggatgagattggaaactattattctaggtgaagtaaatcaggaatggaaaaaccaagcatcgtatgttctcactgatatgtgggagctaagctatgaggacacaaaggtgtgagaatgatacagtggactttggggagtttgggggaagagtgggagggtggcgagggataaaacactacaaatatgaggcagtatgtactgcttaggttatgggtgcaccaaaatctctcaaatcactgctaaagaacttacttatgtaaccaaataccacctgtaccccagtaacttatggaaaaaaatgaatgacagcagagtcctcatcagaaccaatattcctcctgaacatagatagaactaaacaagattttgacaaatcaactctaacaacaaattacatagataatatgttatgactaaatgggtttatcccaggtgtggagggttgatttaatgtttgaaaatcaatgaactaaaatagaccacctcagtagacagaaaaattatttggcaaaatccaacacccatttctgataaaaactctcagcaaactgggaatagaaggaaacttcttaccctgataagggcatatatgaaaaacctacagctaacatcatattgaaaaactgaatgtgttgctcttaagattaggaacaagacaaaggtgtctgctctcttcaccacacctggccggatttttttttaaactgttttatttcagtaggtctagttgttcatcttactggatttcttatacactattctgaaacctcttgtctttgtgtttagatcatttgggtgtctgaggtttatttctttgatgtttttcatcaaagctgctcaaaatacgttattggttttctgtgccattaaaagtgagctcacttcatgttcttgttgaattctaactgaagctcatttctcccctttttattttcagatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaatgataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccat

SEQ ID NO: 12618 - DNA, 19700 bp, Human
  misc_feature (1)...(19700): n = A,T,C or G
atcaggcaggatcccaaccctcctgtgtgggtctacagccacccaaactgcagctgtggatccaagcctccctgagctcctgggtgggagccaggggcaggcaggatctgcccttctgcgtgcagctgcagccacccaacccacagctgcagacctcagcctcctgctccacggaggaggcaggagccaggacaagcaggagccctgccccttccgaattgatggggcaggagctccccgggtgcagcttcggccaccctcccaggagcaggaccccggcatctgtgcattctgcacctccagggcctgggaagaaccaccctgtacccagccccccaacccccatccctgcaggctcagggctgtctgcttcccactgcctggcctctctctgctcccactctcagagcggggttggggcctagccagggaccataaatggcagtgggaggcagacagagtccctggagggagaaggcgggtccccagtaaggccccgccttcaggccagggagggcctgaaggcctggctgccagtccctctgactggagtggggacttgtggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaggctcagccagagcagggcagaggatggagaaacgatgggatggcccagctgcagagaggagctaccctctctgctgagagcttcagagacctgcagaggtgttcagaacaacttgcctgtggagaggagccactctctccagggacttctgtctgctgagagcagcaggtggcaggaggaccagtgggcagagaggagctaccctctcaagggccttctctgctgagagctgaacactcagtgggaggggaggacttacctacagagaggagctcactgcagatcacctctgagctgttctagcattcaataaagcttctctgcatcttcttcacccttcacttgtctgtgtacctcatgacctcattcttcctggaggcaggacaagaactcaggtgccacagaggtttctgggaagaaaattgacacccaaaaatcccacacaaggacagatgagggtccattctctccagtggcacctatagtccgccaggggttcagcacctaccttcattttggatctgagcctttatgcatttactgggtcttggaatgggaggttcggctggcagggacagccgctgtctacatctttcctactgcatgatgcgcctgatatgcaggcggtggtggcaggtggggtccccctcccacatcccaccagggctgtgtctaggagccacagaagtggactctgcccatttctctctctctttgcatttctgctgtgacaatctcacctctccccaggcagcatggaggaatccaacctaagggcaatgaaaagtttaggccatgttctcgttttcgagcagcccctctctacaagtgcaattttccttctctttcacttccctatgtggcatgcaagggcctctgcaatgtggtcccatccacttctgttcaaccttcccttccactagtgagccacacactggtctggctaacccctagccttttcctacctcccacatgctaatcacctccctccacgaagaatgtctgtcctcgcaggctctgtcctcccgggctgcccatggcttccctgatcctactgtttatgcagcatccatcttaagtataccctgtccttgagccctcctctgtctccccaggcccggggaactgcacccactgtttgagctcactgttcagccccttttgctgtcctagggacatctgttcacattaataagcctgggtgcccagtctcaccagcctgtctgagcacagacagtcacctccaggtccatgcctgaagcttgctggctcccgtctcccacccatgtagcgccctgtcacctgcagaggcccctctacaaacacaggcacttctgggagtccctggggtgtgctactgaggcagaaaatttaaaaatacatatgccttcattcactccaagaaaagtaacaggcaaggcaagggttaaaaagtaaaggacaagttttcctctgcctatagcaagcccactgcaaggacagttataacagtgtccagaaagccaaggccaaaggaatgggctccagatacccgccgccccacttccagagcaaggttgaaggaaaaagagagaaagacaaattcttttactgttactgttttcccaggcttcttaagcatgattgtgttttacaaatgtctgtacttagccagttcttgtttttctttcaatgcagctacaaagtcacccgctgtgcaaggccacaagttatgctatgctatagattatgtgacctatcatgattagctgcttttgttttatttattgtaagtccacttacaaaaaccccgctctgtctttgtttaatgctcagctttttggatgtgagtccactgagccggtgtgtacctaaaataaacaatcctcctgttcttcacatcggtctctccggtcctcagtttcccacaacactgcatgtgcttgagctgctcgtgcctcagctctggcctgttccctggaggggacgtcagtgtgggctgcagctgggtggctggtgcctcagtccgctaatgcccaagttgcaccatggcctacagtaagatggggtgggctgggctggggtagtgcttgctgcttcttttctgacctcttctccactagagaaatcccaatccagcaccctcctgcatttctaagttgcacgtgaacaggttttgcaggttgcctcacgacaatgcccccaggatttgttccttactgaccttgtcctgaggagaaggttatggtgggttaaaaattggtcatcagccccttcctcgtggttagttagtggagactgcagtctactctctttcactgttcggggactgctaccctgcctccttggagtccgagcttcactggcacaaagaccctgaacccagctggagcgttttctcctcactttgagcctctgcagctgtcgctctctacaaagctctcagatacctttcccctccttctgtgaccctggagagatattttacatgggaattcaagatttttctcagagacaggatgtgacgacttccttgttttgttctatccatcttggtttccatagccaagggcagagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtaagtggctcattctcaacagctgcctacacctccatctttcagaaacggcaatcagaaaatgaaggtgggaggctttgggaaggcgtacaattagtggcaccattttattatccgagcttggccgcagcatgggatgtttcgagtgtggccaagaggagatgtccacgcccgtttaggtgggccgcatctcaggaggcaggatcctgatacatcccattgcccccaccagacgaaaaagatttcaagcctcattgcggttcccttcttggggcagtccatcttccttagagactaagagggtggaaatcctcttgtggacctatcgaaatcaaaccagcgcaggcagtgagcactagctggggtctgccggggggaagggcattgcagggggtgtcggggaggcccgtgggagagggccaaggccccactgacacctgcggacttgcagcttggggagtggaggacaggagacaggcaaaattcaccagttacacagcttacagaagtagcaaagcaaagactatacttcagggataatttctgtactttgttactagagaagttttccactctgggaccccacagtctccgcagacatatgcagagcaaaaaatacttcctgtgtttgggagagcaagagacatggcatttattaataacatggattttcctgccaggtttcataacgtggtcatttaagtgtgaaatgtagtcttaaaattatgttagagaatccccaaggttttgctctgcccccatggaaacactgggatcgctcaggacgccaacagctgcatagcaggcgagggactcctgtgggaggacgtggcctgtggacactgccaggttcggagatgtccttgggagatttactatttgtcaggaagatagtgttaagttcaggcaaataattatatgtgtggacagaatctgaaattcaccaatagagtaagtaagagtgagagattgtgaatgtgtaatacaaatggaaaagcaggttttattttgttaagttattcaccagggaaccaactgaagttccttctaatcctctttttctccattcttgctttgctgaaagttggagaaaaggacatgtgtagagaaaatgggatgcttcagggtggctcagaggacaccaatccatagtgattcgcctgagtttgtcaggtggaagcagtgatttttaagagtcactgattaaaaacaaacagtcctaagtgtattagggagatgccatttatttgtgaatcaaaaacttttctcagtctcttaaattatggttttcctgtaataagaatgatttatatttttagtgaaaagttgttttcctttcaaatacagactttttaaaaagacttagtttgagtaagtaccttttcatttgatgcttttcttgtgcctaaccttaggaaatccagaatagtatttgacagaaattatgttttcaacttgcctttgacatctgtcccactgcattttgctttaaaattctttatttaacaataaattatctaaaaaaataacagtagcaaagcaaaaagtactcatctttaaagacagactcgacggagggaccggaaatcagaaaaacatcagggttgtttaggaattgcaggtgcaggaggagagaacaggagtggggcgggctgggggcaatgagagagcaagaagaaaagaaaaataaaaagagaaggagaagaaagaaatgggcttttgctgggtgcaggcagtgacatttctcaggaccccttatttctccctgtgccttccggagggagcagcccaaggctcctgggaggacaagcagcacgtgcccgccggcagagctcagctccagctggaggacccctttgtggtccttgcgcacactgggttttccttcttccccaaatatccgacgcgtccagtcccttactccttccccaggcaaaacctcctcaccaggaacaacctgaaatcaatttacactgtaatcaaaatagcagagggtggaaagtgtttccttcgaggaggggacttacgcttcaagtaaggattgagcaccctggatccttaactgaagagtgaggtcagaaagggcggacgcacagcagcaaacggggaggagggtgctgtccaggagccgctgacttttcccttcaggaagctgccagaccatctctctctgctaaaggctttcaagatgatacccttgagtgttgggagcaaagggaccaggtacctgttcctcctggctcagaagatgctcttgacaaagtcttagggagacctcagctttaagttgttttatctggcagcgggattttaaattttgtattcattagttggctggttggctggttttgtggctggcaccgtgtgagccggtcgcttcttcagtgcctctgtgtgatggcaggttagggtgagtgtttggtctgtggccagctggttcctgagacggtcatggttttgggtaacaggagtgacggaagggtgtacccagacacacgacgtagctggtgaggaatctgaattcgagaagtgcagagcgaggctctggaaccagacagtgggtggaaccccaccccaccactcacccactgtgtgcaggagcaagtcactcagctcctgggcctccgtttccttatctataatttggacctattagtaataataataataaaaataataatactgaggtatagataagtgtttgatagataggaagtacccaatgcatgttagttttattactgtcagcacgtgtgtgtgtgtgtatgtgtctgtgtgtgtgcatctgtgtgtgtgtctatgtgtgtgtctgtgtgtgtgtgcatgggtgtgtctgtgtgtgtgtgcatgtgtgtgtgtctgtgtgtgtgtgtgtgtgtctacaatcctcctcccctgaagattccatgatgggaatcacacgggtgtatcacaacagagaactgaggtccctctagcacttccacggttctggaacatcctgccccaatcccctgtccccaggaggtggcagcctgcccccagtccagggaaattggagtgagtgctccttctgtgagaaggccagctgtgggacctgtctcgcgccccattaccaccttatgagcagacctgtgtcacaacctaacacaacctcgactaattccccagaacccaacccatctgaatggatgcataaacacaccctgagcccctcttggttttggaagttactagctgaacactgacgtgcccctcctggttttgctgtcatggagctctaacctgtgtctagaatccagaagaaaagactgaagtataaaggaaaagagaagggaacagaagagagggtgagaaggtgcacaaccagtgtagacccctttgctggaacccttccttgccagcttccccacctgtcgcagagaggcttccaccagtagccacagagggtgagagtctggactgtccagccagggcctggaccctgcccgaggcctctgcccatgctggttattgtgtgaatcgtgttccaataactgagaggtgtcaacacggccccgcttcggggggaccccacctcctgtccttgaaccttcttgaaacacacctggagctgtcccaacctgtcctctgtttgtcccctcaattttagctctaggagacagggccatcagcccatgcgcctcacaggccacccctcttcccttgtattcctgcctgtctgggtgcctcctagcctaagggtccctggggagcctctaccacctcattaactcaccctgcacacctcctctgatccttctgcctctgcatggcccagcagctttgaaagtccttccttcacacctgctgatggtgttgctgacagtgtggccagtgccctgtggccacaggacaccggaaacacctgccatgccaaggtctcggaagaaaagccaagccgtgggggccgacggggagacagagagggttggagagaggagcccaccgtggccttccaacaagggcactgtgatgaagtgaaaggcaaggggtgcagtcccaggacgaagacagtgcgtgggcgttgggaaggcagggggaagggaggtgctgactttgatttcaagagctcctagcaacccatgggagtgggcattggtttcttccatggttcaggcagagatttcggtccagccaatgacagaatctgcctaaaatcttgcagaactaaatgcaagagaaatatggagagttttgtgtatctccagagactcattggcagcagcacactctctggccgtgagtcattagtgggtcccaagggagcagagcatcaggagtgagggggtagcccttgtctgggccaggtctgggcctcctgggtcatagatgaggaaggggtggctagatgggatgactccatcactgtagccccgaagatgctatcgacacagagacagttaccagctggcctcctgaaggcacaacttgaggtcccaggcctggaggagagtgtcctaggatgtcgttggggctggcaggcagccacctgcatgcactccacttctgagagagcagaactctgtgtttgttcctctgttttgcggactcgatgttccagaccaaagggaagtgggacgaaggttgggttggtggtggtgaggcaggaagaatgaaaatgcatctgagatcttcagagattgccctttgtttgaggaaagtcgctaagcccagaaaagggggggcgctgagcccccacacattgtgtggctctattcctggctctaaacaataagcagcacagaagctgcttcctctgggatccttcagcctcgtccccttgcagctctgtgaacctgggcaaggccacggatgccattaacagtgtcccctgggaaaattagaagcagctctcccctctggccatggaagaagccaagcgctgaggcttgtaaggaatttgagaactagacaaaaataactgaggccacaacagacttcaggtctgatggagtgagttccagctccccctacctttgcacgtcgctccagcacccctttgtccctctccaggtggcccccactgctgacgagagatggtggacctctcagtctccccagactccttgaagccagtatcgctgaccagcagtcttgtcttcctcatgcacctcctcctccttcagcctggggagccgagctcaggtattgtgtctgcagcctagctggccaggatgtgaacgccacccctcctgccaggtgctccccagggctacgatcttagcacagtaccagggcgtgccagacgctaaaatacaaaaaagacttccatcctggttgttaaagagccactaccccgagcattacccagcctgtagtgatgttcctccaccatctccccagcccccgacacctcctccaccatctctccagccctcaacacctcctccaccatctccccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatattatataattatattagttatataatattatataattatattagttatataatattatataattatattagttatataatatatcatatatatgatatataaatatatataatataaaaataatatatattatataatatatataatatataatatattgagtaacaaaattactcatagtgagagaaaggcaaatcaaagctatgtcaaaatgcaatttttttttaactgtcagactagcaaaatttcaaaagctcttccatgtactgttaatggagctatggagaagaaagctgtcttatactatgttagtggaattcaaagttggaaagctcccggacagggaaatttggtaatacttaagaggactagctgtgtggctaccctctgacacagcaatcccacctccaggaacttactccacctccgatacctccaatatgaaaaaagcatatgtatgagtttaatctttgtaaagctttttaaaaacaattgcaaaatagtggaaaccacctaaatgtccaagcataaaagctgagtatgctctatccacccaatggagtaatctgtattatgcatctgaaacaatgatgaggtggtctctgaatggatgcagagtgatttctagtattgttaagagagaaaagtaagatgcaaggttcgataacatacacttgctttgtaagaaagaaggagaaacattgcaaaagggaacataggaaggataaactagaagctgatgagattggccgctgagggtgaggtgtgatgacgggaaggatggcgcttttttcctgatacacatttctgtacagcattggcatttatgccacattaatgttttgcatactcaaaatataatgctagttccacaaggatggagagataagggagtgtgtataatgcaggcactagagctctgggggaattcaagagaaggagaagagtcacaactctaattattagaatttagggtgctgctattcttcattctagggaaactgtcccttgcctaacatgattaaatgccaggagcccttccccacccaatgacccccttcacatttccaaatgtccctcaggggcattactgtccccacatgctaccactgatttagactgtcatttcccgtccatgggcggggagcgccaagcccacacacgtcttaatagcagtcacacttcatgatgctttatggtgactgcaaatgctgaacagtggcaggaatgttatgcgtgatttctcagaagaagcctgacctttcccactcctcctgcctccaccagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcaggtcagtggctgttagctcacacccatcttcctagtcctcatgtgtacatacacattggcccaaaggcagtctataaagacacaatggtactgcgcctgtctgcatatagggtgtgttggccttgacacctgaaaagtcagcaccttggatattaggaacacactaagaacgctactgagaacccaaacagtcagtgagagaggccccagagagcccgcctttctgtgcctaaggccatacactaaaacccatcaactctgctcatcagaggcatcatgggagccaatagattcgtaatgctgtctctcaaacagtatgtattgagtttccacaacgtgaccccagtccctaccctcaggtccccatgccagtgggggatacagacaataagcaaaagaagtgcatcctgtcacatcacgttagaaggtggtaggtgcagccgggtgcagtggctcacgcctgtaatcccagcactttgggaggccaaggcgggtggatcatgaggtcaggagttcaagaccagcctggccaagatggtgaatccccatctctactaaaattacaaaaattagcccggcatagtggcaggcgcctgtaatcccagctactcgggaggctgaggcaggagaatcgcttgaaccggggggcagaggttgcagtgagccgagatctgcactccagcctgggcaacagagcgagaatccgtctcaaaaaaaaaacaaaaaaaaaaaaaacaagaagaaggtggtaggtgccgtagagaaaaatgaagcaggctgaaagcagtgaggcatgtccacagattacaaaaggcacgtccaggaagtgggcgtgtaggcagtgagctgaaggcaaggtcattattaaagtcttattatgaggcagccactgaagggtttcaagttcatggttctaattgttttacattttaaggacaaacccaacatacgggccacttttcacacgagtccaaatcaaaagctattttattataacagaaaaaaactccccctttgatatagtcagtcagatacaagccaatgcacacatgttctcaagataaatgataacttgtctgcaagtaggaggacctggcaacaccgcttaccacagcagttctaaattaccgtgggaattgggatggccatactgtgtgagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12619 - DNA, 31229 bp, Human
gaacagtggctcatgcctgtaatcccagcactttgggaggccgaggtgggcggatcacctgaggtcaggagtttgagaccagcctggccaacatggtgaaaccgtgtctctactaaaaatacaaaaattagccagcatggtggcaggtgcctgtaatcccagctacttgggaggctcaggcaggagaatcgcttgaacccaggaggtggaggttgcagtgagccaagatcacaccactgcattccagcctgggcgacagaggaagactccatctaaaaaagaaaattaatgcaaaagaagacaatttgggggtcttttcaataattcagtggtaacacacagtatatggagagtttgtgtattgctccaattcccgagtttaaaaggtttaaggtctagttccatatagaagtcctgcagttctaatagactgtgttttgatgaaatatcctcagtaagttagtatgaggtatgcacaacatttctgctgaaatccttatcctgcctatcattttgcagtggacatccatggttcagtttgcctggcaatcctcccttctcataagaacatcatcgctcttcttttagggaactaacagatcctccccaaactccaatcaggtggtcctaatccaggttgccaatcgcagtgcttcaatcacaggagtaagcacaggtcctaggccaggccaatcacagctccttcttggattttccaatttgataaaatccaggctggctggataaaatccagagggagagtttactcccactcctagtgagagaacagctgccaaatttctagtcttatggagctggtgtctgacaaactgaagctgagatgcagaaaaaagctgagatgagagacggggacatcttggtggtggccaggtggctagtgccatatacatccctgcccaacctcattttggttaggtgagcaccagtcattcccatttattcttttaacaacaggaagtatttaatgagcatctactattatgagccaatcattgaagacacagtgatgactaagccttccagtgaacacaaaatatatattaatgtaaaaagtactgcaagttatggacatttggaacctaagtaggcaaaccatgacttaaatctcatttaggctgggcacagtggctacacctgtaatcccagcactttgggaggctgaggcgggagggtcacttcagcccaggagttgagaccagcctgggcaacatggtgaaacccccatctcaaaaaaatacaaaaattaactggtcttggttttgcagcctgtagtctcagctaatcgggaggctgaggccagaggacagctagagccccggaagtcgaggcagcagtgactgcagtaagctgagagcacaccactgcactccagcctgggcgacagagcgagacactgttaaaaaaattaaaaaaaaaaaaaaaagaaagaaagaaagaaaagaaaaaagaaaaaggaaaagaaaacttatttaattctcaacaaatcctgttaggaagctcagagagggtcagtaattattgcaagtttctagcgctaatatatagcggaaccaagacttgaacataggttttcgactcaacaattgttttaattactctgcgctgcgtaaactgagaaacctctgaatccttacaattttaaaagaacaacttacagttttcagtttccatcagattccaattttctaccaaattgcagccctgaggtatgaatggttaccaaactttagttaaacaaacaaaattagctcattaagtaacagagaaaccactctgcccagcctgcattttttttttttttttgtatgagtttgcctcctttatgcgcaaggctccttgggagttgtagtctgaggcatagtcctgtgggtggaggcgctgactcactgggacccaatcagcagagagtcaacttgctctccgcgcagcgattggctggaagtcagcggtctcccgcccgcggcgccatcgcgccattcctagttaaggcggcacagggccgaggcgtagtgtgggtgactcctccgttccttgggtcccgtcgtctgtgatactgcagtgcagccatggcagaaccgcagcccccgtccggcggcctcacggacgaggccgccctcagttgctgctccgacgcggaccccagtaccaaggtgggcacaggaccgaagggaacggctcccccagctccgctgggccgggaccgggccgcattctatccaaccccatcccgccgccgctgcaggtccgccggcctcgggcggacgggagtgtgatgggaagagggataatggtgtttgatggggcgatcgtggggcccgcgaagtgtggaggggatctgttgcctcagctagtttcaaagactgcgaccctgttttgaattggcttgtttatgttgcgacggtggctggaagccaggccaacccagggtcagctttcccaaatcagtcgccaaggcccacgagaacagtagtttcagaactcccagaaataggttcaaagatgcctgtcctgtaccagtcctgcccagcctcgtttttccttaccaccctgactgcagtcttaactcctgcaaactaatttgatcgctctaagtttaaccgcgcccagaatttcacttttgcttgcttggcctttgctgtgggtcacaacagcccttcttgccttcctcatcttcgtggggcccaggagagattacagaatcatagagtttggatctgaaaggaatcttagaaattccttctcttaccctctcgttttacagtaatgacccagtaagagaaatgacctgttgcatacaaaggctttcacttaccgaacatgtctttactgagtaagaatcagtgtaactcactcaggtgtggtgtttcggttgccttgttaagatcagacacagttggcgggcgcggtggctcacgcctgtaatcccagcactttgggaggccaaggcgggcggatcacgaggtcaagaggtagagaccatcctaacacggtgaaaccccgtctctactaaaaatacaaaaaaatgagctgggcgtggtggcgggtgcctgtagtcccagctactcgggaggctgaggcaggagaatggcatgaacccgggaggcggagcttgcagtgagctgagatcgtgccactgcactccagcctgggcgacagagtgagactctgtctaaaaaaaaaaaaaaaaaaaaattcaggcacagtaaccgctgtttattccagtgaagtcatcagtgtctgtaaacacctttgtatttatttatttgactacatcatttgtaaattccttgaagattgaatatgtgcttcgtgcagacctttaaaaggggtagataagtggtccatgactctggtccctgcttgttctttaccttcagggcaaagagtcagacacatctcattgctaaaacttttgactagcacctggtacttggcttaggaaaaatgttagtcattgcaaaattaagggggaaggtaaaaaaattccgtcatgcccatctcacttgtatatcccttaatattaatacctggttttttcatataatgtaaattgagtcactcagtgtaaagtattttcccagataactaggggttttatgtaatggggttttcaaataaaaaggattccagggatatctttataaaatatactaagtaaatgtccttgcagcttaatttacattccacagtatctaaatttctcttgatgattcggagtaattaattttgagatcagtaatttttggccatgggaataccacgtggagacataaaatggaatacataataatagctggtatatattgagtgtgccaggccctggcttggtattttaagtacattgtttaatttaatcctaacaacaaccctatgaagaaggcataattatgatcttcattttacaaataaggacactcaggcacatagaggtgttgagtgatttgcccagggaggaccccacacttccaacctccaccctgttctgcttctggggtgctgactccagcagtaattttggaatttgccataaaggaaaataaaaaacctcaatgaacgctgggtgcagtggctcatgcctgtaatcccagcactttgggagagcgaggtgggcagatcacctgaggttagcagttcgagaccagcctggccaacatggcaaaactctgctctactaaaaatacaaaaattagctgggcatggtggcgggcacctgtaatcccagctacttgggaggctgaggcaggaaaatcacttgaacccatgaggtggaggttgcagggagccgagatcatgccactgcattccagcttgggtgacagagtgagactttgtccaaaaaaaaaaaaaaaaaccctcaatgaattaaattcagtttgatcacttgatacatttatgctatatgtaaagaagatggtaagtactttggggatactgggataaacaagatgaggttccctcccttcaccaacttatatcaactctaatatacaatggacctggggttagtgtgctattgaaatataaatcaccctgagagcaccctgggaggtagaggtttttaaaggtagcattagtggaatggggtatgcacagggtatttggagcctgaagacctgcatttgaatccccacttctgttgttggctgcagtgaccttgccagggcacttgggctcagtttgtagaaggagcataaagatatctcagagagctgctatgaggataaaatgacatgtattatgttctctaaactatgaagagtgatacaattcaaggttgtatttcagctgtggggatcagggcacacatcaaaaagatggtggtgatgggcctatgccttgatagattgggtaggattccagcagagtacatgggaaggcattctgatgaaggaaacatcttagcaaaaatgtgttttgatacggggggaacccaccccaatatttcaacgtaggttctttctattttccataagtattggccagctgagaaataaagagtacaaagagaggaattttacagctgggctgccggggggtgacatcacatatcagtaggaccgtgatgcccacctgagtcttagaccagcaagtttttattaagggtttcaaaaggggagggggtgtaagaacagggagtaggtacaaagatcacatgcttcaaagggcaaaaagcagaactactaataagggtctaacaaagatcacaaggcaaagggcaaaagcagaactactgataagggtccaacaaagatcacaaggcaaagggcaaaagcagaactactgataagggtctatgttcagcagtgcacgtattgtcttgataaacatcttaaacaacagaaaacagggttcgagagtagagaagcggtctgaccacaaatttactagggtgaagttttttccccaccctagtaagcctgagggtactgcaggagacgagggcgtatctcagtccttatctcaacctcataagacagacattcccagagcgggcgtttatagacctccccccaggaatgcgttcctttcccagggtattaatattaatattccttgctaggaaaataatttagcaatatctctcctacttgcacgtccgtttataggctctctgcaagaagaaaaatatggctctttttgtccgacccctcaggcagtcagaccttatggttgtcttcccttgttccctaaaatcgctgtttttctgttgtttttcaaggtgcgccgatttcatattgttcaaacacagttttacaatcaatttgtacagttaacacaattatcgcagtggtcctgaggtgatgtacatcctcagcttacgaagataacaggattaagagattaaagacaggcataagaaattataaaagtattatttgggaactgataaatgtccatattaaaatgaaatcttcacaatttatgttcctctgccacagctccagctggtccctccattcggggtccctgacttcccacaacagttttaggatggtagaattgcaatgcagggcaggtactggagagttagttaaatgttattggttgcagttcaggttatctaagcagtggtggaagaggctaacatggtaggttggggccagattgtggagacagctttgagtgtcacatctaaggaagttagattttatatacatagtggggaatgagtcagggttttgaagtattctataaagtagattggagggatccaagtctggaggtgattaggccacttaaaaagctcttccagaaggtgagataagtgatatgagggtctcgtttgtaaagaagacagcagcaatggcacaaagtcgacttgttttttgatcatttgcatcttcattataaaggaagtccagagaatgtatggctatgtcacattttgggcaatctctctgggctaactttctttaaaaggtcagattctcctggcaacagagagagactccgtctcaaaaaaaaaaaaaaaaaaaaggtcaggttctccttccaagtagtgatctggagatcttttcttttttactatctgtatctgtctccactaatacagtagacaatgtcctcagtgttgccattatttctaccaccactgccaatgtccattttcacatcgttccatatataaatatatgaatatataaaaatataaaaaattaatatatattaatatataaatatatctataaatatatgaatatatatatatatgatggggtccctctccaatcaggtagattggtggaattgaatgcagtagaaaggagaatagggaatggaaaggaggaaggaagaaggacaatggccagataaatggctgactattcaaggcatagagaatcataatatatataaaggcataatgacatcagagaactgaggcagggacctacgggtaacacagtgaatgaagttataagcagtgggacttgagggaagggtgaccaaaacaatcattagggtactcaaagaaaagatgagaattcccattatattcatttgtttttctcaccctgtaatggttgctatttaagtgataagggtatgaaatagaaaatgtttgagatgaccggtttaggggagtggtgataaccgttggtgttagagaagtatgcagctacatatgtggttgcttttgggactgtctctcaaatgtgttgaggaaccactgaagtattgatttttaagccaaaaatgacatgacagggttttctttatggaaagatcactccaaattgcatgtagataagcctatgaaaagcaaagagataattgtctaggcaggaagtagtgaggacttcttgctttcctcaagatacactgaaggcagttgaaaagctcatttttaaaagtctggtgaaaaccactttgttcacttttgttttgtgggagatgtgacacctagtaataaagagttaacaaaccctttccccttttatgaaaatttgacttttcgttaactccctagtttcccagaaaacaatgaaaaattgtgtttgttgcttatggtaaaaataacccaattggtaaattgcatctggagagggagaattgtaaatacttgaaaggaagccatagctttggacttccctgattgtagtgactcttataactgtcccttgtggaaattctagaagttctgcctatggagttgctactagagatactggctcctgtggtacatggggccttctgccctagggtgattctcattcatatccagtgtgaatcttctccctgtacctgatctgtgtcgactcctgtaaggactcccactgaagaggaacacctgatacttctttgttggcaatctgtgttttcctaacagataccgttttgagtaaactggcaccatgtatggcctatggctatggttgtcttataagtctggatgtttagttgagccttaagaagactttctgggccaggcccggtggctcacgtctgtaatcccagcactttgggagaccaaggtgggtggatcatgaggtcaggagttcgagaccagcctaaccaacatggtgaaaccctgtgtctactaaaaatacaaaaaaattagccagacatggtggcgcgtgcctgtaatcccagctactcagggggctgaggcaggagaatagcctgggaggcagaggttgcagtgagccgagatcgtgccattgcactccagcctgggcaacagagtgagactccatctcaaaaaaaaaaaaaaaagaagaaggctttctgttgggggcaatataacacttttgaaagttatttgagagacaaagtagatagtctctaaagggaattggtctcagtcttattaaggtcgaaagacaacattttttaaaccagagaaattttttaatttctgaaaatatggctaatgcaagtgtggaacttctcctttctgcagactgagggtaataaaggtgctatggtctgaatgtttgtgtcccctcaaaattcatgtgttgaaatcctaatccctgaggcaggtattaggaggtggggcctttcagaaagtgattaggtaggtcatgaggacaaagtcttcatgattaggattagcatcctataaaagagactgtaaagaatgatcaagcccttctgccatgtgaggtcacagtgcaaaggtaccatctatgaggacagacactaaatctccaagtgccttgatcttggacttcctagcctccaaacctgtgagaaataaatgtctgttgtttataagccacccagtttatggaatttttgttacagcagcctaaatggactaagataagaggcaatggagattttaactttaagatgtaacctcttacaaagctctctagtaatacttctagagaaataagtatcttcatcactagaagcaaatttgagattttgtagggagaaaacacaaagtcaaacaacgtttttatcattgttgtagctttttgaccagttttgattcatcctgaaaatagacatattgtaaccaaatacactcatatcccattgtgggaggcagttgtataaaattcatttagagactctgcttctgacaagatgaagtagacatacttttccttattcctcctgctaagtacaactaaaaactctggacatgatatataagacaaacattggaagactctgaaaggtggtgagaagaaggtagactggctagggaccttgagaccctaggaacaacaaggcaatgagtttcctaagttttctttttgcctcatattgcccagacttgaagctgaagaagctagtaacctggaaatgctgatggacacagaccaaaaaaaagcctaatgaaagcctgctctctagccacaggacctggaaatgggcagcatttcctggcaagaaagaaaacttttagacaataactgctctactccaactaaactccatagagaaaactgtggcctcagtcccacccatgccagcaaaagctgagtggggagcctagattttcacccaaccagatgtaatgagctgcccagccttcccctgccaaggtgatgtgggggaaggctgggtagggagccaggactttcatcctgccaggctttcccctcttgccatatcaatggagacacatgaggaacctaaaattccaccccaacccagcagtggaaatatttaagataattataagcgggagaaggtacaggaatgtaaagagaggtgaggtttctgtaccttgttcaaactaataaaatgatgtcaccaaatgactgataagttatgtgtgtgtgtgtatacatatacatgggtatatgtatatacatatatacatgtatgtctgtatatatgtgtatgcgtatatgtatatatatgccatatgtatatacatatatagtaacacctagagccaccatttaaaaagctatacaaagagatacatgcaaaaacactacagataaatgaaaattgaattttaaaaagttccagtgacccagagaaaggcaaaaagaagacagaaaacattaaaaaaggaagaacaaacagaaaacaaacatgaataaaatggccaacttaagccctaacatttcagtacttacattagatacaaatacattaagagacaatgattgatagaatggattaaaaaacatgccccagctgtatgctgtctacatgaaactcacttccaatatgatagagacaaggtaaaagtaaaagggtagaaaagataattcatgcagatattcatcaaaagaaagcaggagtggctatcttgatatcagataaagtagactttggggcaaagaaaattaccagacataagaagtacattatacagtgataaaagagttgtgattgaccaagatgacacagtaatcataaatatatgttactaaacagcagagctagggaacacatgaagcaaaactgatataactgaaaggagaaatagaaaaatctaaaattatagttggagacctcaacactactctttttttttttgagatagggtgtcactcctgtcacccaggctggagtgcagtggtgccgtctcagctcactacaatctctgcttcccgggttcaagggctcctcctacctcagcctcccaaggagctggggctacatgtgtacactaccacacccagctaatttttctattttttgtagaaatggggtctcactatcttgcctaggctggtcttgaactctggggctcaagcaatccagccacctcggcctcccaaagtgctgggattacaagcatgagccaccaagcccagccaacgctcctctttcaacaattgatagaactagacagaaaattaacaaggaaacagaagaactcagcaataccatcaacaaataagatctaattagtatttatagaatgttctaccgaacaacaacagaattcccctttttttttccaagtgtctgtagaaaatataccaaagtagaccatgccctgggtcctaaagccaacttcagcaaatttaaaagaatggaatgatgtattcttcagcaacagtggaattaaactagaaatcagtagcagaaacataataagaacatcttcaagcactgggaaaataaacagcacacttctaaataaataatccatggattacaaaggaagtcttgggaactttttaaaaatattttgagctgaggccgggtgcagtggctcacgcctgtaatcccagcactttgggaggctgaggcaggcggatcacgaggtcaggagatcgagaccatcctggctaacatggtgaaaccccgtctctactaaaaacacaaaaaattagccaggcgtggtggcgggcacctgtagtcccagctactcgggaggctgaagcaggagaatggcgtgaacccgggaggcggagcttgcagtgagccgagatcgctccactgcactccagcctgggtgacagagctagactctgtctcaaaacaaaacaaaacaaaacaaatatatatatatatatatatatagagagagagagagagagagagagagagctgaatgaaaatgaaaaagggatcatagctaaacagtgcaaagggggaaatgtatagcactgactgcatacattataaaagaggaaaagtctcaaattaataacgtaagcttcctcctaagaaactagaaaatgaaaagcaaagtaaacccaaaggaagcagaaggaaggaattagagaagcagaaattaatgaaattaagaacagaaaatcagtaaaacagagctggttctttgaaaagaccagtagaatagacaaacctgtagcaagactgacaatgaaaacaaagaagcacaaactaccaatatcaggaatgaaataggggatacactacagacctttctgacataagaaagataagggaatactaaaaacaactttgtatacataaatttgacaacttgaattggaccaattcctcatccaatatgaactaatatgatgagtcctataacttaaggcaattgaatttatgattaacaaacttccaaagaagatttgtccagacccaggtgatttcactggagaattctgccaaatgtaaaagaagaattaacatcaattatacacaaccccttccagaaaactgaagacgggagaacacttcccaattcatttgataaagctaatattaccctgataccaaaaacaaatgaagacagtacaagaaaactacagaccaatatctccaatgaatataaatgtaaaaacccttgacaaaatgttagtaaacagaattcaacagtatatatagaaagaattatacaccttaaccaagtgaggtttatatctaggatgcaagcctggttcagtatacaaaaatcagtcagtataatccaccatattaagagggtaaagaagaatcacatgatcatatcagttggtacagaaaaggcatttgacaaaattcaacactcattcattattttttttaagttcagaaaaaaataggaatgggggcatttctttaacttgataaagagcttctcttgaaaagttagagctaatattacactcagtggtgatgctttctccctaattttggtaataagacaaggatgtctgctgttaccactcttatttgacaaagtgctgaaagttctagacagtgcagtaaagcaagaaaaggaaataagagacatataggttggaaaggaagaaatcaaactgtccttatttgaagatgacatgattgtctacatagggaataataagtaatttacagaaaactcccagaattcataaatgagttcagcaaggttgcagggtacaaaataaacatacagaaatcaatcgcgtttctatatactagcaaagaacacacaggcaccaaaaattaaaaaatacattaccatttacaattgcccaataaaatgaaatacttagatataaatctaataaacatttacaggacacatatgctgaaaacagcaatggcgatgcaaaaagtcatagatctaaataaatggagagatttattgtgttcatgattggaagactcagcacagtaaggatatcaattctccccaaatcaatatacatgtttaacacactccttatcaaacttttttagacagagacagggttattctagattgaaaggcaaaaaaactagaataacaaaccattttggaaaagaataaagtgggaagaatttttctacctgattttaagacttacatagctacagtaatcactactctgtggtattggcagagagatagaacattgaaacaaaatagagaaccccaaaatatacccacactagtatgcccaacagctttttgacaaagatgaaaaagcagttcaccagagggaggatagcctcaacaaatggtgctgaagcaattggacatccttaggttaaaaatgaagctctactcaattctcatcccttataccaaaaaaaaaaaaatccatttactggtgcttaaaggggccttaatcctttggttcacatccttgcctcacttttacagttttgtaaggattgtattgtaggcaggtaggacatgcactagaaacatccttgattgtacctttaaagttttcttggcggttgcggtggctcacacctgtaatcccagcactttgggaggtcaaggcgggtggaccacaagttcaggagtttgagatcagcctggccaatgtggtgaaaccctttctctactaaaaatataaaaattagctgggcgtggtggctggtgcctgtagtcccagctactcaggaggctgaggcaggagaatcgcttgaagctcgggaggcggagcttgcagtgagccaagattgcgccactgcactccagcctgggtgacagagcgagactccatcttaaaaaaaaaaaaagttttcttacagtagttttcttaattaaatttggagaatgacacttcccctccccccgaaaaaaaccttattatttctattgtccaccttttgataaggcacaggagcaaatctttgtcacccagtagccatccctgtaaaaccaaagatagtttaggcataaaagacaccttatttttattgttctaaatttaaagcatgataagggaaagacaaaattaaggactatcaggtgagacaagacatgagcatagcataagtcttactttttaaaacaggagatacatgtattttaaacgatattttagaaccataccaataaagcaataatttttaggaacttaactttttaaaacaggaactttttctcaagatcatgcaagtgttcacaagaggcacatggagttaacagactattttggtgataaaaataaaactgttatctgagcatagaataacttgatcattttcttaaaaataagcccttcttgtttttatatccatttaacaatttgtagcaaaggatttataagcctctattttatcaataaattcactaacattgaatatatcttactttttttgccacgtatagactttttaaagtgaattttaatattctttatgtgtatgtgtttaggcagatacagtacatagttctcttaataataaagttaaagtctgtaacattaattttaagatataattaatctcaatagcatattaagtggtatttgttttcatatgcatgtgtgtgtgtatatatatataatgtttttaaaagctaatataccattttatatattcccatgccattagacttagtataccatctgtatatatctccatgccatttaatatacctcgacgcagcattttaaatgtttttcataatattcttttatgcctgtgtcatactatctaactattcctttgttagaggcagttagtggtttaaaagcaaggactttggaatcagattgcttgggccagaattttttctctgccacttactttctcagcagtaaaatggggatgataataatatgtatctcatgggcttgttgtgaagattacatgtattagtttctttgaatctcttagaacagcatctggcacatagttattgtgtaagtgttgtgatggatgcctttgtacataaatctttgtcagagtaattatttccttagaattttagaaagagaacatcttggtcaaagaatatgaattcttaggccaaggcaggcggatcacgaggtcaagagatcgagaccatcctggccaacatggtgaaactctgtctctactaaaaatacaaaaattagccgggctgggtggcgggcgcctgtagtcccagctactcgggaggctgaggcaggagaatcgcttgaacccgggaggcgggttgcagtgagccaagatctcactgctgcactctagcctggaaacagagggagactctatctcaaaaaaaaagaaaagaatattaattcgtgcaccaccactactggctgattttttgtatttttagtagagacggggtttcaccatgttgatcagtctgtttctcgagctcctgacctcgtgatccgcccgtctcagccccccaaagtgctgggattacaggcgtgagccactgcacctggccaagaatatgaattcttgaggactcttgatattccagttgttttccagaaagattgtaagataaggatatgatagactatgggatagaatagttaaggttgtctaactttggcaagtacttggcatggcatctacaacaaaaaatacatgctgtgcctaagatatatggatttgagtatagcctgtatagtgtgaacagaagtaatgataaagtcgttggtaaagtaccaatactaatgttggtactagaaagatgttgaagaaacaaaacataaacagggtcactacaaagcagattttaaaagatagtttttagattttatccttttttaaaaaaactgagcaacaaataatgttgggtgcagcttggttggaaatatattatctcataattccataggctagaggtccgacttgggtctgtcccactgtattgacaggactgtgttccttactcagaggctctggggaagaatctgcatctaaatccatttagattgttccctgaattcagtttctttccactgtcggacaggggtcccagcttccttgctggctgtcaggcgtggatgggtatggtggggtgggagcagagggcagctgcctttaactcctggcacatgtgccccatgtctcagagccagcacctgcaggttggccccttctcacacttggaatctgtcccacttccctttatgccacactcctcttctactttctttgcgcgcgcacgctcgctctctctctctcctgcttttaaggtcttgtgtgattacattgaatccacctcagtaatccaggctaatcccattttaaagtccactgatgagtgaccttaatttcctctcagagtctctcacagcagcacctaggttagtgtttgagagaataaggaaggacatctttagaatttagtccttgcttgcacctccctccagggactgcagtgctccctcctgagactgagaaccagtgctgggaggacagatctcccccatgaggcctgccagctaaagtctgtgtgattgtgtgtggtcgggcctgacagatcatacataagactttgtcctgcaggtggcttcctcaagcaaacattgtaatcaatagagaagcagctaccactcatattagctgggaaagaaggatgtttgttattttggtagtgttcatagtgccttgttttaatgtatacttagaccggaatatgaagtggacatggtcttgctgctttaaattttttttttttattttggtatcacatcatggcagccacagagtgactttatatatgttcaacaggagaaaaccaaggcccagctgtgagtaccaggccagcacttggatgtgcagagctacttttctctttctcagctgcttgataaaatcgagacctttaggactgtagcatctgactgagaaaagcaacccaaatgttctagaaacatgtaacctgcctggcatgtgattataagctgcgaataaagaatttaattattatatttattaagatcagttttaataagataaagtagtttttaggctagttttgttttaaatgagaattttaatgcctaaaagagtatgtttcatttacttaaaatttagcaaaagagaaaaatataatttcctaatgaggctgaatgaactatatttgtattttatatgatgtgagttatataggagaaagatggcatgtggctccaaagtaagtggtcagaattttcaggcctgttttgtcaagccatgggtttaacagaaaaaaaaaaaaaatctgttaggaagcaccagtgaggttcacagacttatggtctggaaggtacataccaatggtaaagggagaccaaaacttagaggccttaaacagttaattactcagtgtcagcttctcatctacaacatggggtatgaatatcgacagtaataccatatagagttattacacctagttaagtcctaagtagaattattaatgctattaataatcttaactccatgaatttacataccttctacccttttctcagtcaagccttctgtttcctgataagtaagttgaatttcccaaaggtgttagcaacagtaactttttacccttttagttatttaggagtctaggatcttgtgagtaactctttgctaatttgcgtggtcaccagtaaatggttctagaagggcatttatgccttcattcaacaaatattgtagtgatcaacctctttatgtgtaaaatcagtgtcttagtttgggtagccccaaagcagactagagagaatggtgtggttttaagtttttgagaagtggtcacagagagctctgcagagttagggagagagggtgatcataggtgtatacgagtggattaccactgtgggcaactgaggttcaatcctgctggggattctttgagggactttgtggtacctgcctctgaattgtcccaccaagggacagggatgccaggttttttatcgaccattggttgaaggtcattcctgcagtggaaactttctgacactttggacttgcatcacacaggggcctgcaaccagaagataccactgagcagagagcccttgcaagttgtaggtggtaggttaacaattgtgtttgtatcttgttacagaaagcacaattaatgttggtaataaatggtaaaagtgaaagatgtttaatataaatatttttccataggattttctattgcagcagaccatgctacgagtgaaggatcctaagaagtcactggatttttatactagagttcttggaatgacgtaagtcaagtacttattggcaccttaatgtttaaatatatagctttgcaaatctagagagtgttttcagacccatcttaaagtttgtttcagaagtaacagaagttcttttggccaggagtctgtgattaggcctggctggacagggcttctctcgtaagttctttttcttctctatcccagccagcctgaaagggcaaaacaagacacaaatagttgcattttctccagtctgccttctctgagcgctcccagctaaatccttaatgtgttcagaccccttttgatgttctggccacttttagcctcttgtttacttcagaaaagttatagataataagaacttactactcagaaaaccaatgggtttacttaaaactgaccatctgttctatttttctaggctgtgttttcttttgctcaacaggtcatatccactgatcttgcaatcctaaagcatacttatttttctaaagcatgtttatttttctttttttctccagctttactgaggtatattgagaaataattttgtcatattgttgatttgtttccctaagttatgtgagcattttgcttttgagcatatagatacatgaataataaaataatctttaaatttagtgcctagataacttccattcacattgagagaaaaatttaagtaatatatgtctatatttagaaaatttgaccagttcagaaaaatacaaaatgaaaagtaatagcttccctccccaagttcttctccccagagataactgctgtccagtttcttgtgatttttttctagaaaaaggtattatgaatatatttatgacatatttaaaggacaaaatgaaaacagatttattgaacacttttgccaggcacttcaaatgttattttgttcagtcttcacaccagtcttaggaggtagcttttatccccatttcacagacggagaaaccaaagcttaatgagatgaagttactagctccaaatcccacagttggcatatggcagggctggaacctgtatccattgtctgatgggctctaatgtagacttcctgtgcagagcccccaaatagggtacaagttgacagtaagctggaagatttgaacagctgagaaaagcaagttgcaacagtttcatttccttcagtcccaactgattggtccatgagggttgtgtagtctgctttagtaggtgcagagattgtttttcatgattggagtatttgaggtgtttgatactttattataaacatgttagagtaaatcttatttgtgataagtcaatgcaaggatctaagtgggccaaggtctattatatagcagtgataatgaaataaaagattggaagcagaactctagaaactttccatttgctatatggcaataacagccatttgctcttattgattatgaacaaagtcatctttgaataatctaaagaaaatcatatatgcattctcatgccaccttactccttgccaaataatcctataccatttaaagtcatttaaggttcaggacttcagttatctttcttaaaacctcaggattcataattcattcactctctctcccatcagtctcttctactgtctctttcccctcagagaagcgtaagtcttctttgttccagaatatttcttgccctctgctccttcgcctacctccccattgtcactgccatgcttgctactgttttacctgctcacctgccattctctctccccagtacagtgtaatccagctgatgcttccccactctgctgacattgctctcatgggacctttccatatctcatgaccttttcttagtcttaatactgtttgacctttctacagtatctgatactgttagccaccttactgttgacattcacgtcttctgtgatactagtctgtccttcctccttctttcttaccacctatccttaatttcctttcctagatgttttggcatagtaagaactcaataaatgtgtttatttaactgaatgacatatttatatatgtgtttgtatgtgtgtatatatatgaaatagcaacaaggttctttatatttttcagtacaaataaacacagttctcttttggagatagccgtttctatttattaacaagtaccataatttcagctaaatgttactatatttacagaattgatgaattacagaagttttcatttttgtatttcaaatatttacagatgcatttttcatgatattttttcactgatttttcctcctgcttattccattaaaataggcttactacatatagctcttctttttagtaaaacttgaatattaagttatgttgattatagtatgaattagcctttcctgttgttaatgattcaggcttgttgttttttcattgcaggctaatccaaaaatgtgattttcccattatgaagttttcactctacttcttggcttatgaggataaaaatgacatccctaaagaaaaagatgaaaaaatagcctgggcgctctccagaaaagctacacttgagctgacacagtgagtatgagtttctatatttatatatattatagattttttaaggtagtttttaaaaatcttttttgttttgtttactgaccagtataattcaaaccagatctgcctatgacttcacatttttaataatatattgaagtgtttttcatgcatcttttgatctttgtattgttcttgggcaaatgagatgtgttttttttagagacaggctctctgaagcctctaacttctaggtagtcttcctgcctcagcctcctgagcaccttggactacacatgtgtgccaccacacccagctagtttttgtttgtttgtttttggtagaggcatagaggcaaggtctcactatgttgcccaggctggtctcaaactcctggcctcaagtgatccgcccgcctcggcctcccagactgctgggattataagcatgagccaccacgcctggcccatttgtcttttatttttatttatttatttatttattttttgagacagagtcttgctctgttgcccaggctggagtgcagtggcgcgatctcggctcactgcaagctctgcctcccggattcactccattctcctgcctcagcctcccaagtagctgggactacaggcgcccgccactacgcccagctaattttttgtattttttgtagagacggggtttcaccatgttagccaggatggtctcgatctcctgacctcgtgatctgtctgcctcggccgcccaaagtgctgggattacaggcgtgacccaccacgcccggcctccatttgtcttttagataagagaatataagaccctgaaattgtaagatatttgcctgtttgtctctaactaatttttaggtactataattagtctttcagcatccaaaattttgttcttttattattttgctacattttggatccagaaatgtgatatcatgtgttcctttaaaaattcttcaaaccattttgtaataattaacattcaaatttggtatttttataacttgagcacttaaaaatgtaggcaatttctttacattgtttatctgcatactttaaaagagattgatttcagagtgtgtgatttcgtgtgtcccttgattcaaaataaagctttggaatcaggcaggcttagatatgagtctgtgactctaaacaagtaagtggcagtttcatcaatagaatggagatgttcacacctagcccatggagctgttttaagggtttaaatgaaatataaagtacttagcacaataaatgagcattattattattcttattattgttcttgtccagtacctgtatttactgtctctttagtctcgttaaaatcatactttggccatttgtcctttctatagttgaaaacttaatatttttgtagcaggggttaggccaattatgtaaagtagcatataaacgtggtaagatttcaaagatgttacttgcttttcagaatatctattccctaggacattgtagctatgttttccttccttttgtagcaattggggcactgaagatgatgagacccagagttaccacaatggcaattcagaccctcgaggattcggtaagtttgcctgtttttatgtgatatatgtagatttgtgtgattttgtattatgtatataattatgattttaataaacctaaaacattaatgtcctaattaagtatgatcaatttattagagatatgattatttttattttccacaaataatcttatttaggagttgtttaatttcagagtctcgatctaaaattacacttaccatctcaccatgatttacttttaagtctcagaattaatttccagtagacttttttttttaaaaaagctgtagttaatactaatcccagtttctgctagcacatacacttctgccttgatctccagtctctcaatcaagatgacagtattgcaggcttcagctggctgctatagtcaatgccaaccacaaacctattaagtattagtaaatgattactgttttttggtgtcgattattcttaactgattagactgtatatgagctgatattgattaattttaaataatttataattcaaggcaactaattaactacttatacccagcccattagatctatatttgttctttaatgtattatagattttgaacctacctaagtctgttcccaagtgccttatgttttgaaataaacaagttttggaatctacttgtggtacttggacaccctgttataattatttcttccttctctctgcttttttcggggggtatcacgtaaggtcatattggaattgctgttcctgatgtatacagtgcttgtaaaaggtttgaagaactgggagtcaaatttgtgaagaaacctgatgatggtgagtctactacttactgtgttcaggcctgtctttagttgatatttactaaccacctacagaggccactgttgtagtaaaacccttttggctacaagtaacagaagtctccacttcaaccagagttttaaaaaagagaaatgattggaagaatatctgggtattttagggaactgaaagacagcaactagggtggctttccaaggcactagacacaggacctggacagccatcaaaaccctacgcttcctctcccactgcccgaccccaccactttctttcattggccaccagctttcactatttcagtgtatatctttccgcccaaaaataagttccttaaagtccattttatctgatgctcatataatgacaccagctctctttagtttataatcacatggtatttctttttcatcttttataacctttgtatgtccttaagttttaggtaggttttttgaaatagcctacgtatggattttgctgggtttacatgtattgttattattttacttagatctctttctgaactatttcaaattaaaattgaaatattaaatatttcagagtctcaatctaaacatttgaaatatttcactgtttaatttcaatccttttttaaaaaaattaaaatacttaatatccagtgctgggcgtggtggctcacacctgtcatcccaacactttgggaggccaaggcgggcggatcacgaggtcaggagatccagaccatctgggctaacatggtgaaaccctgtctctaccaaaaatagaaaaaattagccaggcatggtggtgggcgcctatagtccgcctactcaggaggctgaggcaggagaattgcttgaacctgggaggtggaggttgcagtgagccaagatcgcaccactgcactccagcctgggcgacagagtgagactccgtcacaaaaatatatatatatttaatatccaaatcttctccccaataagaaaggaatttgcttcactccgtcctcattgtgtcactattacctagagtgggatagtattgattttattttttaaagataataataaatatatcacggtgtttgatcactttttcttcatatatctcttgtagtgtctcctttgagacaggatctcactctcatccaggctggggtgctgcaatggcactgtcatagctcactatagccttgaaactcctgggctcaaacaatcctctgcctcagcctcctcctaagtagctaggaccacaggcacatgccaccacacccagctaattgttttatttttttgtagagatgagttcctgctatgttgcccaggtttgtctcaaactcctgagctcaagcgattctttcaccttggcctcccaaagcactgggattacaggcgtgagccactatgcccagcctttttagcatcttttggatttttctgttcttttatttaaatacctcaaccaaaatggtctttaaaggggttttgtttttgttttttgagacggagtttcgctcttgttgcccaggttggagtgcaatggcacggtcttggctcaccgcaacctctgcctcctgggttcaagtgattctcttgcctcagcctcccgagtagctgggattacaggcatgcgccaccgtgcctggctaattttgtatttttagtagagacggggtttctccatgttggtcaggctggtctcaaaatcccaacctcaggtgatccgcctgcctcagcctcccaaagtgctgggattacagctatgagccaccgcacccagccctttaaagggtttttaaggcaaaacttttgagattctgtgtaactgaggatgatgcctttatgtctgaaggacagttttatggaaaagcctaggtttaatttccttcagtcttgaaaatactcttctattttctttttgcatatgatgttgctgttgaaaaatctgtcaattcatgttcctttgtatattcttctgttttattctagaagctttttatattatttctttgtcactgcctgcattctgggagatttcctcaaactggaataccaattagctaattttctcccaaatgtatctgttctgatatttaattcatctattttgttcttaaacacctgttataattttgatctctaattttcgcttagtttgcttaatatgttcttgttctttttttcatattggtaatatttcatattgtttattacttttttttttttttgagacagagtcttgctctgttgcccaggctagagtgcagtggtgtgatcatagctcactgcaacctcaaactcctgggatcaaacaataatccacctcagcctcctgagtagctgggactacaggcaaatgccaccatgtatggctaattttttattttttgtagagacagggtcttactatgtatctcaggctggtctcaaactcctggcctcaagtgatccttctgcctcagcctcccaaagtattgggattacagatgtgaaccaccacacccggccggtcattacttttacatgtctaaatagtccttgggtctgggcatggtggctcatgcctgtaattgcagcactttgggaggccgaggcagaggattgggaggttcgggaggatcacttgaggccagcagttcaaggctgcagtgagctatgattgtgccattgcattccagcctgggtgacataggaagaccttgtttctacaaaaaggtttttttttaaattatctgggcatggtggcacatgcctgtagtctgtatgcctagctactcgggaggctgaggtgggaggattgcttgggcccaggagttggaggctgcagtgagctatgatccactgtacttcatttcagtataaacgacagagcaagaccctgtctccagaaaaaaaacaaaaatagctcttggtccattattctaatatttcttctgtttgaatctacagtccattgctttgggggtgttttatggttatgtttctcaaattattattttttgcctctgagcttttttcccctgcaactgttcgctattctaacacatcaagcagtgtgaataggagaatggccagatccctgtccttaacaacccacatgatctcaggacaatgggctggataagcctaggccagagattcctaggcacctagaaatgagacttaaatttatttcaccttccacaaaacacctcttcaggttggatcttcccacttcatccctcagggaagagtattagtaggagacacttccgatagtgttattccctagccctgggcgtggagagagggctggggagatcattcggccctaccagtttttctcagtttctcacaagcacaaggctcctgcactgcccttgtttactggtaaggacatctgaacaagtgagagggcaggtgccgatgcacacagcagtgagggaggagcaagagcaaaactctgttctctcgcagccattatgcactgccttctggtccaggccagaactaccacctcccacacagcccaagttaaaacagtcacccggccccatcctcacccattctccccagctgtcactagccgggtttctttctttctttccttttcttttcttttcttttccttttcttttccttccttccttccttctttccttccttccttccttcctctctctccctccctccttccttccttctctctttctctctttttctttctctttctctttctctctttctttctttttcctgcattttccatctatgttcctctaggattgatcttggagaaaggaggcagagataagagtcaaaccaattcaacataatggtccccaaataaatttctgaggtcatatttttccatttaagcaaacagctctgacatactagactctcaatctcagttttgaattcctgggagaaagactctcgcagagcttgggttgcctaggatagtatttaaaagggtttgtatgacccaagcatctgggtcttttggttgtgggggtaagccatgctaccagctcccttcagcacctccctattttctttttcttctttaaaataagacaatttctgtaactactgaactggtagtgtggtatcatgaaggtgaggcaaatgcctgatacctaaaagatgcagccagtcccacagtttatttcaggagggctggtatttgcaatgtgtgcaagataacattttagtcattatgaaaagtatgacttttcatacttttctgacaataagaatttttaaaatttaaaactgtaaacaaaataatgtacttcattaaaatgcaaagtaaatctttaattaataaaagtttttaaggccaggtgcagtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatggtgttttcttttttagtcttttcaataatgaaaattttcattttacaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataagactatgtttaatttgtaaacctttgtccatcatgttctttctttaaaaaaaaaaaaaaacaactccccttagtgagtactgaaaggatttgaaaaggcttgtaggctcattctgaagagagaacaattgtgattctgtacagcccgtaaagcaggtagtgtctatggataagggagtgtgggaaaggtgggaagaagaaagtgaatacggaataaaggattgtggtagataaagtgcaaacagaagaatatcaaaaggtaaggaacttatgaagaccaatttcacatgttgagtgctagaactgacaaacgggagggctaatacattcacaaattcagtaatttaagctttatttccaaggaaagaagccttctccacttgctgagtaaaacttgccaaaagatagcccttgctcattctttaaattcattcctatatgcattttttttaaatgtacagttggcccttgaacaacataggtttgaactccactggtttatttatacagggatttttttcaagcaaatgtgggttgaaaatacagtacaaagggggctgacttttcatatgccaactgtgggacttaagtatgcacagattttggtatccatgggcagtcctggaaccaatcctccacatacaccgagggacaactgtatatggtaacactacgccttgttagggaaaagaacaattcacttccaaattcacttacctgagaagttgtacgaaagtacaaagtaggtcacaagaagtaagttttcttattttccatgatcatggtcaatgtaaaacaagtcagtctcctatgagccctacatagctaaggctagaatgattataatacaggtggtttgaatgaagagcagatggctgaaagggaatcacttgaggctttcccacacagtattttgaccatgattgcatagagtgtgtcttagttgaggcaattttaataaaaataccatagaccgggtggcttaaacaacaaacatttatgtctcacagttctggaggctgggaagtcccaagatcaaggcaccagcagatccagtgtctggtgaggacccacttcctgacttgtagacaggcaccttctcactgtgttctcacacatccaagataaatcatctcttaaaagggcactaattccattcatgagggttctaccctcatgacattacctcccaaaggccccacctccgaataccatcacactgaaaattaggcttaaacatatgtatggaagggagccgcaggacacaaacattcagtccatagtacagtatatataaataatcctcagccatccaactgattatgaagagtgttagtaaggatgcttgctattggcaataagaaaaaaagccagcacttaagagattgtaaaatggattggttgaccaggcgcagtggctcacgcctgttatcccagcactttgggaggctgaggcaggtggatcacttgatgtcaggagtttgagaccagcctgaccagcaagatgaaaccctgtctctactgaaaatacaaaatttgccaggcatggtggtgggcacttgtaatcccagctgcttgggaggctgaggcaggataatcacttgaacctggggggtgagctgagatcacgccattgtactccagcctgggcaacaagagcgaaacttcgtctcaaaaataataataaaatgggttggtagagggttcagagataacaagaaccccagattatttccatctttcccatcctgtcatttttagcattttttctcactggaccaataatatgatcaaagatgcctaccatgattctaggtatcatgtgtagaccaacaatgttgataggatttggctgtgttcccacccaaatctcaccttgaattgaagttcccataatccccacatgtcattggaaggacccagtgggaggtaattgaatcatgggtgtggtttcccccatgctattctcgtgatagtgagttctcacgggatctgatggttt

SEQ ID NO: 12620 - DNA, 146428 bp, Human
  misc_feature (1)...(146428): n = A,T,C or G
ggagttggaggttgcagtgagctgattgcgctatgatcgtgccactgcactctagcatgggtgacagagatcccgtctcaaaaaaaaaaaaaaaaaagacaagagttgttacagaaatctttccatcatcctaagaaagagtacattaaaagggctgtgccatcactggagaaacttccagttcctcctctctgttcacatgcatagagagcctgcagcttcccctcagtcactggctcacctgagatttctgcagggatggtttcgttgaaaatgaggctgtgtgtataaaatgcctgcaacatagccagtagctagccagtaattttctgctacaattaaaaacacacaatacaaaatgtaccaaaaatatgaatcaagaaagcttgataagaggttttccaatcatatttgtctcagacagtactgcagaataatatggaaattctgaagtaacaaaagggaataaaaagttgaactcagttttgttatacttttgcataaggggttccttacatgtacctcaaaagcagggacttgcgaggaggctgcaggctgtgtgatggctgtgctcagctaggcacctttccatcatctcaaatccgagaaagaaactcaaaaagcctaagaatctcgtttcagtacaagcttatgcctcagggacaatcactgtcggtttcacatgcagacaatagtgagtgaatgcaaagaaatggtactttcctacctgcatttaaaaaaagaaagaaagtaaatctactccccctccttttttgggaacatggactggcccattgtggttgctggtgtgttgaactagtaagtaaagcgaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggtgacctatgtcctttgctttgcgtggcagatgtgagatttctggcttccttcgtgaggtcggaggccgctcggatcctccaaatgtggtggctggatgctggcgacagaagtcacttttattgccctgacatacatttatgtaaactttttgttttcctgatgatacaaaagaaacgacaggagcttttgttcatcgatacagaactagactgaagggcaggaaaggctggttatttatttcactgagaagtgtagtgcgttgaccttttaaacaaggcttatgtttttttaggctgctacccgcaagattgaaaggagactgtggttttcagactttggggttgttttgttttgtctgtggtttgtagagctctgtgaaatttacatttgagtcctgtttgggggatttggtggtggaagtggcacgtgggaatgagtagatttagctattactgtaaattatgagatttttttttctttaagaaatacccaataaatgaaaataaggaaacaaaatgtttagatgttattcatgttttattgcggctctaggttgaaagagcttgacaattgcctctctttccacctttgaaatgcagtaaaagaaatctagagattctggcctttatattgaaaatagttttcctaaaaacccagttattaatcgaatcatactgtaaagactttttttggggggaaagtgttttaaaatgtgctatactagcatgaaagaagaaatgggaccagaaagttatttcatctgtgaaaaaaatagatttatgatgttggaaaagaaaaaaagaaaacgtgagtttggccataagccagcaggagtgtggtcgctatagcagcttcatttgtcacttagctgagattggagacttaaaagaaaactgagcctgtttttctctcagacagcctcataaggaatgttaagaggatgtgaagttatttagattaccaaaacaggttctgacaagtaagtgaaaataactcattaaaatataattgttgccattctataaatggatcaaaaggcttgttgagtcactgcatacttatagaataggtgaatttgccacggctcattggtataaattacttttgagaaggctttttaagactaagcgtgaggccttgccaagcatcccttataacacttagaatgttttgaccaatgttttcgaggcggttgcctaagcattttcatgtgtcagtgagtctaatcctcgcatcagtggcttatccagtaagctcagggaatattatatcctgacaacagaagcctgcagatttttctcttcaactaaacaatagctcacctaaaaggacagaaagtgaactactcagttcttgtaacctgactttctggagggatggtcatgattttggctcctgtagaacagggtttctcaacctcagcattattgacattttggatgggattatagtttgttgcaggggactgtctatgggatgtctagtagcatccttgatctctacacaccaggcgacagtagcactccctccccagctgtgagaaccagagatatcttcagacactgttaaatattccctgtgggcaaaatgcccctggttgggaatcactgctagagggaaacctgtcttggggcctactgctgccaacgagggggaagggtctatgagaggaggctggagtcccagggaggcctggcggggtccaaggaacagtggcaggacaggtgtttttgcctgaccatttggtttttattttgtttgggttttgtctgaaatcacatcttgggaatggggtatcagattcaaggacttgctgcggatatacattcttctgcccccttttccttctgtgcccttgtgggacttattttatacagtgctatgattggtatagtagtcaaacttctttcaattgaattctaaagtgcattctggggatatactattttgtctttttttaaaaagaagcttatacagtgatccattttataaagcaaatagttacccatacttttcccttctgtaaatatagatttttttgttgttgttgttgtttgtttgtttgtaatgtgggtttttagtaaatctggccatgcctgttagtttttttttcttctagaatctgcaagtgaatgctttcatttcttttttcttttcgccgtctgtaccagtgggtctcaaactgctttgatttttttaggaattgggccttgttttgtgagtgcaattgaagaatcacagcttttttccaatttacagataacgatgaagtcaatggctgggattttttccgtttaaaatttttcttacacctttagcattaatgctactgcttgtttgctctcaaaggtttacagattacaaaatgcatgaagctgcgagtgctgctttttcttggtgtttctccaagaatatagtacattgcactgagcaccgtgacttccaggagctaccaccaccacccaaaccagatgagatgtaccactgcatagtgcttagtggtgcttagcattggctgaacagatagggaaacaccttgacttattgaagtctattcttggtgacagacctggactggcccataatgttatcagagagctgtggtttctgcttttgattgcaaagcaaatcttgcatttatctccacctggaggtaccaatgtgacacacaccatgtgctctctaagtaacagttcttcgtaattaaaattcaccctctccccccattcagtagaccaaagatccctgagtgcagcaaatgtgagcattttaggtctatttgcccccaggatatagcacagtgcctgctcatactatttgctcagtcattgatgaacagacaaatgaatgtcaatgatttctatggaaagaccacccaggagcttggtcagcaagccacatgtctgcagcctgtgtccatatttctgtaattttttaaagaggacaaatccagtcaccatctaagcaggttttaatgtctgaggggctaccagaaaactctttgaaggatgcaggaagagtgggtctgtgggttgtagaatttgggccttcataaggcccagaaattaaatttctgctcttattataaaccccacaggttaatgcttcttcatggtttcaataagataaagagcacactaaccatagggtctgacccaaaggcaaggtatttaccacctctttaagaaaactcgccagttgaaagagcttatgatcagaggtgaaaaaacggcccttgttgatctatgtgtcctgtggggagtcaggtggtgctgcccagagaacctacctggttctctgaaccaggttatcagggcaaggggggtgcagatggggcagatgtcttgaaattggaagtttccagactgtgcagaatgtaaagatgccgtagtgagagacagagaagccaaagatcctctcaatctcttgctttggttcacaaaccaaccccagctccatggatttttttgttttgttttgttttttgagatggagtcttgctctgtcacccaggctggagtgcagtggtgcaatcttggctcactgcaacctccacctcctgggttcaagcgattctcctgcctcaccctccgagtaactgggattacaggtgtgtgccaccatgcccggctaattttttgtgtttttagtagagatggggtttcaccatgttggctaggctggtcttcaactcctgacctcaagtgatccacccgcttcagcctcccaaagtgctgggattacaggcgtgagccaccgcacctggcctagctacatgcttctaagcagagccctgggaatgagcaagcgtgagcctttcttgtaccttaagctgcagaggcttaaggtgcagcctttgacgggaggggaccttcatcaaagaggaaacaaaccctgctgctttattattcgccaagcctggaatgtttttagcaaatacgtgtttgtgtccttctcagcattgctggttcacactgaggccatttgttgctcataaacactagatgaagcaaaaatacttgtttacacttaagactgcttttatctttccttactgctgaatagtaattttttactagattgtcttggttctgtgcagctggttccttatgtctgtgctcatatccgtataccttgtccaaataaacatacttgaaaacatagagaattgtgttttgtgaagtttagaacatcctctaacagagtttaagctgagctttctgctttgttttggcaacttgtttaggatgccaaatgtatctggtctggcaacagatgaaagaagatgttggcccttatataacgaagtttagggaataagtggggggtggggtggattgccaggtttcctttgtggtttgaaaagagttctaaagcatgaggaaaacatgtgttcgactgggtttttgttttgcctttaaaccttggaattttgaaaatctgttgaaatatcttctcctggcttatgcagccctctgagattaagtttctgattacctacatcttccctcctctttcattccagccctgctagccttctttctgcccctcaagcacagacactgtccatctctgggctttcactgctccctgagcctggcacattcttcctccagatcttggcttccttctcattattcaacctgcctcttttgacttggagaggtatcctctaatcacctagctaaagttgcttccacctgcccaacccctaggccatcttctctcccctggttctgttttaggttcttcatggcactgttccccgactatctggaattcttatctgcttgtatccatgtctagtatctgtcactcattgcaagaatgtatgcttatgacaggtactatcatatccccgaaactaaaacatcatctgatagaaggttggtgcccaataagaggatgagtggatggatagaaggatggatgaatgggagggaaaaggagagggaaggaaggaaagaaggagcggggaaaggaggggggttgactaccgagtaaatttctactctcttttaagtctaagagcttctctcctgtgattcctctttgactccccaagacagtagccttggagaattttctccccacacccacctcactttgtacattacactaaccatcttatccagttacagtcacctgtttgctaagctctgcatactaagctcttgaggacaggaatgtgtaataaaggtggttatggttgtaattattgtttgttcttattgccttagcactttataagcatacttcatcaaagtcctttcatcaactctatggcttgagtatgactctcatctttgttttgcaagtaagtaaactgaggcccagagcagttgccgaaaggcgtacagatgattactgcagggccaggaattgaatacagatttcttcttggtagcgcagattatacagcctttctttcctcctcatcaggtgtccagtgcctgacccacaggttcatcacaggcttttgccaaatgaatgaaacctaagacctcacctcctcccttctcatccctattatttgagcttatacatattatttatactatttataaacataaacatgagcctatcagttcataatccagtgacatctctaaggataactagctgctgtatcttaagtcacttatttttattgtttttttagaaacagggtctcactctgttgtccagactggagcacagtggcacagtcataacttactgcagcctcaaactcctgggctccagagattccctgcctcagtctcctgagtcccgggactacaggtgcatgccatcatgcccagctaatttttttttattattattttttagagacagggtctcactgtgttgcccaggctgctctcttaactcctggcctcaagtggtcctcctgccttggcctcctgaagtgctgggattacaggcatgaagcaccacacccagcctacgtcatttttctttctttcttttttttctttttttaaccgataggacgtcattgattgcttaaaccctctcattcttcttatgtaaacaaatctattagtcaaaagttaagcagctgctgagtcacatggcactttaatccagggttacaattggcagccctgggaatgagttctcctttttttagctcccacgatggcactgatttcccctagaatatgaaacttacaccaaggaaaccaccatgacaactgtaggtagcaatttcaagcagaaaagactaggaaaatgcctaagaattttaaacctgacagagttcttctacatttttaatataaccaagtgctgttcatcacctgccttgacaccggtgtttgtgaggttgattggccccaggatgttccactgcagaacagaaggccaagatcagaagcccttgtcgacatataaatgtaatgctgtaagctggcttggagctgtgactccatggagccaattctaaaatgattaagacttctgtctatagagagttgaggtggagactgtttactatggccctgcccagaggcttcagcagctgagggtgtaccctctgcagtgggagtcttcaggcatgagcctgaagcctgtgctggcctctagggatggagtcccttgttgtcttacagcttgaattttccagcacaggacaactccagatgacagctccaacagggcagaggctgcagccttgccagactggtccgtcaaagctttccttggcacataatccagtttcacccaggtttgggggtaacccagctggttccttttttcctgggttggtggtgagctaagcagggaggtagtacccacaggttatttatggatgtcaaaaactcaaaaggccctcagcactgggggtaggaccagtgagaagtgctcaaccatggcatgtatgagggatctgtgggcgaaccctgatgtgtcatttggctcctctatccatcacaaagagcagggacccctgaaccctttaaccatccctgagcaagattggagggatttttgcccttttaatacaacttcttaaatggcctgatggccttggatgtactcattaataaatatgtcttgtggtttgcaatttaactgtctgtgtgatgaggatattggaaaggagtttctgactgattcattgttcacacttgcctctcccagccgagggataattggggccttgcctaatctgcactcgctcacacccaacatgtgctgggcggggaaaaaaggctgcaacctggccggctggttcccggacctggccttgcaccaaccaggaagatctcttctctacctccttttctgtgttcaaggtgatacctgcttaggactcccagaaatatcattagcaggaaagttccacagatttaatctagtctaaccctctgagagttgaggacactgagacccagaaaacctgagtgattttcctaggaacacacagcccattggttagtaaggcaaaagtagacctcagagcagctcagtgcttctctatcccctctgcacctcccccaggctgcctcttgaactacttctctgcttgctgtacaaaccaaagctatctttcaaagtcttttggaatattaaagccattacagggaggcagggtgtgtggggattgagtagatattcaaaagatttttgctcaaacctttatttcactttgtttttaaacaacttccctttcccatgcctatggagcttttcttgtctcatcctaaaaactcccaagttcccacctgcttctaggaagattgttgatgattgtccaggcatcccctgccactgtctgagcagacaacttctaaaagtttttttttttaagtagtgtgagctcatcgtaaataaataaatgaataactgagtaagtacacttgtttgtacttctctgaatcacatgtaatgggccagatagtacatattttcagccttgtggactatgctgtctctgtctcagctacgtatgggctaaagcagacctagagactatgtaaatgaacagacatggttctgttccaataaagccttatttacaaaaaacaggtagtgggccaggtttnnnnnnnnnnnnnnnnnnnnaagtgtacttattcagttatttatttacaataagctcacattactttaaaaaaacccactcccagaggtagctattgttgagagttgggtctatagtgtcactggcatgcagatacttacaaatacggggttggatcatgtaaattttttcatataggatgtagagttctgtatcttgctttgctcctgtttcttgcacatagatacctgtgggagggcatgtattcttttatacaaataggaccgttttatgcatgttgttctacaatttccttcacttggcagtaactcagtgttgatgcttataggatgatgacattctttttaatgaccacatagtggtaaaatcctttaccatacactaagaaaacatgacaaataccaaaaaaaaaaagtatgtgtgtaaataactaccagcagacacagatgatgtcttgttcgtctcacatggtcccatgtgtctggtgggcacatccacggggatccatgtcagcccgtgcagcgttactatgtttccaaagggggttttgtttcagcctaactttctgccagcacagcaccacatacaggtgacgagctaataaaagatttgcatgacgaggaaggtttcagacaaactttagcttcaacattgtggttgattatgaggcaatttctgtgaaatcctaaaaatcccaagttttttgtcctgctgtgaacacagtttatcgcaaaaaagtacagacccacattgtactgtggcccccctccccgccctttaaagtatgcgctgtcgttgatgccttgaattcgttcctaaggatatcatagatcaccacaaacttggcagctcaaacatgacagaaatgtattctgtcacatttctggaggcctgaagtttgaaatcaaagtgttgtcggtgtggagtgggggttcttctgggggctctgctggagggtctgcttcatcctgtcccctggcttccagtgctgcagcatccttggtgctgcgtggcttggagctgcatcgctccagtctctgccttcatcttcatgtgggtccagcttgccctcttggtcagtttccttgtcttgtctggtcccgtcctgtcctgtattttgtaaagacttgtcattggattcagggcccacctgaatccaggatggccttctctcaacacccttaccttaattacatctgcaaagcaggttggacatatctttgggggaccacagttcaactcagcccatgccctcccatctaaaaatcggagtgcttgctcttccctctcaggtttttcctcctggaggtgaggaaaggggcaaaagccttgttcttgtcgtaatcaacagccctgctctttgaggataaaaagcaacaacaaaaaaaaacggagtcccaaggaatggcatctactattagttaatcgcaggtcccagaaaagcaccagccagaactgcaagtcttctaggaaatttcttactgaattcagcaaaataagaggctaatgagaagagtgtttgcatatctgatagtctaactgaaaggaaacagaggaagaaaaatgtgcttttgtaagccctgagagttttagctgaatggcagcctttccctgtgattaactggcattaattattgtttcaaagagtttccaaggttgactgaatccagtgtgaagctcacaaaaccaacaccatctatttgttttatttctcaggagaaagttatattaatgcaaaaataaagaattgtggctgggtttgtgatctgttttcaatagtttctttaaggaagcagctgttttttgtgttgcacagggtacttggatgcgaaacagtttttgttgttttggctttttttggagacagagtcttgctctgtcacccaggctggagtgcagtgatgcgatctcggctcactgcaacctctgtctccccagttcaagctgttctcctgcctcagcctccctagtagctgtgattacagccacacactaccatggttggctaatttttgtatttttagtagagacagggttttgccacgttgaccaggcttgtcttaaactcctggcctcaagtgatctgcctgccttggcctcccaaagtgctgggattacaggtgtgagccaccacacctggccgcaaaacattttttatgtttaaaattgatacctgctcacctcactcccttagacaatgtttaaaattgatacctgctcacctcactcccttagacaatgtttaaaattgataccttgctcacctcactcccttagacaatgtttaaaattgatacctgctcacctcactcccttagacaatggctttggtcgcaagggacagaaactcacctcaaaccagctgtattttggagccagcataacaaagcaccactacttggatgttttaaaaaagacaaatttaatttccaacagctctggaggctggtgaaatcaaggtgtgggtagagccatgtcctctctgagccggtagaggaagatttaccctggcctcttccagcttctggcctcttccagcttccttgcttatggcaacaaaacaccaacctctgcctctgtttttgcttagagttctccttgtctgtctccctccctcttctgttcttataaggacatcagtcatagtggattaacagcccaacctattccagtatgagctcattccaactaattaacatctgcaacaaccctatttccaaataaggtcacacgctgaggtattgggagttagggcttgaacatatctttttgggggacacaagtcaaccagtaacatcagctgaagcagaaaagaggctcacatagccaagccgctggaggggacagggccttagatgtcattagcatcccgtcagctctgtctgcttatctgtgtgtgtcattcacactcacgaactcactctgcatgaaaagcataaggctgcagctcagggattctcaaccatggtggaaagggctcttgtacccccagctcacatcctgaagtcccaggaagagattccatcggaatgtcacctctccagctctagaccattcactgtggccagggagagggtcacgggagggaatggcagcttccacatctggatttggggaaagatcccactgccgcacaccaaaagcagggtagccttgacatggccgctgcgggaattgtgagctcagggtagctggcccaatttgtgtgaatctcagaactaacctaattcgaatgcagcattgcagtcacgtgtcacttaaatgacccttgtcatgacttacctttaatgtgattttatgcacgcgctccttctcacccatcccctgctgcattgacctggactaaactgctttcaggttctgggagatctcctcagaagttgtgttagatttttcatttctctggaaggtcagtgcatttgcatttgggcagaaactcatggtgactatactaataatttaatctttagtctcaaaggacaccatggtgggtaggtctcaatgacaggcgcttttcctctcttttttagttttcaatctgaagcttttaaacttccaaaaagaatcacagtagtgtagaaatagtcttaacttctgctaaatggcctgtgggaggcctgcttcctgtactttgaataccttttcataggttttcatgcagtctgcaagaaaagacagttttatttcaactataaaaattaattcaggttgagagtggtggccacgcctgtaatcccaacactttgggagatcaaggcaggaggatcacttgagccgaggagcttgagaccagcctgggaaacatagggagaccctgtctctacaaaaaaaatttttttaaattagttgggtatggtggcacatgcatctgtagacccaactacttgggaggctgaggtgggaggatcactgagcccgggtggtcgagtctgcagtgagctgtgatcacgccactgcattccagcctgggcaacatagtgagaccctgtctcacaaaagcaataattcaaaggaatgactgcagaaattacaaaaacagctgataattcagaatgctcatttcactttattttttttttttttttgagacagagtctcgctctgtcacccagctggagtgcagtggtgcgatcttggctcaccgcaatctccggctcccctttccccctcccattcaagtgatccgcccaccttggccttccaaagtgttaggattacaggcgtgagccactgcacccggcctcatttcacttaattatgtttgcttccagctagtatcggaaagcaacttttttattctgtgagtcttaggtgagcagcagtagagaaacttacctgagataactaatctgtagatcctaaaagtgatgcttgtggagcctgtaggacagatgcagttattccttgagtatagtcattgagtgatggtgtcatgtgaaaactttgcaggcttggatgatattttcaggagtatatgtatcttggaaatttgcagtatgacccaaacttggcacatcttaatagtcaataagaatttgcaggggcactaaatccttgctatctctctggcaaaagatagatttcttggtagtgttggcatcgacacctttcatggaaaaatcgattgcttgtatctactagctctgtgctagacaggaagcactaagaattcatttggtggttctttcattcctggcttatgagggataccctttgctcctacccgccaccaaggtgaattcaccttgaccctgagcataccagcacacagaccaagttgggctttgattgctggtcatttacaataggttagaaaggggtgagctgaagcatgtcgactagatgaaattgccacagtgtggtattaacctgctcaggataaattgagtgtgaaattgttactgccggatgttgcttgccagtggggtttctttttttttattttcttttatgtgataaatgtttttgcttgatttaagaggtggtagaatactggctgttactgaaatgaagctaatttcttcctgttctgagccattatagcatatcttgcggacatttgaaacacatttttctcctaagatagctgcatttctgaatgaagaactgatatgctttctttctaaattcatcacatttctttctaaattcatcacgtttatcagttaaatgtacaaggggtaagaaatgaattttcagcagattgttgtacctgaaaaattacacagaaaagtaactttaggtgagaaagtatctggtaagtttctcaaaggtttaggttttctgggtctggtttggtttggtttgctggggaaagggaggatggatggaggaggatggatggagagtacaggtgactgtcttcttgactatagtgtaagtgataggaaaaaactctcgagttttggtatataagtaataaaagcaaaattcggcttgcttgcttgctttctctctttctttctctctttctttccttccttccttccttccttccttccttccttccttccttccttccttccttctttccttccttccttccttccttccttctatctgatggagtctcactctgtcacccaggctggaatgcagtggcacgatctcggctcaccgcaacctccacttcctgggttcaagcgattctcctgcctcagcctcctgagtagctgggattctgggtgcacaccaccacacccagctaatttttgtatttgtaatagagacagggtttcatcatgttgcccaggctggtcttgaactcctgacctcaagtgatccgtcctcctcgggcctcctaaagtgctgggattacaggcgtgagccaccacacctggcctggattctgctatccttctaatcccaatttacaagttatatcttccgtgaagtcctgcctgaccccttgaattatagttagacattgtcccttcctctggattcagaagcaggatctttcactcaatgaatgtctattgtccacttactatttgcacacttcgagaatgcaaagatgaataaggttcctacgtaaagccttttggcttctctgcagactggtccccagaggaatcagcatgtcacgagtgaataagaggtactccgtgagtgcacattgcattggattgtaacacattttctttccccagttcgctaatttcagccctttttacgcacaggaaaaaaacatccttttgtttgggctcctgtctttaatagacccattacttttggaataagcagcttccccccaggaaagttcacctgagtcatcttgtgctcagcacgactggcctgcagcaaggaagtggtaccaagcagctttactgtcctaattggacagaaggaaattgacttgtcttggatggggattatccaggtctttctgctccaggaagacactgagagagcatctgtccacctgagattgtttgttgatgagaaagtgatgccaccgtgttcaagtttgagggaactgcagagcaagaccttctgggtccacaggaaagagaggtctttaaacttaatgatgctccgaacagctggaaggggaaactggagaatatggacagttggcttttctgctgagagttgagactagtctctacagatgacctgtttgatgcaaactgaaagaattagaacaagtctttgccaaaatatacactgggaacaaaatgataggaaatgggacttttctagaaagacatgagaaggggccaggtgtggtggctcacgcctgtaatcccagcacttagggaggctgaggcgggtggatcacttgaggtcaggagtttgagacagcctggccaacatgatgaaactctgtctctactgaaaatacaaaaattagctgggtgtggtggtgcatgcctgtagtcccagctactcaggaggctgaggcatgagaatcacttgaacctaggaggtggaggttgcagtgagccgacactgcaccactgcactccagcctgggtgacagagcaagactctgtctcaaaaaaaaatttttttaaagaggtgagaagggtataaaaaaaattaaaatgaaaaacattgcttagaatagaataaaatctcgtggattcagcaatacatcttgctcttaaatatttgttctgccattgttctgtgacgttagaattttcctcagtgataaacttacattttttgtatactagtttgaggtataattgattctataaacaagaatttaacatttcattcttgtactatgttaactgattatataattatacttataatgtgcgattataaaaagacaacccctaccttaatggaacttaaactttagtggaagacttcaaagatattgataagttcaaggcactaccttaacagaataaataaatgctgtaggagcacagaggagggagggaacacactcagctaagactgaaaagaccctgtggcagggcacaatggctcaggcctgtaatcccagcactttgggagactgaggcgggtgatcccttgagcccaggagtttgagaccagcctgggcaacatggtgaaaccccatctctaataaaaatacaaaaagttagctgggaatggtggtgcatgcctatagtcccagctactcaagagactaagatgggaggatcacctgagcccaggaagtcaaggctacagtgaaccaagatcgcatcactgcattccaccctgggtaatgggagtgagaccttgtctcaaaaaaaaaaataataaaataaaataaaaataaaatccctagagaaggtagcagtagaagcttggagcattggtattttgttatatgaaatagactattttatacaaaaaaatacctaatatgtgttcaacgcccattagactctggaaatacaaaaaatgaatgagacaatgtccttgttcccaagaaattaaagtctagtggggaaaaatctgctaggtagccagcagttataattcattgcattatataaatggcatgtgctttatatgaatatataaatgtatattcaagtcaagaaatacatgcaaatcaaagaaaatgcctaagtccaggggagctggagaaggctcatttcagtctagaagttttcaacctgggctacaccttgcaatcactttctctagaggggccccaggcaactatacttttttaaaactaccctgttgattctaatgcacagagaagtttgagagtagcttctctcaggaaatttaagatgtgggaaggtataggcagtgatatggtttggctgtgtccccacccaaatctcatcttgaattgtagctcccataattcccacatgtcatgggagggacctggtggaaggtagttgaatcatgggggtgggtcttttccatgctgttctcgtggtagtgaataagtctcacaaaatctgatggttttataaatgggagttcccctgcacaagttctcttgctggccgccatgtaagacgtccctttgctctttcttcatcttccgccatgattgtgaggcctccccgtgtcagccatgtggaactgtgagtccattcaacctctttcctttataaatgacctagtctcagctatgtctttattggcagtgtgagaacggactaatacaggcaggttaacatatttgaggctgacgcagagcccacatggccaaggcatggatgagggtgtggataccaggtaggcaatgaaactggacaggtagattgagaccagactgcagagggtattgaatgccaaggttagaaaacttaacttttttcagtaggcaatgggaagacattcaggtctttttatccagagtattgtgatctacatcatatttaataaaaattagcctggtgttcagaatgcacatctttgggagggagggagaggaagaggttgtggcttgtggtccaagtgaggccccgaggcagaggaacctcaaaggattgggaagaacagcacgggaggaaggataataagagcctggagaccgactggtgggacaaggggagcaaagagctccttggttgcctcaacaaataccgcctgagccctgactgcttgaagacacgaatggccacaaagaccagggtccagtaccttggaggctgctggcgcctcaccctgactcgtcctgggagtcctttctcacaccgcactctccatgctgcttcctcaccagcacttgactgtatcaagcagtttgccctccttatgtgaccctggttgtcatagcctgggtagctccagggtgtgcggtttagagttgtcttttcctcctgctctcctgagctgctctccgcattctccatacgaatttattctcattctaaatttcccagtcattaaagacaactatgtgcctctctttgctcatctgtaacatggggatagtaatggtaacttgatgttcctatctcatgatctgttgtgagtatccagtgaggagagatatgtgaaagtactttataaactgaaaagcatagcacagatactgactgttgctatcttcatctgtttgtagaactttcaattaaatacaacagtttagggctcagggacaaagtttaatcactgtgtggtgaccactctgtcaatgcagtattttcctatataaggcttgtttaattcacagtaactgccaatgaagatgtcctaaaccattcccattttactctttcttatttttaaaaatatttttgtgggaacgtaaagtcaaggtctcactttgttgcccaggctggaatgcagtggagagatcatggctcattgcagccttgaactcctgggctcaagcaatcctcctgagtagccaggactgcaagtgcgcaaccacacatggctaatattttgaaattactttttatagtgacagggctttgctgtgttgcccaggctggtgtccagctcctggcctcaagcaatcatcctgcctcgacctcccaagttgttgggattacaggcatgagccattgcatctggccaatattttttatcttttttcaggaaaatagaattttggagctagaatgtatcttaaaggtcctttaatgtaaccatctcctcctgcaaataaggcgcctgagaaatggagatattaacccagcccaaggtttcacaagttaggacccaggtttcctgacttcatcctagggctctttgacctggaaagttcttcctttatcactggggccatctcctaaacagggtaaatttgtgatacgtttgtcccactcaggtagaaaaaaaattttgtaatgtcatgaaatgcaacaaagcctggtatttcaattgaatgcccttaaggctcagtaaagggtttctgagtccagactgctgagcaacggggatggaagcctggcccaagaggtaccccagcatttctttgcagagcagctgctttggctgggaagctgggcttttctttctttctgttgtcagaggaaccagctaacttagactaaggtcagcagactttgccttggagtacctggatgcctttactccagaactcaggggggtctgctgccttgagggacaacacagacttttcatcagcctaggttgcacagcctaacacttggagggtcaccccaacagccatgtgactgtacacagtggaacccacagttcacaaatcacctgttgatataagtgggttgggctgtctcccttgagtctcagtgtccagccatggcacggtccctagatctcctctaacaggccctcctgtcacctgactgtgactggcgcctggtacagcaggtgtggctggcagggtgcccgtttgcacagcactccctgcttatcctggctcaggtctctgaggcctgccctttcagaagaatccagacgacttggggcagggcaggcacccacccagcatgtagaggtctggaatgtgaattgtgtgtctctttctttgtgggatacagaaattctttggttgtcatccaaaggtgtaagccttgccttaaaaatattctcatttggggcattgccaagcctgggggtcctgaattctttcatatgtcttcgttccttcttcagatttatttttcagtcggttttttgcttccttttcatgattggaaccactactcaatgattgttagatacaccactcctcactgttcccagtgaaatcacagaatttgtgctaggtaaattccaggctggaaggcatagttgtttattaaaggagatgaagtccagccacaataggagaggaaatcagacaaggatgtttttaaaagcaagctgtgtttttctgactgctccaatattcattcccaccctgaaggctcctctaaccctggggaagaaaaaatatttttagtctgatagtgtactatagagctgaaccatctgtaaaacagtcttgataactcagaggaatggttttagtggaaataacttgtaaaggatcacccaagactccaaagctaaggcatcaactacccacagagcaccggttcctacccagctcccatgaagtcctttaagatttattttagaaccattgcagccaaaccagaaattgacaagtgggacttaattaaattaaagagcttctgcacagcaaaagaaactatcgacagagtaaacagacaagctacacaatgggagaaaatattcacaaattgtatatctggcaaaggtctaatatccagaatctgtaagaaacttaaacaattaaaaaataaataaccctatttaaaactgggcagatacttctcaaaagaagccaatttgcagccaacaaatatatgaaaaaatgctcatcatcactaatcattagagaaatgcaaatggaaaccacactgagataccgtctcacactagtcagaatggctattattaaaaagccagaaaacagatgttggtgaagttgaggagaaaagggaacgcttatacactgctggtgggagtataaattagctcagccactgtagaaagcagcatgtagattccttaaagaacttaaaacagagctaccatttgacccagcaatcccactactgggtatatacccaaagaaaaataaatcattctatcaaaaagacacatgcacttgtatgttctttgcagcactgttcacaatagcaaagacatgcagtcaacctaggtgcccattcatggtggactggataaagaaaatgtggtatctatacaccatggaatactacacagccaaaaacggaacaaaatcatgtccttcgcaacaacatggatgctgctggaggctgttatcctaggtgaactaatacaggaacagaaaaatacctcgtgttctcacttatgagcaggagctaaacattgaatacacatggacacaaaggtgggaacagtagacattagggactactggaggggagatggtgacaggggaagtgggttgaaaaactacccatcagttactatgcttactacctgggtgatgggatcattcatacaccagacctcagcaacatgcaatttacctatgtgacaaacctgcacatgtaccccttggacctaaaataaaagtcaagagaaaacaagacctttttaagaatagaaatactgaggaaggaaataagagcagggtgggatgggaaaatatttataattcatgggggaaggagagctatcacagagctggaatgtactttagagatagcaatatggtgacgaaaagcagttgacaaactagaatcccactgaattgggatcagccatttgctgcatactgtaaaacaagtttaaacatttttaacttaaaaagcctggcttctgaatgcttattgcaacttacaaagtcatgactaagatattaaataaagggcacttgttatgttatctgatactgccctattccttcccaccaaatgcacttaattgtactatttggcaactaggagatgtgtattgagaactgattccctcagagcagctggcatgggagcgattctttggattgctgttattgtgcattcctgactccaacatgctattgtgttggaaaggaggccaggaatgaggtcatgagtaagaagaaaccttaagtttttgcccttgcacaagagacaaaaattatccaattggagttagatttcaagagtgttgaacttgaaggcaaatatttatcttctggtgttaagaaaggaaaggatgtgaaacctttgaccttgagtgttagggcagtgtctgagtttggaaagcagttgtctgaagccagaagcatgatgaatttctcattgttccttccctggaactatgctaatattttttaccacacgctgagcagcaccagccgacttaatagcctgctcaatgtcacattccattggatttggggtctctccctctggggtccaacttcctgaagatacccctttagaattctaggtaagtgtttggaaagaaaatggcttagagtcatctggtgttttgcaacctacttcatcctctctccatgtcatatgactcaaagtgaatttataaagaattaacatttctcttatctacacagcaaccttgcaagctaggcagaaccactactttatacccttttaacattatggaacatgtagcttttcatggtctgaggatttttcagaaagtacatagcattggggcatataaacagctaagtccaggtatatccagtcatcctgaaagttcagtccagcctaacagattgatcagacctccccctttttatcattcttgatgtacatgcagaaactggggtagcccttataacacgtcaaaaatcaaacaaaccattgtttctggtcccagggaccagaatcgttttcctggccacattttcaaattatcatcacttaaagtgacttgctatttttcaagggatggccttaggaagatccactggatcttaccaggcggttagcttctgtattccctcatgataatttatggaaggaaaaaaagaatacttactttaaactgtccaaacgactaaagtaatttctagttcttctgagccttaacatgtagcaggatgttgggggagtggggaatggacttaggagaaaaccttagatttgaactctagctctgtaactttggagacttttcttagcccacagacaggcataagaataacaggcgcccaccaagtgttggatggattaaatgtgaacatactttctaaacattcaactacagaacaagtacaaagggtattgttaacaaaagtaattgataagggaagaaatatttaagctcaatcaggagaggaaaaagttgatcgtttggtaaccaccgccaaagtcctcaaacttctaaacccaatttttttgtgttttcagtgagccttggtcctgactagaagaagccaattttgaggcttcatgacaaacacttacagaaagttatccaactattgcaatgtcaacccttgcttgctaatatcaggtcaatttaggaattaaatatggaggttattcgcatgccatccatgtctctccatcagttcaaaggataccagcaacagaaggatgaagatgaaaggaggattgaaaattgttcagtggcactctggaggtcctagaataatggatacctgatgagattaaactgcacagcttttacttagagaccattttataaagatcattcacttcacagaggttagaaaaacactttgagaatccatttggcaaagtgctgttaatatgattcttcttacttaattcctttaaattcctcttggattaaaattgtaatacaaagcaaaaaccactttggaccatggtttggcagtagctactgaagcgaaacataaacatatcctatgaccttgccacatactctctattcccatgcatatatatgtatatatatacaactgaaatatgtatataatttaccaaaagacatgggcaggaattttcatagcaacactattcagtacagccaaaaccaattttttttcttttttttcggagacatctctttctgttccaggctggagggcggtggcatgatcacggctcactgcagccttgacctcccaggctcaagcaatcctctcacttcagcctaccaattagctgggactacaggcatgtaccattatgcctggctaatttttgtattttttatagagatggggttttaccgtgttacccaggccagtcttgaacttctgggctcaagcgatccacctgcctcggcctcccaaattgctgccaaggcatgaggcaccatgcccagaaaagcagccaaaatttttaagttacccaaatgcccatcaatagtagaatggataaataaaatctagtatatttccacaaaggaattgagatttagtgaagtatgactacacacactaacatggataattctcacaaagtgttgagtgaaagaagtcagacatatttgcttctattgatggaaactgaaaacaggcaaagctagcatgtggggttagaagtcaacatagtgattggaaggcatagtcatcattggaagaggacacaagggggtttcttagtgcagataatgttcttttcttttttaatttgggtgctggttatagagtatgttgcatttatgaaaacttatgaagctgtgcacttagaatttgtgcatttttctcaatgctatactgcaataaataattttacttaaaaatttggccaggtgggtggatcacttgaggccaggagctcgagaccagtctggcctacatggcaaagccccgtctctactaaaaatacaaaaattagacaggcatggtggcgcatacctgtaatcccagctgctcaggtggctgaggcactagaatcacttgaacctgggaggaggaggttgcagtgagccaagatcgcaccactgcactccaacctgggcaacagagtgaatctctgtctcaaaaaataaataaaataaaataaaataattaaaaaggcatacctctttccccctacaaagaaggtggggggaggtgtattgcagactttctacctaccttgtaagagagagttgatataacatgtaaaatttatggcttttttttgctggtgaagaaaagaaaaaactctatagaacaggatgtagcaagtgcaaaggaaatgcctggtcagggaacatcagattcagctaactcccaaggaaattcaacaccacatcctcaggtccctggttaccctccagactgtgttgtattcctgaataacttaccagaagagactaatgagaggatgatgtttcatgctatcatatcagttcccgctttcaacaaagtatgtttggtacctgggagacatgacattgctgttgttgaatttgaaaatgatggacaggccaaagctgtcagggatgctttgcaagaattcaggatcacagcatcccataccatgggggtcacctatgtcaataaataatactgagggatgaataggtggagcacagaggatttttagggcagtgaaactattccatatgatactataatgatggatacatgtcactataaatttgtctaaacccatagaatgtgcaataccaagagtgaacaccagtgtcaactatggacttggatgataatgatgtatcaatgtagattcataatttgtggcaaatgcaccactctgttgggggacgttcttagtgggggagactgtgtgtatgggagaagggatatatgagaactctctgcaggttccacccaatttttcagtgaacctaaaactgctctaacaaagtctgctaaattttaaaaaatacatttggaatagttgtctttaaagcacttggtgttgtttatagtggtactttgcttcgttttttgtaacttttgattaggccattttaatagttgggaatgggaagggtaaaattttcgttaaggacttacaacatgatctagtcgttagccttgccaaactgtgaaatatgaaggctcgattttatataataaacttttatttgtatcctttaaaaaagttgaaagaggatatataaagtcatgggagatctgctttgccagtgcagatcttgactagagccttcccaatattaactgagctcctgaggcctgggaaaacaacattggctctgttggacagtctctagagttggacagacctggattcagatcatagctccatcccttgctaactgagtagccttgggtgatttcctgatctctctaagttttgatttcctcatctgtgaaatgggcatattacctacctcacattgtggctgggagagtcaggtggggtaaagtttgtgaggtgcctatcatggtgtctggaaacaagcaaatactgaaactatagctgaggcacagaagaagttgatcttttactcatcttttggccaaagtaattgtatagggaatggttgcaaatctatttagaggtttctgttggcatattaattcactggacacttctagaacaccttcttgtgggaagcatggaggtgtagagttatgaagatacaggtgtggcccaattctttaagggaatttataacctagtgggaaagagaggaagaaagctcacctgctttgattggcaccagttactttgctaccaacttgcctttgtttatttaactttcataacaatcctacgtagtaggctcccttcccttcccttcccttcccttcccttcccttcccttcccttcccttcccttcctttcccttcctttcccttcccttctcttcctctttctcttttctccttctttcccccccctccttcctctctnnnnnnnnnnnnnnnnnnnnttcccttcccttcccttcctttcccttcctttcccttcccttctctttcttttttttttttttttttctttcgacacaaggtcttcctctgtcacctgggctggagtgcagtggtgcaatcatgtctcactgcagcctcaacctctgggctcaagtgatcctcccaccgcagcctccccagctgctgagactataggcaagtaccaccatgcccagctaatgtttgtgttgtttgtagagatggggtttctccatgttgcccaggctggtctcaaactcctgggctcaagtgatctgctggggttacaggcacaaaccatcgcactttggccatagtaggttttcttatactagtttttacaggtgaagaaatgagtccagaaaagtgcccaaagtccaattttcagtctagaatttaggccctgggttctcttgctcccaaagcccatgtctttctactctatgatgaaagttagagtataatggtttatttctccctaaactagtttatgcacccttactcagaaggataagctgctgacccttcctctgacatagcacacgtgtttaaagcagtgtttgtgagctcagaagcctcgcagttagtaaggctgtagggctacaggatgttctcatttgtgcagattggctttgcacagacttgtatagagccctctaggctttgtgaaagctgcctgggcagactgatttattcacctttgcccaggatacatatttacggccaaggcacgccctcattatcctgcctgttcatgatgctgcatcaggagaaaagcctcctggaacaggtgagtgtttagcttagagatcaagccagtccagttgcattggaagcctctcccagttgagggtgaaaaaaccagtagacgcaaaaaagctgagtcagcctctgcactgcctttctgcaggagcataacagggaacttgcgtgattctgcctctcccttccgcccatgcacctgccacgtaagcagcacatctctgttactccctttggcttcctcatctcttcatccaccctcaggtttgtggttttggtaccacccagaccagtgttttcccatctcatggtgatctgcatagactcatttcagtgcttataaaataaagacactcatatctgggtcccaccttaaggccatcgaacccatttttaaaaggcttcttgggtgttgcttatgcgcaataatgttagaaaactcctgatctaaagcaacccaccagcctctaggtgtttgtatatccttagtctgaaatcaccatccaccagagctgtgtttgggagagtcttagggactggaaaacaatttgcttattcctttggggattctaagcaccatctctgaatcaagttagatcttttaagataaaacaagaaacaaaactacacacatagtcctcgatagtttaacttcctctatggaagtgacttcatttagtgatctttcagtgctacgtctttggtatttctcaagggtctatatgagaaacaactacttaaatacttcctatcatcagtgaaattcctgtggaagatgtttttctgtcccataactgagggtccctgtatgagaattcctttggtgcttttaggaggtagtttaacagggttaacgtgtggaccttgagtcagctacctgggttctacccctagctctgtcttctggaagcactggtgggtttgggtaaaacaatttagtttccttgcttgtagaacaagactggaaaatagcaccgacctacctcatagggttgttgtgaatcatttaaagtcttgatacaaagccttacacaaagcaagaccttatagaacttcagcccacaatgactgttattaacttagaatcaggaaacctaccttctgtagtgacaagtgtgtgtggccattttttcaaacagtgagactttggcagcctatcagttcctcttttgccctcatctgctaagaagctcacatcacaacaaacatgtttgcctgagcttgggtcttttgaattttaaggttcttgatcaattgttttaaaatcatgtccttctctgataagaatcagccagtcctttttgaaagtaggcagaacataagttataagtggattaaggttgaccttcagggccatcttcccatctcctgggctcatgccacaagtagagcactcctagagaaatggaggcggtaaaggaaagaaactaaaagggactgtcagcagtccaggagctaagcaggttatcagatgagcagattttctgtccaaggatgggttctagaattacaattctctttttctgttcccaggagcatattacatgggctcagggcttagggcattagaatttctcctgggtaacagacacggaggaatcattggttaaactccatttttctgccatcaagaatgttctttctctaccaaaattgctcttctgttagcactactatgtgagcttgtagagggtatgggatttcacaccgaaacatagaattttacagctgaagaggacttgaaattgtctagcccggccctttgcatttttgagatgtgtgtcctgaggcttggagatgttaaatagtgacatatttgaggccctatggatggtaaattgaggtatgattctcagacttcctgattccaaagcttgtagccctttccctgtacctcatgtccacaaagaattcggaactcttttctgctcttccagacaaagggtttcataaaaaatgttgtgacttacactaaattttgcattagagtagatgttatttccccagaatcctggtttgtatgctaaagttcatacttcaatttagagattaactaaatagcaataataactacagatgtctgatttaaccagcactattaaaggcaaacaattttttgcacttcaaatgtgtaggcaggtactttgtaaaactcacctaaataagcaaattgtcagttgttcatagagtttcatgctagccacaatgtagtctttttataaaagcattttgaatatgtgaaaatgcagaaatggggacgtgatttttttttttttttttttttttttgagacagaatccggctctgttgcccaggctggagtgcagtggtgcgatctcggcttactgcaagctccgcctcccgggttcgcgccattctcctgcctcagcctcccaagtagctgggactataggcgcccgccaccaagcctggctaatatttaatattttttttagtagaaacggggtttcaccgtgttgaccaggatggtctcgatctcctgacctcgtgatctgcccgcctcggcctcccaaagtgttgggattacaggcatgagccaccgcgcccggccagaaatggggacgtgattttttttaaggagcagggtacaaagatagatggggaagagcagtgatggcgctctggtgagctctctagcagcaccgctggccactcaggctcaggcaggacggctgccagttatgtgcctggggccaggtatctggtaaaccaaccttcatgccgttgtctgccacaacaaagctcctgctgggctttaaaagtttatagtcaacagcatcctctctgcagtgaattgcaagcttattatctgtttcttatatgagcgctatttagtctttcattttgctcatgatctgaaatacttctccttctcctaaaaataactccaatttaaatgattttgattcagcaacatctgatttttggtaaatttgcatatgcactgccgtctgtgttcagctctgttacttttcctggccttgtgcacatggcttctctgtgaaccatcatgggtgcctatgtaaggagaaatgaaacagaagggtgtctcacacatgcgaaggagggcctcctttgtcttgagcatctgaccctggagcctctcaagcctgcactgctgcaaaaacagaacgactcctcaatgccttttgactctggctcaccgaatgtcttgacatgttcagcatcttgggatgaaggaaatacataggtcaagacatccctggcattacaatgggctagggttaggttttttagcagtgttttctttttatataattattttattttatttttaagttccatagtacatgtgcaggatgtgcaggtttgttacataggtaagcatgtgccatggtggtttgctgcacctggcaacccatcacctaggtattaagcccagcatgccttagctctttttcttaatgctcttcccccgccaccctcccccaacaggctccagtgtgtgttgttcccctccctgtgtccgtgtgttctcattgttcagctcccacttgtaagtgagaacatgcagtgtttggttttctgttcctgtgttagtttgctgaggataatggcttccagcttcatccatgtccctgcaaaggacatgatctcattcctttttatggctacatagtattccatggtgtatatgtagcagtgtttttactaatgatttatagagcgaagtcctgccacatggggccttgatgtaacttccattcatcttgtgagttgatagaactcttataagttgatgtaatttcccttcatcttgtgagttaatagaacacagtgactctcctatgcctgcccagggcatccagagagccttttactggcatccaaaccacactaatgtgccttctttttgtgaatgaccttgggactgtctctgagcagagagttattacattgttattcgtatcattattgttattactttgtgcaatgtgtcacaccattttcaaaatgtccttttggtcatcacaccagtatcattgtgaggtagttacagcagtgacatactgtatggttattagtggtggtactgggtaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacagcaacacaaaaatatatttttgttataaagggttgagcatgatatagctgcaaaggagaatgtgagggtcccttcctttacttcttcctgactctcacctcttgctccaaaggtaaccacagcaaactagttgtatattctcgctgtcttctctctaagaagggcacacatataagatcaatatacatatacatgtgtgtcctcgttgatgtaaataatcataagagtgtctgccttacaggattgatgagggggttgaagaaaattaggcttttaaagcacttaacatggtgccaggcaatatactaggttcctaatagtgctctcatcaactgcgtggggtaagttctattatttctacccattttattgatgtggaagctgaggattagagagattgtcacctgcacaagatcacacaatactgaaactggatttgaatccaatcagacttaccctagtgtctcaacagctttggccactagcttatgtggttattttataggcatgatttttccacttgattattttctcttggtaatattagcttgaactgtttccatgtgtgtacatatgagtttacatcagtcttgtaatggctacatgtgattcagtattgtaagtacttctttattggggttgttttctggttttgttgttgttgttgttgttgtttggtttggtttgcttttgagatggactcttgctctgtcacccaggctggagtgcagtggcatgatctcagctcactgcagcctcagcctcccaggctcaagcagtcctcccacctcagcctccaagtagctgtgactacaggcgtaagccaccatgcctggctaattttgtttattttatttgtaaagacaaggtcttactgttttgctcaggatggttttgaactcctgggctcaagtgagcctcctgcctacgtctcccaaagtgctgggattagaggcatgagccaccacgcccagactggaattgatttttgtataggttgtgacttaggaatctagatttatctttctctaagtggagaaccagttgtcctctctatttattaatccattctttcggctcatttgaaccattacctttatcataaactgaattctcttgtatgtatggctatgcaactggttcctctcttctctactgttgatttattttctactcccatgcccatactaaagtactttaattattttagacttagaaaaaaattttatgacaggaagggaaaatccttccttattgctgttctctttcacaaaaaagtgtattttttgtgtgtgcatttattctgtcacgtaaacttacagaagcagcctgtcaaggtctatagagaaaattcctgtgggtatttagactgggtgttgcattaataggttcatttttgataaatcagcatctttacaatatttagtttctccatctagaaatatcatacatttttatttaggtcttttatgttcatcagttaagttccataatttgctttgtgtagatcttgcattggagggtttattagttgttattacaaatgggatcccattttcccattacatttacttaatttttattgctagtgaataggaaataatggtttttatatgttaattttttatctagccatatgacttaatttttgtattcgtgatctttatacttatttttcttgacatcacattggccaggaggaaaatgatgtagaatgatattggtaaaagtgtacacctttgtcttgttcctgtctttaatgagaatgcctcgaacgtttcaccactaaatatgataaatacacttgatcagcttgaagacatttctttctatttgtagcttaccaggaggtatgcttttcactgcagacgacaccatggtcttgccaaggggcctttattttttcacttaacattttccttaagagtccagagattgcccggactaacttgggcctcccagcactggcatcctagctgagcgaacctggtttagaactgagcacttaggactgagtaatgtcttctttcttcctcctttctgctcacatttgacttcagatgtcctacaggcaggagctactttgtgttgatatttcccgccttctctcgccactctcctccagccctacccttccttctgcagaaaagtaaaaaattttacaaataaataaaaagtagcatgtggacgaggacaagagcaccacttctggaattttctggcaggcaccactgaaaagatttttattcctaacttctaatttaaataacttcaatttttttttccacctgattatcttaaagggctaaccaccacctcacgtgctggttgctaagtggatcttgtagtttttacaggaaagtatgagaaaggaattaccacgtgacatctgatttcctgttgcagtttcatgcaggttctgatgcaggatacagtcatttttaactctttctcggccactgccttgtacatggttaatgcagaataaatgttttgatggtggattgatggaaatgatttaatcagagtccatctgagagttcttaggtggtgatgattttttgctaggctgtgaacgaaaggatttgttcttgtcaagcatgtatgtggagcatgactctaatgtgatttggcacctgtctagaaaattgtccctgtatccagtgacactttgctttggggaagtcaacacctgctgtgatggcatctgtcatatttaggaatgtgaaatgcacatgaataatgcacagccaccttagtaaaatgccttctccagaaaactcttcatgtaagccactggcaaaagattgttgcaagctgcatagaggagacttagggccccccttgagataaaaacagtggatgatgtattttactatagcttttctcaccttgatgccattggggtagattttattattttcagattgtttagccaagaaagcaagaacctgctaaatataagggtcatttatttttggttggtttgttagaaacagcattagctcccaacaaggtggggttttggggagatggagtgactcatctcaggcatatggtgtgttagtggcagccatccaggtcaagagggagacatagaagccagaaacaccgagaggcaaggcagccccaccaggcagccacgagtagctggccttggagcccctcccgatttcagtgaagttggctttagcttccggggctgttggtgtaggaagtttggtcaattagacaattatttttcctttttcagcatcctctcttttcttctaaatcatcaagtccagaaaagattctggaatccatgacaaggagcagactcaacgttccctaccttttctcttgcaggcaggtgacaaacattaccaccccagctgtgcacgatgcagcagatgcaaccagatgttcacagaaggagaggaaatgtatcttcaaggtgaggtggactcaagaacactagaagttttccttgctgggggaaaggaaatcttgctatgtttgtttgattgtttttagagaaggaggcatgttattagctgtgaggctacccaaatccaagaagattatggccaaaagttacctcatcagttagtattaatcagccaagcagttgacatgctggcagtgagcccctcaggctgttcacgaatgaacttgtgatgctgccttaatcaaatgaatggaactcgacatttgatggctcggatgtgagggaagagtgaaaatcagcaatatctcctctccaactctccccaggaatatgcttaggaaacaaaagattaaaataatttctagaaatttctagaaatgttacttatttgatggctactttttttctccttttactctcctgtgagaagggctttttgaggcctcccaggctgctgttctctgggttttcaaaaagaaaatctcatatttgatgaattacgtcacagacttgtttcaccccattaagttgattagctcttatattgagagagagagagacagagagagaataggagataacaagagagaacccactctctgaaagagaaatttctggtgtcaaagaggtactttttaccagggagccattggaatcccagcactttgggaagctgagttgggaagactgcttgaaccgaggagttcaagaccatcctgggcaacatagggaatcctcaactctattttatatatatatataaaatagaccatatatatatatacacacacacacacacacacacacacacacacacacacatatatatgccgggcgtggtggctcacacctgtaatcccagctctcagggaggcagaggcgggaggatagcttgagctgaggaattcaagacgtgcctgggcaatatagcgagaccccgttctccacaaaaaggaagaaaaaaaacaaaaaagacaaaaaaaataagcatacatatatatataaaggaccatatatatatgatcatagtttttatgaaactgattatatatatatatatatgatcagtttttatgttctctgaaattctggaacttctcagagaggctttgagagaggattctcttctagtcaaacagcaccatctgtgtaagcattttactgtttttagctggaaaagagttattaatcaaacaagggtttattaataaaattagcaaaacccataagagctattgctcgttccgttgtggtaattactgggtctcaactacctgtgcatgtcatttcttgatttctctttgcacatggcactatgtgtacctgtaatgagttgttcactttgctctctcaattttgtttttaggcaacttaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaagcacccgcatctgtggcctcatgcgggatttatatgacacgttttcccaaggacaacaggccttacatctgcagtggcaataggcaggtgtcactttgcatttctcagcacaaagcagatttattctttatttggtctgtgggcttagattttagcatgtcaattctagcactcaaaagcaaagacacaggagtgccaatcaaccctgtctctgctagaaacagactcagaggctccgggtgcagctctgcaattcagagtggttctggaggctggagagagaaggtttcaagcagtgcacaaatgcagcacattcgggctacaaataaatggctatctgttgaggctgcatttggaattccagggattgctctaaaccttctggagttgtgcttccgtagcctttgtgtgccctctcggcacatctttgaagaaagagcagtttcatcttcttcagcatctgatgttctgtccgagtcacattccttgtgtgcctgacctctggagaacaatagtgccattgtgcgcagacccggtgtcctggccagtgactcctgctcagcagaaccttcacggcgaatgcttctcctgagcctgcacctgacccctgggccctctgcattcagaggatttcctgtgctttgtagttagcctttgagccagagttagtgctgaagggacctatacgtctgtctgctttttgtttgatttttttgtttgtttattttggccctgggttaagaagatggaaaaaatgattgttaaataaggattaaagtattatgctgatataaaatgtattttttcttgccattaatttgatattagttaagctcagtggtgtgaaataactcatgagttattttaatttggttacttttcaagtatgcacaggttgttgcttaaaagagataaagattttggccaggtgtggtggctcacgcctgtaatctcaacactttggtaggccgaggtgggtggatcgcttgaggtcaggagttccaaagagcctggccaatatggcgaaaacctgtctttactaaaagtacaaaaatcacccaggcatggtggtgcatgcctgtaaccccagctacttgggaggctgaggcaggagaatcgcttgaacctgagaggcagaggttgcagcaagctgagattgtgccacttgcactccagcctgggagacagagcaagactctgtctcaaaagaaaaaaaaatgaggtaaagatttaagtcatgaaatgtggaaactctgatattcatactgtgaattttatttatgtaatttatgctttcaacatagtaactttattttcttaagtcttcttaagtgctcatttaagttctgtccatccccacacttgaatgtgtccttacatggacatatcagccttactcataatcatataaatgacatatttgatatgtatctagtcatacaaaatcatatgagcaggcattggattcttataagagcttctattggagataagtgttttgtttaattctgtgatgctggtaccacgcattaaagtgcttcataatatgagaaagtgagactgttgactcaggaacagaaaataacacctaaatagttacttcactagtttaaaagcaaagactttttagaaaattacttaaaagattgaaggccaaaggcaatttttggatttataatttaactttcaccctttctactagttggtttctcatttctctgtaggtgactatgtataattgaatcaatgaaaaattcagtaagtcttgcttctggacatagactatctggttgactttattcccgtcaactaaactgcttggttgttttgatgttatataaacaatagctattattttttaaattaaatgcagcttgtagtaagcactcaggcattccttttaaaggatgataataaggtttaaaaataacaagacacgattaagaactaaatatctcttgcatcaaaagactcatgcccagttggtggtctctgtggtctagaattatgacctttatcaaacaagcttgggctagatcaggaaaactcacttaggctttggacatgtctgatttttgtgttatgattcacttggacataaagcaataacaccttcctatgatggggaaagagggataggagccattctcagaagtgctgtctcagaggactttgtatctttccattttcctggctccttagtagtgcattctgtcttctcaggctccaccgtttggcatcccgactgtaagcaatctacgaagaccgaggaaaagctgcgggtaaggacacaattaaaacatgatgccagctgcatttgtaggccatacgctcgtggtcactaattcttggggctagggtttaggtgaaattactttttactgactttttcccttatagcaaactaagttcaaaggccatttggctagggaaagggttcccctcttaccttaaacgtactgtggtttttattccaaatgcttgtgttagacaaagtaagccttggccttactagtcagcttcttagaaaagcattcaagagaaaagtcaaatcatgcagatgggaaaacaacgactcatcaggttccaggtgcagcatctgctgacctcaccagactgttttggtgcttagtctataatgcactactctgaccccagctctacattggcacattttactggtctctcatttactggatccaaattcaccagaatagactctaaaagctgatggcttgtcagataaaacctttggggaaaataataaccaaccaagacaggtaaattagtcaattctcggaacacctccagatggcagtattttatgtttcagaagcaaagcgctgtacacagttgtaaaactgtgatcataattctctgtcctgttcagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacaggcgtagtcacctggttgtgggctctagactctgggatttttgagaaactatggatgctttggaaatgagttacctttataaaatatgagaacataaatgatcatccttattgtgacttttatcgtaagaatgtaaagttcacagcatagcttgaggatgctgcccagaaaccaccccagtagctatagtagtttgtactctctctccagtgttgcttttaggttttctaataatcattttaacttcatctctgatgaagtcgtttgggagatgaagagaggaatgctaatgaggccagactgagtggaatgtgggtcttttctgtatcaggattgcttgagtttgcaaatcatgtgactaaaatgatttttaaaaaccaacaacactctgataacatcttgatggaaaactctctggataagcttatgaaaacaactagtgaaatacttccacccattctggccaagaggagctattgttttcttcctttagtaagacttccagagaattctaaagctcttctcctaaacccagcattcactacgtgggaggtcaggacagtgctctgggtcactgtctttggaaagctcagaagtgaggaagaggctcccacgtacccagagccggggttcacactgatgttggtagggtttaaagggaatacgttttgaacagagaaatacatcttgtgctctcttgagggtgtgtctacacatcacaaatcttgagccaagatttccaggcctttcactgcatgtcacattagtgcagtttccatagcaaaatgaaaatgttttaagaatctttcagcaacccactgggtagtccacattttttatatttaagaactcatggggcatttgtaacaacagattctcaaggatggctctcagttggcttcactggctttcttaccctttatatattgtaagaatgtctaagccaaaataaatggagaggaattgaaggaggttggagcttagataaatttactgtaacttgaagaccagttaatatgcttttaaacatgggcccaaaaatccacatgtacatcaatgaaagaatcccacttgatgtttactctcaagttagttttacctaaggtggttgttgttttgttttattttttaaaataattcttctgatttgaggctatttctgtgttcgttcttcccttttctcatgtttcatggcagctgccaaacattcggcgttcttcatccgatttcttttattccaaaagtctgattcgacgcacaggacggtctccgtctctgcaggttggcattgtgtctaggctggggctcgaagccactgtcctgggcccaggcttctgttgcttttcccctgggctgcttttctcacataacttcttcggctcctgcagaaagcagatgcttttctcacaccacaagcgcctctcacactgactctggctgttgtcttcttggatggatgttttcattcagagcagcagctaaagctttgtgtctgttcaagcaagcacatcagaagctatcttttggtcccgtgttgccacgtttgttcactgcacaagtatctgctcagcacccaggtatagagctgggctggatgtggcagatccagcctcataggcaagaaaagatgataaataattataagagtggtacagaaacccatcccaggctatggctcatgtaggccatgctccttggaatgtcagatgaggaaaaggtttccagggtcgcttcctgggagaagtggtcttggagttgatttttggaggctggctgagatttgcccatgaggggatgaggagaaagtggtggacctgatgaggagatgtgaagtgtgcagccgggaaaggcagtgcttgggtagggagtggtttcactcaagaaaggaagagtgagaccaggcacagtggctcacgcctgtaatcccagcactttgggagaccgaggcaggcagatcacttgagatcaggagttcaagaccaccctggccaacatggtgaaaccccgtctccactaaaaatataaaaattagccaggcatggttgtgggcgcctgtaatcccagctacttaggaggctgaggcaggagaattgtttgaaccctggagacagaggttgcagtgagccaagattgcgccactgcactccagccgggatgacagagcaagactctgtctcaagaaaaaaaacaaaagaacagtgaagtgggaaaggaagaaactgagaacaggcacctactctatggagactgggggatttacgtataatctcatttcctctccctaagaattcctgcgaggtagctaatcttattcccattttacagatggggagactgagacccatcatagttaggtaacttctccagagttactctactggtaagtggaagagctaggattgaaaaccatgtttccgtgagcccttcactcatattcatcctgctatactgcaaggggacagtgagagaaaaacccgaaagaagcagaagaaggagaacattaaatactggctaaggctgttgtcagggggccactgatggagtgtaaggaagagagacgcaccacctgcccggggcatcctgcaggggaagggagaggactcaaccagcccggcagaggaacagccaggctggagattatgctgcatgcacagtgtacctgaccgtctttaggggtctctgagaatcagtggaaaccttggcctgttaaactagaagcgactttctacaatctcatctcagcccagatgaaacctgttctgtagctctgctaacaattcagggttgcactgcagcactttggctgggctgtgtgcctgtacattctgtgcctgtcagaactgcgctaaggataagaagagtttgagtttctatttttgttaaaccttcaccttctttctttgcacgatggaaaagacagaagtatagaagcttagagtagaagagaaccttttagaggtcaaccccctgagtttcctcattgatagaatgaagtcggatgggctggacatggtggctcatgcctgtaatcccagcacgtcgggaggccaatgtgggcagatcactagagcccaggagtttgagaccagcctgggcaatatggcaaaaccccatatgtacccttccaaaaatacaaaaattagtgagggatggtggtgcgtgcctgtattcttagccactcaggaggcttagatgggaagatcacctgagcctggggaggttgaggctgcagtgagccaagatcatgccactgcactccagcctgggcaacagagtgagaccctgtctcaaaaaaaaaccaaaaatggacagatacagcagcatgtctgagactgcacaggctgtcataaacagcaagccaactgcacacttcagttcttgaccccaggcctcagtgccttgcgttgtcccgtgatactgggttcctatgatatgatgtatttttcatacaatcttcattctgtgttaaagtttcagctccagtggcagagtttccacacacggtgaagtcaaagtcacatgaatccagaggaacagccaaagattgtccccactttaaatgagtgttgctcagaattaagtgcttccacttggcaagaagccactttttcaatagtttttttttcttattttttccagtagtatactgttaaatagtattacattttgttagcctgtgtctacaatcaagtaatacattttcatgacttgaagaaaaatgccatcatcaagtgtgaaattttttagtttgccccagacctttaagcttaagagatttggagcatcttgagagacagagagggagcgagagaggtctgttttcaataacttctctcctcctatcttgttgttcaaaagggacatctgattcctattatccagctgtaactatcaatgaagtcaactttagctccatcacagaaagttgtaaacagctggggacctggcagagaaaatgggctgtgtggcaaggtctcccttcacccgttggcgattgaagaatggctcaccagtacctttaagattccagaaaactccaaagcaatgcagttctcaagtcacagatatgttatcttttaagtacttttggctacacagcagctcattttccaccacttaaaattcagtacccttagttattagataaactgtcttccttgcagggacattcagtactctgtgctgcagaaataaatcctggttttgttgtagaggaaagtaaaatctatagcaggaaagtcatttttgttatctatattgagaatgagctccatcttttccttttgcctgaattacaggtaaaagaaaatgatgaaaatagaattacctaagaaaaacgtattctggttccactcacttggaagttttctatgaatagcaaattttgtctacaggtaaaactcagtactgagcatgtgtaattcattatacacaaagcacatggtattcccaggaccaagtctgtaataatctggggggtgtcacttgctttcattctaaaagggagtttttctcagccatgcctttggaggttaaagcatgaattgactgacctacaaaatgggtgtgacttttttctttgaaactaatattcaccaattataacatatgcacttgtcaatctataatataccgaacaaataccatgtgtatatttttaaaggagctaatttgaggctttatgtctgtcaagaacaagcaagtaatgttagtggtgtttgatttttgttttgttcatgtcactacaatacatactgttttactcccagctttcacttcgtccaagtatttcatccttttgagtgtgtctttacagttcatcagacagctgaatgtagaggtgtaaagatttatactggaaagatttcatgtaataacggctgatggcatttgtgaaactgtccccagagaagtggtgtgtgcgcacagcaccctcctgcctcctctccaaacacaaaattcttttttccaaaggagttgatttcactctttctttgcttagcagtgggcattcagtatgtgcaggttttaaaatattcctttttctgcagctgttatccccaccttgtctagtgaacttcaacaaaaacccaaggcaggtactgtccacatcaacaggacttagtataaggtgtcagtcaccttatatcagtagttgtcccatcagtgttcataagatcattctgatctagttgccagatgcctgtagtttctctccttagagcatggctttggataaatgcaaattagatgaatatagttgttgcatccctgctcctgctgaatggggggagggcaggggctacaaagtgcttcccagcactgtccttctaggcgacccatgtgcatggtggatcataatggaaagtaaatggaaaatgtcatttatctacttactcaaccggcagagctctggtaagtgtttttaatggttagtatttgaagaataataagacctgtaatggaaacggaagaggatgtcttcaattaatttttgttctgtgactgtgccttctgaatggtaggacagatggacaaaatcaaggcataggggaaaaatagctgaaaggtatttagagggcttttcaaagagatttcatgaagaaaacaaaaagatgtgctttttaaagcatttggctacttatttgtaattaaatgccatgttttatctctcctgttgaactgctagtcttctaatgaggcatctctttgttatttgtgtgtgtgtgtgtggaaagtaaaaatcgttgttgaaatcaaacgtaaagacatgaaagtgtgctggggagataactatagagtaaatggaccccttcatcatgacagactgaatgagaacagccatatcaacaagaaggttcttaccgaaggctcctttcttccttttgccaaaataaggtttcacctacttgcctcatcttactggcaaaatactctgagcgatcactaccatatataattctgtatctatctaccttgcctgctttcttcatctcacctcaccccacctccatgccaaagatggcatcagaagatgccaaagatagcatcaaaaggaagaactgaatttctccaactgcactttcgagttggtttttctgcaaggaaaaggtgcttaaatgaaagtaaataaattgtacctgcttttagtatgttagccataagtccttgctgtttcctttattctgtagaagtgagcttacctttggtgataaatatttgaaattgtatgcatttataacatagaccagagagtaatttttttttactgtaactctcataaagaattccagaaacaaggcttctgacccattgggttattgagttcagttcataattattgggtcactgttgttaccctggacatctgaatgggtggaaatggtaatttagattaaataactacaggtaaggatcatcagttacatgtcacgatcacctgtaaaattctgtgatgaccaaagaggtgatgatagggttgggttaatggtaaagaagaaactgtcagtgggatttgaaagtgggacagcatgtcagtaagttaagtgctttcaagattgagatggtttctgtctgagtggatatatgttaatgtgttggagaacagctctgagccttttgaagatatcttagccataacagcaaattatggattcattaggaaaagaaaaataacagctggaagaataaaaatggttcttttaataaacaagatgttaatttgaaattcaacatgtttggaattctagatgtttcaaattgaaatgtaaaattctaagtatctaggattaaaagtccaaaaataatcattcaatttttaaaaagtaattttatgaccttcataagggagagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctgtgtagctcacgtatgaaaggaatattcatgaagagcaaaacagaggcattatttgagattaactgcctgagaaacctagtctaatcccaagtgtctagaaaatgttgactacttgccatgtgcccagtaaggtgcttggagctttatatgcatcctctcatttaaccctgtgacatagttatgctggtacaccttgctgcgttctgtacatgaagaagttgaagctcaaggaagttaaaagaaaaagagaatggaaaagaaaaaagaaaaactcatgtaacatcaaacaactagtagagcccaggtttgaactgttatttggcaccaaagccagccttttaagtccactgtattacactgtcttacataaaatacatagatgtgttttatcccattatttcaatatagacaggtaaacagaattgggccattgtaagaaaataagcaagcaagaatgcaactcaacctgcaaacaagatgcccatggaagtaaattttaccataaacttaggaggtcagaatgaagcaaaaacaaacagtggtaaattcagtgaaagaaaaagcagtttccgaatctccaagtgtattagtccattttcacgctgctataaagaactgcccaagacggggtaatttataaagaaaagaggtttaattgacccacagttctgcatggctgggaaggcctcaggaatcttaacaatcatggcagaaggcaaaggggaagcaaagaccttcttcacatggtgtcaggaaagagagagcatgtgaatgcagtaaaaactaccatttataaaaccaccaggtctcgtgagacttctctcactatcatgagaacagcatggggaaaaccacccccacaatccaatcacctctctccctggacacatggatattacaaatcaagatgagatttgggtgggggcacagagccaaaccatatctccaagatacatcagggcatttctcaacactaaagtttgaagatgcgagtagcagagggatggctctaagacaagccagaacatcagcaaatttgatgaccagttcacctgactttgaaaactgcctattaaaacctaaaatatttatttctgaatcagagaacttgggggtaagtgtattcaaattggaggtaatttggatctgaaaacttttaaaaaccaaatgggtcttgaaaaaattcaaattgttgaataacttttaaaatctttagctcaacagtattaatagtgtaaataaaaaaagataaatgtttccaagaaagcctgcataactcacaggatcccctaatccagtcaagaaggaagggagaggccaggcgttatggctcacgtctgtaatcccagcactttgggaggccgaggcaggcaaatcatgaggtcaggagttcaagaccatcctggccaatggggtgaaaccccatctctactaaaaatacaaaaattagctgggtgggtggcaagtccccgtagtcccagctacttgggaggctgaggcagtagaatcgcttgaacctgggaggcagaggttgcagtgaagccaagatcatgccactgcactccaggctgggcgacagagtgagactctgtctcagagaaggaagggagagagaaactgaagtgaaataggctagttctgccaagagaactgcctttactgcccacgaagctcttcatccctggaaggtgctgttaaagacccttccctacatgtgcgtgcgttgttcttcagctctgtttctaccagtacatgcagtacaagagcaaataaaaccattcagagccatccccaggtgcatcattacagcaaaggctgaaagtatccttgccccacacttggcaaaaataaggatgagtaacatacgagtgaccccaaagccccagtgtacactttggctgttcacacaatgtcctggatgcttgttaatgaaaacaggcctttgtcatagcaaccccagtaaccgaagacatctgatgctcctgccgcacaccctctccccaccccaacccagtgagctattgcagtgttcttacagagctagcgcaacaaaaatattttcagttagcaagcattcttttctgctacttgatctcaatatttctcttttagtttcaccccatttgtcccatagttatgttgataggaaataaatgatcacatttgccctgcaatacagcaaaattttagtgcagggcttaaatgcttgggctgtggacctagagtgtctgagttcaaatcctgactcttcatccctttcctacctgtgtggcttggagcactgatactttttccttatctgtaaaataggaataataatggaagctacctcctagggttaccgagaagattacatgagattaagcctgggaagtgcttggcacagggcttccacgtagtaagtgggcagtagacattcgttgccatcgatattcttgggttgctacttaagaggtttcattttgacattaagtttggaaaatgtgagatcctggccacttgaaactgaaggactacctgtggttaataattatctcacagagatggatacaggttcagctttttcagggggtagcatctccttgtaaaggaggaatacattttgattgtgccacttctatattttgattaggaaatggatctagaaattgcactttattattattattattattattattattattttttgaggcagagtttcactcttgttgcccaggctggagtgcagtggcacaatctcggttcactgcaccctccgcctcccaagttcaagcgattctcctacctcagcctcccaagtagctgggattacaggtgcctgccaccacacccagttaattttattgtatttttagtagagatggggtttcaccatgttggccaggctggtctcaaactcctgacctcaggtgatccacccgcctcggcctcccaaagtgctgggattacaggtgtgagccactgcgcccagcctgcacatttcttgaatagtgttatgtgagtctttcctttttcaacatactcagaggtagaattttctcatattgagatatgcctgtgattggtataactctagcaggaaagcgcttgtgcacggcaggtcctggggaggaggcccagaagtgatgcacctggtgcacctccacctgggtgtggtgtgatttctcccagccacttccaccctagcatctcaaagataccaggggcattggctgaaaaagactgatcacagtcttccagcaatgagtcaaatcactgcctgacctgaattggccagatatgtttgccttcattgcttcaactgtgaacagcatagtgagacaacacccttgtctgaaggagtttctttggctcagtggtgcccacattcaaggtattaaacaccaatagaaactactgagaaggcaaggtcttattcctattgtagaactataagttactctctttaggaaatggctgcaacagaggggaggaagtgttccaaaatgaggccttgagttttctctgcagagctttccagaatatgttaaacagaagcaggaggcagctgatcctagttcataagtttccttcctgctcacataaccacctctcactctccacgttcttcaggtatatactatgaagtccagtttctttcatccttcccaaaggccgacccaccagccttacctcagtgactctctatatagttaggctcaaatcgtgtaattaacataagtcaagtgtctgcaaactaagtatttgtttacaagtaataaattctagctcattccctcaactaggatttgtgccttctgtgtacctgtggaaagcattgggtatagacagtggttaaaaaataaactctatgagggcagagagcatgactaaagttaatgagggagacagacacgatgcaaggaaaacaataaatatataattatacattttactcatgaaggaaaaaagaatgacactatgagagaaaacaacatggggaaccaactctggattgaatcagggaggtcctctctgaggaggtgatatttaagccaagactgaaggaagagaatcatccaagtaaaattgggagctagggcatttcaggcagagggagcagtaagcgaggatgagaactccgaggcagctttgtgcgctgtgttctgtgagtgatgacaggtgagagacgaggtaggaggggaaggcagggatagaatcctgaggccctggttgttgtgattttattctgaatggatgcttctgttaggtctgttctcatgccgctagtagacatatacccaagactgggtaatttataaaggaaagtggcttaatggactccagttccacatggctggggaggcctcacaatcatggcagaaggcaaataagaaacaaagtcatgtcttacgtggtggcaggcaagagagcttgtgcagggaaactcccatttataaaatcatcagtctcgtgagacttattcactatcacaagaatagtatgggggaaactgccccatgattcaattatctccacctggacctatccttgacacgtggggattattacaattcaaggtgaaacgtgggtggagacacagccaaactatatcaatgctggagacaaaagcagagtagtgaccatccaaattatgttcttgaaaggtctctcggctgagtgcggtggctcacgcctgtaatcccagcacttggggaggtggaggcgggcagatcacgaggtcaggagatcaagaccatcctggctaacacggtgaaaccctgtctctactaaaaatacaaaaaattagccgggcatggtggcaggtgcctgtagttctagctactcgggaggctgaggcaggagaaaagtgtgaacctgggaggcggagcttgcagtgagccaagatcgcaccactgcactccagcctgggcgacagagtgagactccgtctcaaaaaaaaaaaaaaaaaaggtctctctatccattgcctgccaggtggatttgatttgaagaagggaggggagaaggcagaaaactcacagggaggccattgcaataatctggatgaatggaggtggtgactggggctgggactacggcagtagagagggagagaaatgggaagctttgaggtgtgctcaaaggtaaaccagaaattctcgtaggggacaaggagcaggaagggccagagaaaggcctccccatgccttttcaaaactggatcgtacaactagtttgcatttacctttccttctaggttgtattttaccttattcaaaaaggtgataagtgtttctttttttcactagctgagtttttagtaaagcttaagggcccaggacagtctagattctgaagccagggtccgaagtcttacaagtcactgtttattttacagcctaccaggacatcctcggaaagtatttattctaggccaggctccagtattcctggctcaccaggtcatactatctatgtaagtatctacttctggaagtgacatttctgggacaggtaaattagtggattgtaatagcagaatgggtaatccaaaacaaaaactgattcaaagtgatttctatttttgttatgagacctgattttcatttttgtagaacagtctcctcaatcacttttacctttaggtaattacatttatgtgaccatcaacagagtgatcagacgacctgtaaaatgtagtaatatgttgcgggacttaaaaaattcttgcacctaagactccgtctcaaaaaaaaaattcttgcacctaaattgcatatagatatttggggattaaatatatattttatgaagctgatactgagtgttcctaaattctaccacaaagatatttaaatatttagtttattaattatgcggttcttgtttttagccatctgagaggattattggaccatctgtttgagctttttcctttactatcataaattcaggaaattatccttaaggtttgcacatttatctatttcatgaattctacacagattttttcctaagcgttcagtgacttttttaaaaaaacatgattaatatatggtataaagggcaacttctgaagagtataactgtgttaggcaagatgttttggtttttgtttattttaaggccttcactttttaaacaacaggaaatgcgccaactacagtttcctaaagcagtcagactacaaggtaattgttctttctggttaactttgccaggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagaggtaatacattcctactggttgtgagttgtacaacaatttaccttcccttttgtcacatttgtaataactaccatttggagttcaggtaaatcaggtggtcttttgtctgcctagtatttgcagatttctagaccaggtgctttgaggtattcagaagcccatcatgagaagtgggagaacagaacaatggcacatcaaacaacagtgaagaccagctaaacattagcatgctgggatggaagctgtcgggaggtggggagggggtggggattgtgtgagctgggcagagcaaataagggagtgagggtctcctgggggtcttagtctagtgataagctttaagtatattcatggcatcatgaggagagagaacacaccccctaaattttggtaattacagttttcagcaacttaagaaagttagcatgtgaaagaaaaaataaagtagagcgcatggggcaacagtctagcacaggagtgtgagccagcattctggaatcaaattacctggtctcaacccagggatcaccacatgccgattgtttgactttgaccatgtgacagccattctgctgctagtttcctggaccaggtacagtgctcatacctgtaatcccaacattttgggaggctgagggccggaggattgcttcaggccaggagttgaagaccaccctggacaacatagttgagacctcatctatatatattaaaaaaataagaaaaatggtcctagtttcttcatctgtaaaacagatagggtgatgatagaatctacctcatagggtgttagtgaggattaagcaagctaatctatgtaaagcaattatcagaggccagacttgggggaaatactgagcatgtggcaatttctaccattgttgctacctgtcctcttggggctcgttaatactcggcctgcagacccatctgctgcgggaccagagcctctcagccccttggggtcctcccctccccggtcccatctcagggttgaaggttctctgtggtcgcttcctacccaagtccgtttcccctggccaatcggctcactctcatttttttctcttttattttttgaattagaatcatctgtagactgattttagtccacaaagatgttaacaaatagctgacaaatcagctattcaacaaaggttaaaacagaatataaacaatctagcatctcacagtgctttgaggtcttggagaagaaaaggcatgaaaatgtgattctgtttaattgttctcaattccagatgtataatattatttgataattatatttatgtttattttttattttatatatattgttccttttatttatttactttctaatctgggttttattccagagcatagctctgcgtggaaaaggtccctgtggcaggaagtgatatccattttcatgtagtgccacctagtggtcacttagctgtagctgcacttgcggccgctctcaagcgcaggtgcattggcccgggttgtcagttgccattgaaccccacagagtttcgtagggcataagaggcgaggggaagttcctgaacaaagtgcatagagattggccttggaccctgtggatgagaatttactaatgtttaacccatacaagcaaggggatgtgagtttttttaatggtgttaaggatttggggttcatggtgtgcagtgtacgtgtctgtgtgcgtttcccagcagctccatcaaggcagtaaaacattaagcactcaagagtttgggctttgaggtgaaaatctctgcatttaaaaccagactctgccagacatggtgactcatgtccgtaataccagcactttaggaggccaaggccaaggtgggtggattgcttgagaccaagagtttgagaccagcctggacaacataccaaaattccatctctacagaaaaaaaatacaaaaattagccaggaatgatggcacacgcctgtagtcccagcaacttgggaggctgagatgggaggatcacttgagcccaggaggttgaggctgcattgagccatgatcatgccattgtactccggcctgggtgatagagtgacaccctgtctcaaaaacaaaacaaagcaaacaaaacaaaaaccaccaccacaaaaaaagaaaaaaagaaaaaccagaccgatgctgactaaccacataactttggggaaattatatacctcaatctccttatctgcaaactcaagatagagaacaagaatacctatgctagaagttttctgtaaagagtaagtgagctatttacattagaacagtactgggcacataataagtgcttaagaaaaatgctggctactctcgtaatcagcatacttactgtcataacctggaattatgtcccatggttttctctatgcatagagggtgcccctgggatcagaaatcagatatattagtgaactctttcccaatacttgcatcttgcaactgagagaaatttacaagctgttctattatttattccattaaagtttaacacacttcttttatagacctcatatacatattgcctttttttttttttttttttgaggtggagtctcactctgtcacccagctggagtgtagtggtgcaatcttggctcactgcaacctctgcctcccaggttcaagcagttctgctgcctcagcttcccaagtagctgagactacgggcatgtgccaccatgctgggctaatttttgtattttcagtagagttggggtttctccatgttggccaggctggtcgtgaactcctgacctcaagtgatccacccgccttggcctcacaaggtgctgggattacagatgtgagccaccgcacctggcctttatacatattgccatttaagaaacactgcaagagtcagattagttctgtgcagccattggtgcctccagggccttgctgtcagtgcaggtgcagacctgggccctgaccttgagaccagccttcacccagctgagaccccctagagacaggctgtagctgcagaggagaccctggagcttgtgaaggcttagaatacagacagtccgcccacttactatagaatgtggggaaaagggcaaattctaaaactgagaagtccacccctggctgtgttctccatagctctgtttgaatttcatttctatttgaaagctttttgcattttaattgtaaacattttattcatctggaaaatacttgagcaactactgtgtcccaggagctgctgtcatcactgggaatatgtagttgtaaacaaacagtccttgccctcatggagcttgtggcatcacgtgggagacagacagtaaagaaacagatatgtaatataattttacagagtggtagggctctgaggagaaatgaagcagagtaaagagaaagcgtaccaggggctgggttgctcctctggacagaatggtcacggagatgctgtgtgacagtgggtttgagcagagacatcagcgctgacagggaatgagccctgcaggtgtctgggtgaaaagcactggcagcagaagagacagcaagtgcaaaggccctgaggtgacagaaagcttggcctgttgatggccccaaggaagcctgtgtgcctaggaggatggaagccagaggtgaatgatagtgagattggcgaggtgaatgatagtgagattggcgatgcagccaaggcaggatgccccatgcctggtcaccaaagtcctattttagttatcaaactattttatggtgattgctgtggttgtaatttagtcaacaaccatgtgaacaagatcctatgtttcagtagatgctgtaactcatcatagtaaaatgagcgtagtttgaatatataagggaaatggttccaacttgtctagcttaatcacctaagtatgtatcacaatcatatctagtcatggttcttttttttttttttttttttttgagacagagtctcgctctgtctcccaggctggagtgcagtggcgtgatctcggctcactgcaagcttcgccttccgggttcacgccattctcctgcctcagcctcccaagtagctgggactacaggcgcccgccaccgcgcctggctaattttttgtagtttttagtagagacggggtttcaccatgttagccaggatggtctcgatctcctgaccttgtggtccgccagcctcagcctcccaaagtgctgggattacagacgtgagccaccgcacccggcctattcatggttcttaggcagagatgtgcaccagaatctccccggaactttgtcagagtctacctgtctgagccccatggcagatgcatttgtacctgatcagaagacagggagatgtggagggatgctggcaggtacatgttggctaatatttacagctgactctgataaacaactctaattaaaactggcaaagaggccaggcgcggtggctcacgcctgtaatcccaaaactttgggaggctaaggggggcggatcatgaggtcagaagatagagaccatcctgactaacgcagtgaaaccccatctctactaaaaatacaaaaaaagtagctgggggtggtggcatacgcctgtagtcccagctacttgggaggctgaggcaggagaatcgcttgaacctgggaggcggagattgcagtaaaccgagattgcgccactgcactccagcctgggcgacagagcgagactccatctcaaacaaacaaacaaacaaacaaaacggcaaagagttaacaaacattgtgactttaaattctcttttatttttctagtctccgaggactttgtctcctactccatcagcagaagtaagtaccatttctttttatcattttaatgggtggaatttgagaattgcttggcccttccctagactgggatttttgaaaaagaacataacatacaaaagaacagaaaaactgcatgtggggttatggtggctttggggattacctccgtgaaagaggagactctaagacacagcaatatatttctcttaaattggagaccagggagtaaaaatggcctcactttaatctgtgtctgtgcctgtaagtggaagcaaagtgtctgcaggaacataagtcacttgtcccaatgtggggctctttgtccgcatctataattaatttttctgaaccctaatatactgaaatggccaacagccatcatggcgtattctataagcagagccatcttgatgggaggttactctgtttagtctgaaatcaatcatctgatcctaaaaccaagcaactttctggatattatgaaactggactacttttagggaatctctgtaattcaaagtagtaaaaataccataatattttcatggtttatgactgctatgaattattaatttctacctatattctaataatttgcattgaatttatgaagaattaatttctattgaccaactgtgcaagcttgaagcacataatctggggactttttgttttgttgttgttttatttaatttattgttatagacaactagtatcaagccaaagtttccccttgccatttgctctcaaattccacaaagctatggttactgaggtgttcatttagtcgttattaatgcattctttcaaactttttacttttattgtgctagtagaaatttcataggacaacagattcctaaaatgtaaaatattctttgtactctttcaactctttagacagttttatattgtgtgtgtgcatgtggttttttgtacttattacctaatatatccttttctagatttggagataggtgacattttagtggtgctatgatattccattgaattcgcatgtcataatttcctttttttttgagacagagtctcactctgttgcccaggctggggtgtagtggcacaatcttggctcactgcaacctctgcctcctgggttctagtgattctcctgtctcagcctcccaagtagctgggattacaggtgcacaccaccatgctcagctaatttatgtatgtttagtagagacagggtttcaccatgttgggcaggctggtcgcaaactcctgacctcaggtgatccacccaccttggcctcccagagtgctgaaattacaggcatgagccactgtgcctggcccgtatgtcataatttcttaattgtgccccaatttgttgaacatgtaacgcaaatttttgcctttatgaatagtagtactatgaaagtatttgaataaattattcctccttttaaagggcattttaaattattttcttgggatatgtttcccaaagtgagaagtaaaataccggctttatggcaaccatcaacttgttattcaggagaatttatttaaaatgccaccagatcaatgtcgtagacagtacagtttggttggtggtcagaacgaaggaagagattagagtcaggagtctggttccgaagcaggctctgcccataccaactacatgcctacacacagggctcttaccagcttggaaccatgtttctacattagtgggggagggaggtgatagtatgtgacctaccttttcttgttatgcagatctggtaggtatgtgaacatacttatgaaacggaaaagtacaatgtcagcatggtcattggaattattatctcttgtcccatagccctatctctattaaggtttatatgttttcatccttaaaattttttttttttaaagaaacagtgtctcactctgtcgtccaggctggagtgcactggcacaatcatagtttactgcagcctcgaactcctgagtagctgggactgcaggcatgtgccatcatccctggctaattttttacagttttttgtaaagacaaggtctcgttgtgttgcccaggctgttctcgaactcctggcttcaagccatcctcccaccttggccccccaaagtgctgagatcacaggtgtgagccaccacacctggctcttaaaattttgtaataagcccaagtactgcagactttgaacaaaatatattagccacagaatgcttatttgcatataaaatacctgcaaaatttgcacataaaaataagtgcatatattaatcaaatatatataaacaagtagacatgatggttccttggcagtgtttgtgaagcgtggttcctactgaggcatggtgatagcctgaatgtgttgaactttgtttccaggggtaccaggatgttcgggatcggatgatccatcggtccacgagccagggctccatcaactcccctgtgtacagccgccacagctacactccaaccacgtcccgctctccccagcatttccacagacctggtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcgagctactggaagcaaggggtttttttaaaaatttttttacgattaacaaaaatctcttcactttgagacttaaaatggagatctcccaaagaaaatattttgatgtgctttttaggcataccaacatcatctaaaattcagtattagccatttttaacagctggattatgtttcccttatctaggtgttagtaagcatgcttggttaagcactttctagaaagaggactcagggctgttcttgatcacttttaagatcgttccaaccctaagattttcagtcattcttaggaaacataaaatcatttccaaccctaagattttccctcagacttggaaaacaaaatcatttccaaccctaagattttcaatcagacttggaaaacatacaattattaggcatcactacagtagagaatgccacaaagtagcagattttagtggaccttcatctgcagagaatttagtctctgtagctactagtgggtgtctcctgtgtgtagtgggagaagaatggagatcccagtacagatccaagattccctgagaaatggattcacaaggaagattctggcctctaataaaacttaatggtgacagtgcgcgtctgtgaagacttcatgttaagcttcttgcttctggacgcatagatgagagcaaacccatatgctacctttttaaaaataaattgtacaagaaatgaaaccaaaagaattaacaggatgataaaaagctgcaatcttctaagaccctagatttaatgatcgtagagaattcaaactatttgatcctttgataatgtataattttctctacactgataaatgtttgtgctatttattgaattacattaaatgaaagttctcaggaattttttttcctttatttcatgggctattatattcattttattcatgcccaggacgtgagtcccgatttaagcctttgtccatttgggtaataagaaatcctttatgctgggccaggcgtggtggctcatgcctgtaatcccagcactttaggaggctgaggcaggtggatcacctgaggtcaagagttcaagaccagcctgaccaatatggtgaaaccctgtctctactaaaaatacaaaaattagctgggcatggtggcatgcgcctgtagtcccagctacttgggaggctgagacaggagaattgctggaacctgggaggcaaaggttgcagtgagccaagatcgcgccattgcactccaacctggatgacagagcaagactccatctcaaaaaaaaaaaaaaaaaaatcctttatgctgccaccctgctcatgtacatatgctgaggtcactgagaccccagccatggagttgccggagcggcgtggggttataggggcattgttgttccaaagacccctgaacagtgaggggagtggtcagtcaacactccttcccccaaaagctcatgtccttactgagaaagtttccatctgttccaattatggttctgatgccaatagactttagaatcttctccttctctcctttcacaatatattacatgtatgcctgatgccacttgttaggctttaaagttattattttgaaggctgcccttccaaagtgaagctggagggattctgatagcatacttgtgatccatatagaacaccccaaagtgtccactccacaagttctagatgccagatgatgatttaaaaccccctcggtctgggttgaatttgaatggtccattcttcctgagataactgagtttccagcctccagtcctcctgctgaagttctcgggatcatatagacctctttgccacacagggaacacaaacatgttttccttctatgtaggcaaaatcaaattaaatttacagtgggatgtttgcttaagaaaaaaaaaacctgacccttacatataaatacaatgattgtcattttttttaataagcatttcagagggttctgttgtgtcaggtgctttttaaaaacagctgttgttgagtctaaatgacgtgcctgctactggctgaacagagaccatccgggtgaccatttctcctcaccaaagccatttattctcagagagtgactctgtacccacctgaacctctttgcaaactctcccctactttgcctcagccttagcaggtgcactcttaaccctttctccttcctcccttttcagcctcctgattaacgttctttattttgttttcccttggaacgatggcactttccctgctcctgtgttaatttctgttcttcttttctgtttccaccgtgccctgcccctgactccttgctgcacagagcttttgtctcctggtgtgcagaggttgtcgtacctgcgcaccagcagcctcagccccacccacagcgactcccgccccaacccccctttccgacaccacttcattccccatatcaaaggtaaggaggcaggtttctccaggcagcaccctgcatagtggagatttattagcaccctgggaaggctaataaggtgtatctccaagagttagtgccgagcttttgagctctcagcatgcctgcgtgtgtcatgactatacccaacagttgtcttagaacgggcatagcatctctcattgggagaaatatgtcacttctaagggctctagatgaagaagcaggaagtatgtttaagaccataagatttattatccactactttgaaaaaagaaaatatatatatatatattattattttgtttttggatgcatcgaaacaaaatataatatatataattggaatattttcctgggttcaatacgcaacgtgtctcagcaaaacacgacagtgtttagtaacagatatccaaaagttgtcttaccggtgataaaccatgaccatattaacatgtttgggcagcattaaaagatctatggcaacatcaatgtttctctttgagccgactctcagagcagtcatcttttgatttgtcctaactcccacatgatgcagaagagaggctttgccttctgttttctgttcctgcctcacatttctgccccatcccttctttttcatcattgtcggcaatgcttctgcagccgtcctcagttgggactctccacactgggggagccgagaaccctgaagaggctacaaaggggtcataatttaaaattaagtaggagttcccagaatggtgcgaacttgatttgaaccaaataaaccaataataatagctgaaggaggaaggaggaggcaagcacagatgttatcacaggtcttaaaacagtcctaaaggactcttaaccatgtgctgctccatgtgtcatggccctgatgcttccattgaggagcttgttctggtttactgaattttcgttgtcagtctaccgaagctttttctttgtgctcacttggttgttgagcggctgaatcctaaaaggtacatgtactgtacttatcagtatgcagtgattttataaatttgctaatttcagcattctctatgttttgaaaataatattgcttattgaagcaatcatgcttatcaaagacacacatacctggagttaaggtacacgtgccatttgccattagcaaattttttgataggtgcaacactctctaaaactcttgacagattattttactttattttatttttttattttttatttgttttgacacagagtctcactctgtcacccaggctggagtacaatggtgcaaacttggctcactgcaacctccacttcccaggctcaagcgattcttatgcctcagcctcctgagtagctgggattacaggtgtgcaccaccacacccagctaatttttgtgtttctggtagagactgggtttcactatgttggccaggctggtctcaaactcctggcttcaagtgatccacccgccttgacctcctaacgtgctgggattacaggcgtgagctatcatgctcagccgacagattattttaaattataagtgctaattagtattttgggggaaaatttttatttataaannnnnnnnnnnnnnnnnnnnggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcaagattatactttagagaatgtttataaaatcataaagaaattatgctgtttttttttcttaaaaaaaaaaaaaaacccttcagttgtgtattttaaagagactttaatataacagccattagccaaattaagattttggttatttctgctgaggtgggcagattgcttgagcccaggagttcaagaccagcttgggcaacatggcgaaaccccatctctaccaaaaatacaaaaaaaaattagccgggcatggtggtgcgtgcctgaagtcccagctactcagaggctgaagcaggaggattgcttgagcccaggaggtggaggttgcagtgagctgagatcgagccactgcactccagcctaggtgacagagcaaaaccctgtctcaaaaaaaaaacaaaagaaagaaaacaaagattttggttatttctgatatttaagaaaaaatgcattattgattcattaaaatgtaaacttcctcacttggctattatatgttttaacttgtagagagatactttttgtagaaagaaaagtgtcacaggccctataaagttacacagtttgtccaaataacacagcacaaagtgtccataaatggtcaatgactaatactgcttcatgtccatgagtggccatgtggagagttgaaaagcccatgggcattggaatctgggttcagatatgatctccgtcacttgctagctgtatcaccttgggttgcttatttatcctgttgagtgtcacttgactcctctataaatcaagaacaatgagactcctacatcacgaggtgaagtgtcttggtgtggggcacacccaccttggtcagcatggtgctcttaaattgcttttttttgtttttttggagacagagtctcactgtgttgcccaggctggcatgcagtggcacaatctcagctcactgcagcctccgcctcccagcttcaagcgattcttctgcctcggcctcctgagtagctgggattacaggcgtgcgccaccacgcctagctaattttcgtatttttagtagagacggggtttcaccatgttgaccaggctggtctcgaactcttgacctcaaatgatctggccgcctggggctcccaaagtgctgggattacaggcgtgagccaccgcgcccgaccttaaatcatttttgatgccatcattctgttcacttttcacagcattcttgggaaatgggctcagtgaggagaccaagtacagaggccctggctaagtaactgtccaggggctcaccactaggacatggcagtgctggactagacccaggccccctcctccccaggaacgctccttcatatgagggccatgcgtttcagtataaatatgtgtgaagataatttttaaagcacacttttatttttcatcccttttagccagaaaattgcattcttattgactcttagaccaagaatgatcctcagtcatttagatcacaaaattaagaaatatttacttttccatagaaatattaaatggttataaaaattataacacccctatgttcctaaatggtgctttattaaaaatgtagatatacattcttttctgttttcagtctgcatttgaagtgtttgacaccgtcaggtgttctggatttaaatgataaaaagcattatccaaaaggaattagtgaccctgaacttaaaaacatctaatagtctctctccctttttctttttactagacgtgtgcctatagtttgttcatatgaaatagtctttatgcttcagatgcaaagtgtaatgtacataacagtatatacttagtttttcaatcatatgagctttttgccaaccttaaagataaatcattggctgctttgggcacactgcctattgggcagtcctgctccacagggagcagtgtaaaaaaaaaaaaagatatgtggtggagattttgtacattaaagatattgctttaaaagcctagtgtatttggctaaatgtggattctccaaggaattacgtcttagttattttgaaaaacatgcatccatttacatggaagacctctccagcacttagaaatttctgaatggggggagcctatggccattgataacacatccaagatatctttgagataagtcaatgtcttccagggttttttgtggcccttcattgacttttatcttggagcttgtcttggaacttgagggagtttttgtttgtttgtttgtttgttttgttttgtttttaatggatgtgagctgggagcttgacctaaggtaggatgtccatctcagaggcagggggcgccctttgccactctggcagccagaagcccagccttccattgcccaagtccacttcctgttccttgtttttgcagcatgtgacccaggcctggggcctcactgagctgaggacgcctgcatggttgtaaagctgagatgcacggcacagactgtttctctccttcactggcttccccattcattttccataacatccattgttggttgggtgtatttttatttctgtcctccaaacttccttgtagcctcattctatcttagtatatctttgggccatttggacaaccttatgcctagagatttggaaaaaccattttcgctttgtttcgggcttcgtttgtaaagtgtctgctaagtttctcttgcttcccctttgaaatactgctagacatgacattctgtgtccatgaagtataaattggatttctgagcaggagggttacatatattaagtttctttgaaaggaatctttcctcttttgctataaatatgagttgccatgatgtaaatatatatttgacacttgctgaaggaaaccgtaactcttattgacgctttagacaagaaccggcaatcttaaaactgtcacaaaattctggatgctgccaacttatcttaaggttccctcaagatgttcatttatatttggggatgtaagcactctgagtccagaaagctaggcagtgctccaacaggtccccacagcagaatcgcacacccccatctctattcgcttgtcttagaattagtcactcgggctctcatggtgccaaaaagaagaatgaaagtggagatgggcatttaaatgtgttaagtacagtgagagtcctgtgagtgaatgctcccctgaggtctaaaaaattagcttactaggctaacaggaaaggaggtaaaaatgaaggccaagaaatagaaatagaaacataaatagaaatatagtagcttgtcactacaatagatgagaacactaacaacttagggtagcccaatctgaggacttaaaggaacaaaatagctatgagtgtgatatatatatatatatgtactattgtattatgtgcgcacacacacacacacacacacagagtagttttgttttttgttttgaggcagaatctcactttgttgccccagctggagtgcagtggtgcaatttcggctcactgcaatctccacctcccgggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcannnnnnnnnnnnnnnnnnnnggttgatagagatgacaacgatgatgatgaaaataatgatatcttccaaatatgatatttcatctggtgtgtcacacattactttgtttaagtaaggaactatgcacagatggcctcttagggcccccataagttatttcctgccagggttgggttcaaagttatatcatttaaatagggtattggccaggtgcagtatctcacgcctgtaatcccagcattttgggaggccaaggcgccacagatcacttgaggtcaggagtttgagatcagcctggccaacatgatgaaaccccgtctctactaaaaacacaaaaactagctggatgtggtggcgcatgtctgtaatcccagctacttgggaggctgaggcaggagaatcgcttgaacctgggaggcggaggttacaatgagccgagactgcaccactgcactacagcctgggcaacagagcaagactctgtctcaaaaaaaaataaaaataaaaataaatacagataaggtgtttaatttagaaaagggaaagaggcctcttcctgagaattttcctttttcttttaaaaatgcccaaaatttgtcatgcctttggtatttcaagggctaagaatttggtacctagcaacattatgtattccaagaacttattccccgatgagcggttgtgatatgtgaaaagcacattctgcagaattgctgagatgggtgtgttattgggtctctctttacctgatttttaaaaatgctttgtgggaagttttaaatgattatagttacatctgcttacaaaatttgaacaaagtagtgttttttttttttttttaaaaaaaaaacaactagagaggtgaatgtttgctgaagacatccagcctaatatagaaccacacccaactggtgacagcattcagccagaatccagtccttgggaattcagacagctactccataacctttgagaggctttgaccatattcaagaagtgaggggcttctacaggcactggccaacacagggtcttgttgatagaaatattttaatccctggacaaatgtctaattctaataaccttaaagtttgtgtcctgcatatgcagatatttttgtgtgtgcgtgacactggctaataatgataaaaactgatttaatgggggttcatttgattgtgtattataaccaaaacctacgagaactttcctggaaacatctgattttctgcaaggacagtggaggtctatgtgaaagaacaaaagcatggggcaggggggttcagaagcagtagtaaaagttgagacccattataccttctttcgagaaaagaccgtaagaatgattctgtttttcagttatggattactcttgttaatttctaatgttcataggattaaatcatttttcttcagtgaaacatttatattggagttgtcaaagattagctgtaatgggaaacttataaaaggggtgttgttgtgagcccagtgctgtacacaggtctttacttatcatcatcatttacttggaaactgtgacttaagtgaattgaaatattaaaaaaactagtttttcccctcatcagtgttctaggttgaaataaacgacgttcttcaaggacctgctatatgttgttttgcttaaagttgcagtttccagccgggtgcggtggctcacgcctgtaatcctagcactttgggaggccgaggcgggtggatcacgaggtcaggagattgagaccatcctggctaacatggtgaaaccccgtctctactaaaaaaattcaaaaaattagccgggcgcggtggcgggcgcctgtagtcccagctactcaggagggtgaggcgggagaatggcgtgaacccaggaggcggagcttgcagtgagccaagatcgcgccactgcactccagcctgggcgacagagcgagactccgtctcaaaaaaaaaaaaaaaaaagttgcagtttcctgtaacctgttgatattaagtgaggacttattgcactagcatctggcttcctttaatttagagaaaattgatggtgaatcttgccatggtgcttgctaaattaggccaataaatagctgtggaggtaattaattggcctccttcaatcattcattcacagacatttattaagcacttactcctggccaggcgataccctgagcactgatgatgacaaatgagaccaagttttaattcagcaacaggtttaaaacactatttccttctaaatgcaaattataatcttccttcccctgttttcctctgtgttttttatactcattttttcccgataggaactagttacttctctttaggagagggataaatgagataacatttttataaattagctttttaatagatcaatagtttgggatgatatttcataatttttaggaactaatatatgacttaaataataaagtcaacattataacatatttgggtctggatgctaaaccagctcttgagaagaaaagacaaaagtttcagaacaccaataaccaaaagccagaaatctaaatttgactcagtaatagacacagatcccatatttggaatatcttactgcccatttagtgtagatctgtactctggttacttaaaaatgtacatgctgagacattaaaattctcttaaatgtatattcaaacggtaacaattgacatctttcacacttgactggatagatttagaaaaatttgacctgaagcaactggccagacctctattttctgatgatctatgatttatttaaaattattagtgttaatagataaataaattggactttatcaaaaattttaaacttttgtgcttcaaagaattccaccaaaaaagtgaaaagacaacctacagactgggagaaaatatttgcaagttcatattatttctgacaagagacttgtatccagaatatataaagagctcttacaactcagcagtaaaagtcattacccctactaatttattgagctttaatagtcctgcatcttctggtgtcttcttgagacaagatgtttgcccagacatagggtaggaggacaatttaggccagttacaaatctctttctaattttgcacaagctgaattagtttatcttggccattctcctggtcagaagggagtgatggtggctatggtggcacttaaagcttttgcagccacccctttgctctcttttctgccctggtccctcttctctcctccaagagcaccatgccttccagacaaggtggccagtcctgttgctcctccagtctgcacccttccacaccctcctttctcatgacattccagctgtctggaatatgggcttcccaccctcccattcacctaccctctcacctggtgagcttactctttgatgcccagctcaaacctagcttgaagaattggtgtcaccttcatctgagtctcatagcatttttcttatacctcagagtaaacaattgcatgtcattatatggcatttaagtttgtctccttagatagcctctaagtcccttgagggcagggactatatctcattcatctatttgtcctcagtagtactcagtgcccagccatagtaggtgttcaataaatatttcaatgattgaatcattggcctgggttgagcctcatctttgaagtgaaagatggggagaggtataaatggtcgtgaaatacctggctgacacgcgtctgactctattttatatatttcaaagtgaggaaaacagaaacatatgcaaacacgctgcaattgaaggcactttgtattcctaaggggaaggacttggtgaccacacgggttcccagacttaaccttcagatcggagaaacctctgctaattgccagctgctgccatcatgcttgagagtgatttgtatttgggtttgcctagcccgctcctttacacgcttgggatttaaccacctgacaactgatcctgaatcatgagcaagcagctttccatcgctcccaatctcccctccatctaatcagtttgctgcgagctcacagctttcaatgcatgccattggaatgacgcacctgaccgctagctgcttctaacccagctccacctgagttcaaatctctgcaacggaaaactaaacctgatatcacctttgcaagtcaagttgataaattgagtttgtttcttttgtttctcctttttgatgaacctccttccagtctgttgttttgaatttttattacacttgctttgttttctttgtttctctctcccttctctcattttgttttttccattcttctcattggaggcaatgagccgtccagcggccggaactcccctctcccttaccggccagacagccgccctctaactccaacttacgctcaggcccctaaacatttccatgttccaggtaggagctgacacagtctgtgtcttggtgtcctgtcacagtgtagaatgtagccttgtaacctcgtcttgtctcatctctcatgctcttttaattgggatgcacagttaacaaaccctaaattgcaggatctgacctagggggcctttcaaaagttttatgtgttaaatgccaggattatgttgaaggtttatgttttctaaaataatttttgaagagtgtgggtgatgggtaaaagcagttgggttgttttgttttgttttttactaaaattttaattgtacctttttatcattgccttctgagatatctttctgtggtttgctgtcattgactaattatggcaatggcaatctagttatcttctcatcctaaagactgaaccacagtatcacctgagagaatacttttatatttcctgtttttctctaatgtggagactttctccaaggacttttcagagagatgtagaattgggtgaattggttggtctttctgcagcgcataacagactagccatctccatagcccgtgaagatatcttgcaatttaggcttggtgctgcaagctttgctctagtagtcacaagcatttgctgtcataatgcaaatagtaatttgacatcagaaactgaaataatcagagcccattaatataatatcttaatgtttagaatcagctcactttgtaaggacaggattagccatcagaggtaataatactatatttctaccagcagtatattgttttttgctttgtttagctactgaaagtagtttaataaattacccactatattaatgtaagtgtacatatttagaatctataatcatttttttcttttgcttctaaacttacctaataaaacagaggaaagttcactgagatttatatcacttagttgggactgtcctttctaaaaaagtttaattgaatcttgaaaattaatgttctatatctgggatttttcacataaaaatgccccaccaagatacagtgcccacggttctggggaaacagaaaccttttgaaatttcctgagtatttatagttaaagcaaaatggttccataatccaagggggtcttgtataaatatatacatagtgtttagcatctcttttctttttcattcattctttttttaaaaaatttggcctgtataaattaggatttgttgaacatcccatcagcacaccaggctagccttgcacataaaaagtttctgttttttttaaaaaaacttttgatttttctacattgctttccactgttccactcattagttgaaaagtaaattgagccactggtatctactgggggctcaatttctagacaatagcaatttgggcattttccccaagctggttatgtctttctcaccataagagtacctccactgcttgcgtttcttcctgttttaatcccactttcaatgaagtgtgtatttgaaataaatggctcatgagttaatcacatctttatatatcctaagatgtattacaaaggcttccataacacttgtctatagtaagccactcatttctataatttttctttcaataaactcaatctttgtaatacagaaattaaccttctgggttgtttttgttcaagatcttcagtttgatttgccccttggttgatctgtttttcccatcgctgaactggttcccataatcacacacctttgcttttcatttccacagatcaaggaatcaacatttaccgaaagccacccatctacaaacagcatggtaaaacccgctttcctccgcgtagcttttaaatagcaaagtcagctgaacttctccttgctgtcctctgaaaggcttttcctgctgctgcttttgagagtaaaactggggcatccagcatattatgcctttctggtctactaagatgtaaatattgtaaaattgattctcctggatggagagacttagcttgattagaaagcttctaacctgttgctgagcccatcaaaccatgtatcattctgttcctagagaaggggaagtactggtcacacagcaactcacaaacatcctagcaagtcttttttctttttgccatcaaatatagtcaccctttaaaataattttgatgagactaatttaaactggtgaaaaaccagccacctagaaaaactaatttgactgagcctacatcaacttggctgtccaggtctccagtttcttattgggcatgaagatgtgtgcacagtggagtggacaggatacaggctaacacagaggtcaaggctctgctcccactttctccctaaatggctctgtgacgtcatttctctgtgcttcagttttctcttctgtaaaaaccagttagttagatcagtttgtctctgaacttcctgcaaactaagaatcactaacgtggatgtataattctgttttcctttttttaactcaggaactcacatgactttatgtaaatcacattttcctccaccattattaagtctctgtagatatatcgaccataaatctttgtgaaaagatatctaaagctggtcttcaggcgttttcagaaaattctacacagattgtgcctggaaatttgaaggctgcctttagaattcagctgacattcatgagtccttaagaattaggataacatgaggccaggtgcagtggctcacacctgtaatcccagcactgtgggaggccgaggcaggtggatcatttgaggtcaggagttcaagaccagcccaaccaatgtagcgaaaccctgtctcctctattaaaaataccaaaaaagttagctgggcgtggtggcgcacacctgtaatctcagccacatgggaggctgaggcaggagaatcacttgaattcaggaggcagagattgcagtgagctgagatcacaccactgcactccagcttgggcgacagaatgagactctgtcgccaaaaaaaaaaaaaaaaagaaagaaagaaagaagaattaggacgatgtgaaaatcaaaatcaaataacattgaaaatgcgtaaggaaaaaaattttagaccaaaatcaggaagacaaagagaaatgtatgtatcgtaatggttctagagctatgattttttttctcatcttttttttttgaggttttaaaccatacgcttgctttttaagtttgttaacattgtttttgtttttgtttttttttatggtttattgtctttccacacactcattaacatgtgaatgtttaactactgacttcaccaattctaatgcgtaagtactgtttgaagtcatccttttgttgttaatttaagaataaaattctcagcatttgatttgtcaacttacaggctttaaaaaatactatctttaggtcctcctctctgaacaaaaataatcaaataattaaaatttaaggagattggataatgttagattatttgtttggaaggaattagttgacttcttttcataatatttactttgactgaagtctttcaggcctttgttataattaattaaaaatagcccagccagagcagcgctttccaaaggatgtttttgcaaaacagccattccatgccaaagaaatagttgttatgcccaaaactggtgtctgtgccctgatgcgtttgagaaaggctagatttaaatcaagtcacatttgttcttcataatgcagaacttctgagaacttcttatatgctaacatgttttgtccatctttaagaaggggatttcctatgtagtgttttccaagctgaaatggttttctcatgaggttagagattcagaggaacactgtttcatgcctggccaagactttacctcctaaactgggcacagtggcccacacccatagtctcagctacttgggaggctgaaatgagagacctgcttgagtgcaggagttagaatccagcctgcacaacatagcaagaccctatctccaaggaagggaaaaaagactacccctttgtattgggtgaccttggttgagttatttaagcaaattgagacccagaaggttacccgaaaaatggaggacttagagctgaagattcaaaaggttatttccagattttaaaatatgtaagcccagaagaaaaaagttatttaaggcattataaatacattttgaaatatttagtgacatccctggccgatttgcaaaattagccagaatcagggactgtccatttaacctggtttgttttgctccatctctgtaggttagatctggggctctaagctgtgactcctcctctaagcatagccaataagaactttgtgaactaatattgctgctagtttggcttttgttgttttaaagttggataactcacttgtgtgcacagacctttgaacaaaacaatgagtggaaacggcaaacataagtttcaatgccaaattcctgcaagctgaaagtggattttccaatttccatttctcctaggactcaaggacacatgtatttagtatataaggattagaatgaagtggaccagacagggtgtggtggcccatgcctgtaatcccagcactttgggaggccatggtgggcgaatcacctgaggtcaggagttcgagaccaacctggccaggagaaaccctgtctctactaaaaatgcaaaaatcagctgggcatggtggtgcatgcctttaatcccacctacttgggaggctgaggcaggagaatcccttgaacctgggagacagaggttgcagtgagccaagattgtaccactgcactccagcctgggcgacagagtgagactctgtctcaaataataataataataataataataaaagaatgatctggaccaacatatttgtggcttcttgcccaaagatgcaaagcccgccaaccctctaatgattaacaactacagtcaagtgatagcgtcatgctttcaacttagctctttaattttagattactaattactctaggagagtgttgtccactggaactttctataaggatggaaatgttctatatctgcactggccaggacagtaggcactaatcacatgtgactactgagcagttgaaatatggctagtgaaactgaggagcagaattttaattgtattaattttttttgtttaaatagcctcatctagctagtgctgggcagcactctagaatagggtttttcagatgtagaacacatgtagaatgaagctttgcttctgacgtaaagtaaggaaaatgagttgacttgtcaataggtacctctgagtgactgggccatggataatggtaataaacagaactttctggaactgaaacttttgccagagaacaagaaaactatgtaagtggggttgtaccgccattgtcttacagaccaatagctaagcaacccctgattcccatctagatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggtatgcaactgtcacggctaagtcaaagggacaaactgctaggagagctcaagatgacatgcttaaaaacatgaaagaaaatgtatcctattatgaagattttaaagaaaagtatgaccaagaggtagcatagtgaaaagaactaacgtggtattaacttgttgtacaaaacgcttaaaagttacaaaaacacatccaccagagtcttgttctaaccaaacccactgggatccagaactggtctaaaaccaatggtttgcatggactctcagagttaatactgcagaatcagtaactctgttgaacatagttgagtgaaagccttatggcaagaacattgttctatataattagagtctagtgggtgaatttaccgaatgtttgtagaagcatgacttctttcagttaaatttgttttagactatttctgggttgtagttataattcttaacaaccaatcttaacactgaagcactttcatttttcttgtaagatcatgttgtccatcatgcaaaagggctattgcagagtagtaggtgttctgaaatattacttctgtgaagttatgtgattttacatctaccattttcatgaattctgtgctaaaatgtcatatttcagctgtttcattctttgctccatgctttccaattatgtctgtgtctttactatattatcagtagtgaacctactcggcctaaaaagaagtattagcaaactcagaagctaatactgaaaatttagcgagtcagctttacaaagacacgatcttatcacatttctgttaacaacctaaaaggccttcaattttccaaaatgtcctaatcttcattgtgctatttttaataagttatttttggaatatctttcacaagcaatacaagtggattttaaatcaattgatacttatagaaagagtttaaggaaaaatctacctcctaagttcattattcacaagtgttgtgtacattatattaatgaaatttatctagtccttgcaaacttgtgcctattgattttcattagtgtaaactaaagagagaaacttcacactgacatttataattgtaagaactaagaaccaaccatcagcttttctatgccaatccatgcccttcaggaagttcttgaggccttgaggttgctagtttagtaaattgcttactgggacattaaagcagctacattttggaaagagggagaattaagtttttgttgttgaatttattatcactaagtagtttaaagctcttttagattccaaaaggaggaaaaatttcaggtccattaatcaaaatgctgaaaactaagactattagttaaagtttattttgattagattagcaaactttcctgtttcctcccacagccagattaatccaagcaatttaggaaaacaataattatcttaacctctcaaccattcagacagattcctcctttcctttccctgtctcccctttccagaaagctaaaaaattgaacacaatttactatattgttccaaagtaaaattgtacctgtattaatgcttttgatttacctattagtataaaactcttttgtgaccatttttcaaaggatgagaaaaagaaaaccttagagacccatttctcgaaagaaatagtaaaagtatgctttttattgaatttactaagagtagaagacagagtgatagtattatgaaattctaaatattcagaaaaagagaaaactacaaggtttaaacgcatgtcacaaaacaatgactatcttacctatctgttggtatgtagataaatttgcatttctttctatttgaaaattgaggctgggcgtggtggctcacgcctgtaatcccagcatttttggaggccaaggcaggaggattagttgagccctggagtttgagatcagcctgggcaatatagtgagaccatgtctctataaaaaatatttaaaaatcagtagggtatggtggcatacacctgtggtcgcagctacccaggtgggtgaggtgggaggattgcttgagcctggaggtcgaggctgcactgagccatgattgcatcactgtactccagcctgggcaacagagtgaaaccttgtctcaaaaaagaaaggaaaaaggaaattcacttcaaagacatcaaaataacaactggagatgcccttccatttactaaagtgatctctgaccagtgaacttagactaagttgcaaacccagttctaatggagcagggaggcctaaattcaggccttccttgcattgcacgttgacctggcttgtcacacagggccattttcttgagaaaccagccagtagtgctgagttggtggcaggcatttttgttttctcttgtattgtttacttaaaagtgttaaagaccgttgctgaccttgccagcctaacaaactgaacacagatggactagcccgttaagattcccttgtcttggggctgatgtgagaagttgtctttgctgtggaattaggacctgacatgaaacgcagatctagtggcagagaggaagatgatgaggaacttctgagacgtcggcagcttcaagaagagcaattaatgaaggtttgtccttaaactaccttgctgctgtcttcaatgctagttacataagatctatattttttgaatgactactatgtataaaccatctagataggcaagaggtggtcccagtcttcaaggggcttgaaatctggcaggcaaggcaagacaggtgtctgttaatagtaactagaatatggcagaatacctgctgggctctagaggagatggcattggtgctggaggtcagaggggtgtggaaggtttgggttgttgtgggaaggaaagagagaccacatgggggcatgtgtgcagtgcatgtgttgaaaggctgctggagggccaggcagagcaaggtggtatccacccaggtagtgccacaccttccttccctcatgcagttctgctgaaggaatgactgtgggattgaacatttctccaagtcttttcccaggatgtgggccaggagaaaaggaatgaaaggaacggccaccatgaaggggtcctcttcataccctccttcctgtagcaagggcctgcagcagcccagaaggacagtctgttatcagtcaagaggctgctgaatcctttcaaatgatgttttctaagcatataggaaatgcacgtgatattagtcaaaggatacaaagttgcatttatagtatgatctcagttttatatgtgtgtatacaaaaatactagatagatataaatcaaaagatagtgttatttctgagtgacatattatgggttactcttcttttcttctagattttccaaaatctgtaaaattagcatgtattacctttatttcttgtttttaaacaaatcaaggcaatttctttttaaaggataccagccccagtcttcccttcccacatcaaaaatccacacacactcacacatgccttctgaggtctcctggctctttagggaaagcagaggaaggaaaacgttcttctaacacagagcctgacttagggaaatggagctttgaaactgaaagggctaagagggtttagggtcccaaacttgacctacctcttcaggaactaccaggctctggggccacatgcattcaggccctccagcaagagaaacttcttgtgggatctgctacaaagaaactgcagctccatgaaagtaattgcaagctttgctttcttttttttttttttttccttttttctgtgaatagcttaactcaggcctgggacagttgatcttgaaagaagagatggagaaagagagccgggaaaggtcatctctgttagccagtcgctacgattctcccatcaactcaggtaagcagcaaacccccaaccttccctgattcgagagccagccacctgcttgtaaggcacctgccttgactgttcacttgtggtggaacctacagagtattccacgggaaaggaagtgtgggaaacccactccatgtcaaatgagctcataagcatgtcatgggtcttccataaatgtgtgtttcctttcttctggaaatgggtgaacccttggaggttctcaaaatccatgaaggccaatccccatatactaggtttgtcttctagaacactcatctccaagggaagcagcaaaaggaaatcctctaaaaaacatgatgctttttttcttcttctttttttttttttttttttttagataacatgaataagacattttctaagcattatgattttacattaatatcttcaatagaggccgggtgcggtggctcatgcctgtaatcccagcactttgggaggccaaggcaggcggatcacctgaggtcaggagtttgagaccagcctggtcaacgtggcgaaaccccatctatactaaaaatacagacattagccaggcgtggtggtgggctcctgtaatcccagctactcgggaggctgaggcaggagaatcacttgaacctgggaggtggaggttgcagtgagctgagatcacaccattgcactccagcctgggcgacaagagtgaaactccatctcaaaaaaaaaaagaaaaaaaatcttcaatacaagaactgaggatgaacagtgtttttgatacttttgaagaagatgacttatacactgggctgaaatagcctatcagtgtattttcccctgtatctatttgtcataagccaattctctcttaaaccacaagatttcttctctcatattctgagctagagcataattttctcctctaagagttcctttaaaaatgcatttagtggggagaccaaggcgggcagatcacaaggtcaggagatcgagaccatcctggctaacacagtgaaaccccgtctctactaaaaaatacaaaaatcagccaggtgtggtggcgggctcctgcagtcccggctactcgggaggctgaggcaggagaatggcgtgaacccagaaagctgagcttacattgagccaagattgcgccactgcactccagcctgggtgagagtgagactctgtctcaaaaaaaaaaaatgcatttaatgttcactccatgcaagcatttttgctaaacattttatttaatgttcacaacatgccagtgaagtagatgtggttgttattagcaactgcagcattttcatctctattttagaaatcaggaggctggtatagaaattgagttaacatacccagcgtgatacgccaataactagcaagactaggatttagaagtccacatattataaccccggagcccacacccttacctggaattcccgctacccttcatagatgcctcactggcattgatcttggattcggtggtttacaaatctttagagttccttggaattctgagattctgctctataagaatgtataacattgtacctgcatagatgaagaaatgaggacttcagaaagattaaacaccatgtccggagatacagaggtattaagttgcagaaccagaattcaagcccagggctgctccctctcaagcccagcagcttatcaggcttccatatcattgacagataccctgtatcaggcctcccaggaggccagctgtagatggctggtagatcttgataacatacagggttggcttccagttcagttactgctgccttatcaactggggcatgggctaatgtattcagatatccctgatttacatccttgctcagctgtttagaagcttagtaactgttggcaggatatttttcttagcccctatttctccttctgtaatatggaactaataatcatagtgttattagggttatattgaagattcaaagaaataaagcatgctgaacacttagctccatgccagagctataggaagcacagccagcttcagcccccactcaaccgcgtggacttgactttcccttccctcctcagtcatatcactgtccacccactccttgcaaatatgatggcatatttttgaacatttgagcccaatatgatttgaatttttttggtatttctatcctgtgaggtagaagatactgccaatttcattaaaggattggaccttctgatttcctaacaattggttttttacttttttcttactcagcttcacatattccatcatctaaaactgcatctctccctggctatggaagaaatgggcttcaccgggtaagatttctccccgattcattgtttctgcctttactcccacctcggccctggttgaagtattgacacattgcctgaatacgtctgactcttgatctcagtgttggaacataatgaaaattttaacctccctggttgcctagtaaattaatttgagttacaggcaaaataaaatgtttctattgagagaagaagaaattaactttagataaaagaatggcttgtgtatgattatgggaaaactaaattgcaaaactgtatggcaaatattttttacaatgaaacaaaaagtaattacttgaaccattatctttgctgtaaaaagatataagaatgtgtgttataaccatcctcctcacaaaagatggaacaaatacaattatgtaactatgtaggacaatgcatttttatttatcagcaagagatccctgcttaccaagagcctgctgagtggtggcattagtacactaaaaaagacaaagagatggcatagcagtagaagaatcatagggaaaaaaaaaatgaaggtctgacatttagcttgggaagaattcctaggattttgtaaactctttcttccttttcacctgactccaaaacgatcactatggagatttcctaataattgtttttcctcatttcagcctgtttctaccgacttcgctcagtataacagctatggggatgtcagcgggggagtgcgaggtgaggctcccatggccaggctgagcatggccacgtcttccctcgaggctgaggttcatgagagtcaagtatactggctgtgttcatgctgtattgtatccttagagtaggatcacatctgtcttctgtgagctaatagggcaattatttacaaaatttcaaagaatatctaatgaaatcaaactgtaagaagtgagtttgtgagaatttattcattgctcatactatgtgctgagcactctatcagatacctagaggccaggcatggtggctcatgcctgcaatcccaacactttgggaggctgaggcggaaggattacttgaagccaggagttctagactaggttgggcaacaaagtgggcctgtctctaccaacaacaacaaaaacaacaacaacaaattataataattagctggtggcacatgcctgtagtcccagctacttgggaggctgaggcaggagaattgcttaagcccaggagttcaaggctgcagtgagctatgttcatgccactgcactccagcctgggtgacggagcaagactgtctcttaaaaaaaaaaaaagtaactggaggtacaacaataagtgagacatggcccctgccctcaaaatgcatatggcagaaagaaggtctgtgtgatgaacattgggatcagagatgcagagaaggaagcagtaagtacctttaggttgtcagcgaaagcttccaggggaaaatgttttaactgttaactaacactggaccaggcatttcttggcttcagggaggctgatgggataacatgtgcagagtctgggagcagaaaaagaacatggtttatagggcgaatatgttgggaatttcaatataatatagtctgtgaatggttccttgcttttccatggtctttcccttatgatattttcttttcctttccttttcagattaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgttaaaaaaagaaagaaagaaatgtgatggagaataagaaaagaagaaaaatgcatagaaaatcatgattaaagataagaaactaacaataatagacttgggcatcttttaaatgtactatatgctttcattcatggagcctaattcaggaatttgtccataaccatcaagccaagatctctccccaacttgattgcaaaagagctgtattcctgttcctatacagcaaggatctcattttgaaaaatacatggtcatttagatgacacaaataaaatagtggttaggattggagacccaacagggaattgggagcccaagagtactcccttcagtttcctagactatttcatgcctcacctggaactggcatttctgttgcagacactcccagatggccacatgcctgcaatgagaatggaccgaggagtgtctatgcccaacatgttggaaccaaaggcaagtgcagctgttctttttcctctcatatgggaatggcgtaaccctaaacagatttgatgttctatcttttcatcattctcaaagtgttgtaggctggtgtgttcaggtgagccatgtcatgaatatgcaccttgccattctgctgttttgcccacatcaggtcagcaggttaaacccttactgggcatgatgctgtgtgtttacagtgaggtgccagtccctctctgcctatgaccaaggtattcccttggcctctgccatgtgcattacagagcatatccggtgctgagtggagtggctgcagactcaccatgtaggtgaggcaaccctgtttcaccattgaaagccctgcatttcaagaacctcagtcctgggtacactggggtgactggccaccctagctccagagcaccctgtaccttcagagttgtccaagggctcatgctccctggtgaccataaccagggcttatttcaatatggcagttgccagagcactgcttctgggcctgcctggccccatagattcatgagctagtcatgggacaagattgttaaccccagcacaaatgcaccctgccctataacagcatcctataaaaggtaacacattggctgggcacagtggcttacgcctgtaatccaagcactttggaaggccaaggcgggtagatggcttgagttcaggaatttaagaccagcctgagcaacatggcaaaatcccatctctactaaaacttaaaaaaaattgcttggcatgacgacatgtgcctatagtcccagctactcgggagggtaagataggagggtcacctgggcctgataggttgaggctacagtgagctgtgatcacaccactgcatccagcctgggcaacagagcaagccctgtctacaaacaaaaaaagaaaaacaaaaacaaaaaacacgtgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggaggtaaaacaaaaccgaaaaatccagtcccaactgcagatccctatgcactcccccaactctcccctaagcaatgttttatttcttcagtgaaaacaaaaaaaaattataaagatcaccctcatgtcataggtagaactaagaaataactttggagaaaaaaaatatccaggttttcacttagatcagcataaaaatgcctggtaatatccagaagaatgacccaggaggtgggcatggtggctcacgcccataatcccaacactttaggaggccgaggtaggcagatcacttgaggtcaggagttcaagaccagcctggccaacacggtgaaaccctgtctctactaaaaatacaaaaattcacggggcatggtggcaggtgcctgtagtcccagctacttgggaggctgaggcaggagaatcgcttgaatccaggaggtggaggttgcaatgagccaagatcacaccactgtactccagcttgggcaacagagcctgactccgtctaaaaaaaaaaaaaaaagaaagaaagaaaaagaaaaaaagaatgacccaggagacacagaatgatttcagtcattttctttgaaacttgatgttgccataattatggctggtaattcagaatgggagtcgctatttctcttgagatagtctcagatccttatcttcccctgagctggggttgagttcatgggaggctgtgggagcggcaaaggctctcaggagagacatttatactgatttatactggacaagtttctttcttggctgtttccacattccttgttgaagggttatctgggtacatgtacccaagatctccttagacatggaagactaatttttgtattatagttttccatcccaatgattttaattaagaaaaaccctggctgccagtctccgaaagaatgcttactttttcctgacaaaaggcagtaccttggcgtagaggtacagagaataaaggctgcaggatcttgggggaacttttctaggggggaatgactgatgggaagtcttctcagtagaacagacatccaccttaccccctattcctcagccaggaggaagccctggggctccccagggaccacgctggaggtcattttctttggctttctattgcgatagtccattttccctgcatcttctcaacgttccaaggacctgggatggagttgtctccaatgtaataaatcacctctctgtgtcccatcaccagtcagtgttattattataatccccattaatactctgccagctcttttatctgatgggaagggctcctcacctggcccaaccaggtaagggatactgatgtcacaagcattaaagatgggctcctctcccgtcctcctgccttgttcttcagaatgactctgtataaactatagagcaacgctcaaggccatttgtgtggccatcaggactgacagcagctcttttttttttttcttcttcccagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagatgcctccatacctgtgtttcatttctcgttccctggctccctttgaaggtctatctcattttaaaaagcaccaacgcaacttccaataatcaaaacaaaatcagaatgaacccaaggctgtgggaatgcatttttatcatgcaggtggaaaaatgcagcaaataacagcaggatattccaggactatgtgtccaataacccagaccatattgaccaagctgtccaaaggaaagaaatgtttagtagagccattacactgtgctgtgtcatgggtgtttgatttggtttgtgacacagcagggatagtcccatcatttcgacaaagctggggatttgaggaggtttgaagcttctgagccactatgagtgtgggccactttttagtaagaagctagaatgcagtaggagaaaagcatccttccaattttgggcatcccctgcatgatcaaactttacatgaagaaattgtagatgttaacttccttgttatcatcactgccaagattttaggcttgccagaaagtacaaggatctatgtccaagatggcccactccaacgatagccttccttctgctctgtgtctgctgagactacccaagacccagtcacactggcattcacatgaccctcccctggaagcgggatgcaggttgttttcaagacagttggcatctttagttcaccaccatggaaaacaggccgggagacctcagctcaaggtctgtgttctgctcatctctgcctccacccgtgggaaagcatccctgctgtggtccataattaccatagctaggggtcatctccagtccttatgaactctctgtgggatttggctctggtggccacctctccaatggaagttgacccgtgcctcacttcagttgctagactttagtcagcgaatctcacactgcctttgctgggagtggaaggatctcgcctcacccactgctcagctgcctctcccccagtaccctgccttcagatcttgccaaaccactgcaagttcccaggacataccatgcttgctccctcccaggcagctttatcaaaggtatttcttctttacgatgctcaactcttcaaggaggtggtggagcagagaggacctggccccagggaaaggaagtaatgatcaatgttgactctttaaaaacagctacccatcagctctttggagttacccatgtgaatttcccatgggctccatttgttccaaattaaagacaagtccaagttcacaccctctctatgagcctgtcttaatgggcccagcccaatctgcatgtaattctttgcatgcctctagttgaacctcaaggtcggtacttagcaagtgttgcctcgaactgctagctgcgtgggtttctgctcttcagttgaactgtagtgagatctctgtgctgagcgccaggcaccctagcttggcataactatattgctcgtgagagcctttcaaagtagacaattgtagctccactatacaggtaggaaaccaaagctcagagtctaatcaaacatgcccaatcactcagccagtgagcagcagagctagaattctccaggtctgcccttttcagatcccatgctgttatcctccacatcccattccctgtgactttcttagggcaaggactgtgtcccacattctgaatctcccagggcacactgcacagagtgggttcttagtgtgagactggccagcgcccttcagtgtggccatgagccccaacactaccaccaaggcgcatttatgaacagtttgggggttactcactgtctgtgtgtcttggagcctgtttagcctctcttcagcctcaatttgttcatctgcagaatggacaagataataatatccatcaaaagactgttgccaaattatagcacgtgagcacttaggtggttgaataaggactagtattattttaaataatcatttgagaatgaattagttttcactctgggctttttacccctccctctagtcattttgtttgtgttcacagggccttcctcatggattctccttctagtctttatataaatactccaggattaaaataatcccacgacctcttttacatacttcaacaacagcactctctccacccaagcatagtctaagatagagatcccctgaagatgtgctaattagtagtaataataaccagaagtattactcagcagccgagtgcagggtatagcatcaggctgcctgggttcgagtttcagctccaccaatagctatctgtataactaacaaattgtttaacttctctaagcctcaatttccatgtccataaaagaggaataataatgatacctaccacaaaaggttattatgagaattcctgcaggacaagagcctgcatgatactaaacgagcacttaaaatggcttttattcaggcccggcgcggtggctcatgcctgtaatcctagcactttgggaggctgaggcgggcggatcacgaggtcaggagatcgagaccatcctggctaacatggtgaaaacctgtctctactcaaaatacaaaaaattagccaggtgtggtggcgggtgcctgtagtcccagctactcaggcaggagaattgcgtgaacccgggaggcggagcttgcagtgagccgagatcacaccactgcaccccagcctggtgacagagcaagactccgtctcaaaaaaaaaaaaaaaaaaggattttattcatgaagtagctgccatgtaataagtactgtttgcccagccccgaactaaacaatttctgtggtttctttcatatacttccttaggttccttccattttagttaaggaaacagacccagagagactgtctctgagtagtggggctgagtaggctgaggtgggtggatcatcacgaggtcaggaaatcgctaccatcctggctaacatggtgaaaccccgactctactcaaaatacaaaaaattagccaggtgtggtgatgggcgactgtagtcccagctactcgggaggctgaggcagtcctaaacactgcctatgggcaagtgtcatgccgagaggggcacaggtgcccccaaagcactgtggccacccagcatggcagactcctcaaactggaagcgttcagaggtgccaggttgggactcagctgctccagagggttttcctgggttgggaggattgtcctagcctactccggcggtgcttagaaacactccctgtggaagagctgagactcattctcatgaaagatggtgtttgttccagaaagatcttttcaatggtatgactcacttcaaagcaaccaaaggctgtaaaagttgagctgctggtcctgagagtattgagggagaaagccaccaatcctccccagcccctcttgcccgttgctggaagaaggctactcttccccacaggtcattgccagggtgtgtctgtcaggcccaccctgctggaggtggcccactgtgggccggaaagcactgggaagggcggggacttggagctgtcagcgtttgagaaagccagggtggttgggagaatagcacccaaaacttcagggaatctcgaccccagccctaagaactcacttccgcaccttcttccccacaggagaccaggactctgaacaaacacttcccttctactctggcagagctcagggataggctgtagcgagtcgggtctgcagaagagggggtaataggaccacatttattttactttccaatctccactggataaaacttgctctccagggcctgctattgtgctgaacacaatcacagctcctggagaggtttttctgtatttatttgtgctgtcccctgctgctcactcttaactcagcccttcccatcagataaaaagaaaaaagttggcttaggaaacctccccttcagagcagaggctgttcctgctttgcccctagcatatgttagccataggccctcccagagtatcccgaaggggctggaggcagggcagagcctcaggggtttctagccccagatctagccgggttgagacccccaggtgtctgagtccaggcactaagaagagaggggtctgatggcagcagcagcgaacattctttgcaggcctccaagtgccaggtgctgggctaaatactctacgtagattattttgtttaatctgagaagggcaaacccaaggctgggcgagctccactgacaagtgggtaggattctagccccctcccatcaagtccaaatgccaccttcctcctaaggcaattacagctctctggggtctccacaaggccttctaaggatgtcaaaaggattgcctacaaagacaaataccaggctttctcagcaaggtggagcctggccatgaataacattttgttctaagctggacggatgctggcacagaaagaataggttctttcgttcctgctattgtcttaaaacatatgcttcttaatgaaaagttagaaaatgttgatgccagttacattcccatcagataagagcgagggtcagctggcttctcctgttgaaaaaaacaattattatgcccctcctttacataaaaacaaggtgcttcatacaactcaagagtaaattgctcggatttattaaccattttttcaatcaaatggcttccacttgcacagacgtgatctatgatcctcacgagccacctgggtgaatgttgctcccttcgatacacagatgagagcctgcctggcttgtcgaagctcaaagggagacttggggaaggagctaagatctggacccaagtctaaccccaaagctcaggcttcagtccacaaagaggctttgattgggtagatctgggttaggagctgggaagttgaatcttacaacaaaatataaaagcctccagataattctgatgatcaaccaagtttgggaacccttccccacatcccaggatctcaggtcagtggcagagctggtctgtgatgaaccaagcatcccttgccaggatttgttatcactgtcgccctaattcacaagaccacagtcagacaaggcctgggaaacctgccctcgctgagacctccatgggaaatcacccacatcttccttcagctcggcaaggctcggaatgcccccgggacatcccactgcagtctgctcaagtgtcaccttatttgcaaggagattatctcttgtaaaatacaaaagtatgagatgagagaatcagttaggtgcacagttgcttaaaggaaaagcaatccaccagtatcctattctccctttctcccctcacaatcttgagaaacctctgaacattgaaaaaaatggcctagaaatgttattattgtaccaacttatttccttttcaatgtactctcgttctcttcgttctattgttaggaaggtgagtataataaatgctggtcttaagttttctgtggagacagtcacttcagggaaacttagtgactgtcctcagggcctggctggagggagattaagagcaagcaagccagaagttgtgattacaaactcttcttttacagaaaggtggctgtttttagttttgagcctttatatcagtgcatatgtagtgggtcgaaatagtgtctcccaaaagatgtctacctggaacctcggaatgtgactttatttggaataagggtctttgcagatgtaactctaccaaaagacacatgcactcaagtgtgctattcactgtgctattcacaatagcaaagacagggaatcaacccatgtgcccagcaatggtagattggatcaggaaaatgtggtccatatacaacatagaatactatgcagccataaaaaaagaatgaagtcatgtggtttgcagcaacatggatggagctggaggccagaatcctaagcaaattaacacaggaacagaaaaccaaatacggcatgttctcacttccaagtggaaagtaaacatcgagcacacagggacataagtatgtggactattagaaggttggggaggtgggttaaaaaactacctatggggtactacactcaccacctgggtgacgggatccatactgcaaaccttaacaccacacaatattcccatgtaacaaatctgcacatgtgcccctgtatctaacataaaagttgaaaaaaaaaaaaagaatcaagatgaaatcttaactaggagattaggtaggaggaataagttcaagagatctcttgtacaacatggggattgtattgataacaatatattatatacttgaaaatcagtaagacagtaaattttaagttctctcaccacaaaaagtggtatgtgaggtaaagcacatatcaattagcttgatttagccattccacaatggacacgtttcaaaacatcacgttgtatcccataaatatatgcaagtattatttgtcaattcaaaaattaattttttaaaacactgcctaaattaggctgttcctttgaagtatgaagtaagtttgattattaatcactagaaagagactatatttgctttaaaattaaaatagaaatcttgacatctcatttctattttctgtaattggttatttttaagcaatacaaaatgccaagttcataaagtttattgtaatgagtctgttctggctcccagaagatgcctcagttcaaatcgctaagctttacgctcaccatttctcaatctttgtaattaaaacaacaacacagtatttaaatggatcctttccattctgggacaaaatgttctgtcaaagacaggacacgatggctcatgtccgtaatcccagcactttgggaggctgaggtgggcagatcgtttgaggtcaggagttcaagactagcccagccaacatggtgaaaccccatctctactaaaaatacaaaaaatagccaggtgtggtggtgcaggcctgtaatcccagctactcaggaggctaaggcaggagaatcgcttgaacccaggaggcggaggttgcagtgagctgagatcacaccactgcactccagtttgggaaacacagtgagactccgtctcaaaaaaaaaaaagttctgtcaaagctttgaagttctttaagctctttccagctgggtatggtggcacccatctgcagtcctgggtactcaagaggctgaggcgggaaggtggcttgaacccaggagttctgggctgcagtccactatgctgattggatgtctatactaagctcagcatcaatatggtgaactccagaaaggagggaccaccaagctgcctaaggaggggcaaactagcccagatcggaaattgaccaagtcaaaactcccatgctgatcagtagtgggatcgtgcatgtgactagccactgccctccagcctgggcaacatagcaaaaccctatctcttaatagaaaaaattttttaaaggcctttccagtggtaagaaataaatttgttcttctttggccattgttttttctttgcccaaacacatcagcagaggcacgagggagcacctcctagcacacctagcacaagtgagagagctgtctgtccttctctaaagacagccaaatgctgctagatctgtagctttgttgtccaaggatgcctctctttctctgttgctgacgcaggtgtacctgctgtaaaatgttctgaaaacaggtcaggaagtcagcttccagatggaatggccttttccttgaatctctgaatctgcaacccttgaatggagaaagcctccttcccttgtctccaagcagcccaagaagtggatgtcccatgaaaactcatacatattgggaagaaaaaagtgcaactagggaaaaattgcccctgaatataatgaccctgtcgtttcacatctgggcctactccgactgaggatagaaagttgtctttccatttttaggcctcacacattactcctgtctccattgctactttccacctgaatttggttccagattttaaaaaatacactatcagagcactttggttaatcatctaactcagcaacactgttataagaaggcaacatagaggccgggcgtggtggctcacacctgtactcctggcactttgggaggctgaggcggacggatcacctgaggtcaggagtttaagaccagcctggccaacatggtgaaaccccgtctctactaaaaatacaaaagatgcatggtggcacgcacctgtaatcccagctactttggaggctgaggcaggagaatggcttgagcccaggaggtggaggttgcagtgaaccgagatcgcaccactgcactccagcctgggtgactgagtgagactctatctcaaaaaaaaaaaaaaaaaaaaaaaaagaaagaaagaaaagaagaagaagaaggcaacgtagaataaaataactttctggaggtctgggctagcagggggcattcaagtgactgcgcatgggaagtgtgcctcatacaatcagtgcctttgaatgaccacaaatgatgtttcctagttaccctaatttgtcttaattttcaatggcatacagagccctaaagcctttctaagatctcattgtttaatttcaggaacatctgtactgtatctaaagtgagaagcatgaggctggggtgttgtggaaaacatgaacatgaacacaggctgggactatgggagcaactgaggtgtgtaggctccaaatgtcaggcgatgctcactctagggcttacgcaaatgctgaccctgataaaacaatctctgccctcaaagagcttgaagcctggaagggcaacacaggcacgtaactaatagactagatttgaggcttaaagcagacgaaaaagttcacaaaataaaagcaaaaaaaggtggcccaaagacccaactataaaaccaaaaactatagaatttcttgaagaaaatacaggagaaaatttccatgaccttggtttaggcaaagggttcttagaattgataccaaaagcatgatccagagaaggaaagaaattgataacttggtcatcaaaatcaggaacttctgctctttaaaagatgttataaggagaatgaaacaagtctgagattggaaaaagcaattttcaaatcacatatctgatcaaggacttgaatccagagaaagtagataaagaactctcagtacaaagtattgcaaggacgcagaacaagtggaactcgcacactgatggtgggagtacaaaaggatacaatattttggaaaacggtttgacagtttcttttaaagatatacacccctaacataagacccaatgactccactcctatgtatttattcaagtaaaaccaaaaccttagttcacacaaaaacctgtacatgaatgtttatactcactttattcgtaatcaccaaaaactggaaactgcaaatattctttaactggggaataaataaacaaactatagttcatctatacaatggaatattactcaacaacaaaaagggataaacttttgcaacaacatgggtgaattgcaaatgcattatgctaagtgaaagaaaagccaggggttttcaggggataggatcgaggggaggggttgaccacaaagggtcacagggaaattttggaggtgatgaactgttctgtatcttaattgtggtcgtgattacatgactgtatgcatttgtcaaaagacacagaatgacgcactaaaaaaggtgcattttactgcacataaattataacaatttaaaaattgtgaaaaaagaagcagtttaagacaacaaactcttattgacaatgctagtgtattgggagctgtgagatgttgtaaagggagtgtgatacatatccaatcttgaaaaggttacatgccttgcaacaaactaggcactatgctaagcacttgaactaaaactgtgagcaaacagatattaatcaaataaccccacaaacataaacacaggggttaaagcatataaagaatgaatgacctgattgattctatcagcaaagcttctctgggaaatacttctatttgagttgcaactggactcaatatgggctgcagcagggtggaggatgaggagctgaggaaggtgcaaaggatgacttgtaagtttctggcttgggcaacaggctaggtggtggagcctgcaatgcgcgctggaggaggagcagatttggggtggagtgagagatcgtgagtccagcaaaaaaagaacaagtgtgaaaccacagagagcaatgcctgattaagcacagaactatgcagtggacccaacagaaatgaaaacaggtatctacacaaaaacttgtacatgaatgctcatagcagcattattcataatagtcccaaagtggaagcaactgaatgcccaccaactgacgaaaggataaatgaaacgtggtatgtccacgccatggaatattatttggtgatattaaaaaatgaggtactgatacttgctacagtgtggatgaaccttgaagatattctactgagtgaaagaagccactcacaaaagaccatgaaatgaaatggccttttggaatattgtgtgattccacttattatgacatttcaaaaatagggatatctatagagtcagaacacaaattagtggttgcttaaggctgagggggatggggagaataaagtggctattaatgggcatgaggtttctttttagggtaatgaagatgtaccaaaactaattgtggtgatagttggaaaactttattctattaaacaccactaaattgtagattttaaatggatgaactgtgtggtatgtcaattatatctcaataatgctgctttaaaaaataagataaataatctgcataaagatgttcttttttttttttttttttttttgagacggagtctcactctgtcgcccaggctggagtgcagtggcatgatctcggctcactgcaagctctgcctcctgggttcaacgccattgtcctgcctcagcctcccgagtagctgggattacaggtgcccgccaccacgcccagctaattttttgtatttttagtagagacggtgtttcactgtgttagccaggatggtctcaatctcctgacctcatgatccgcctgcctcggcctcccaaagtgctgggattacaggcgtgagccacagcgcccggccataaagatgttcttatatgttctatttagaatattgcaacccctcagtgggagaatggttataaaaattatgacccatcagtaaggtaaaactcagcacaattaaaaacacatccaatgacaaaaaagagtaattaatttggaaagatgtaaagttttgtttttattataaaaaacaaaaagcaaaaaaactacacagtaaagaaagatgcaatcacttcggagaagacagagatcctgggagtctggcaaaggtgaaactcaaaagcaagggccatgcatttctagagcttttgcaggagagcctcagaagtggctatgttggcttcttctgtgatgggaagtgggcaggaagcctgggcaggtgagaagtgggcaagaagcttgtgcagtggctcgcgcctctatttatggccaagagtgagggcttgaatttggttctctgcgcaggaaggaaggcactgctagaaaaacaacttgcggcccggcatggtggttcatgcctgtaatcctagcactttgggaggctgaggcgggcagattgcttgagcccaggagttcaagaccagcctgggcaacacggtgaaaccccgtctctacaaaaaatacaaaaattgaccggacatggtggcacatgcctatggtcccagctacttgggaggctgaggtgggaggatcacctggtcccagggaagttgagactgcagtgagccatgattgtaccactgcactccagcctgggtgacagagcaagacactgtctaaaaataaataaataatttcaaaaaaaaattaaaagaaaaacaactttttaagctcttagctctttcctccagcttagtcccccactccccacctacccacgacctgggcacttcctaaatgtgctcactatcattttcaagcactcactctgtcccagatactatgctaacttctttgtgtgcttcatcctacagaatccttacttgtttatgaaatagatattatcgtaatcccatatgtttgtttcatttgataaagaaatctggacaatgtcacagggatcataaatgatgcacctgtgctgcttctaacccaaggcactctgactctacaacctgaaggtcacatttaaatcaattcatgatccacactcaagaaaaccttcctcacagattcccacaactgtcccacttttacaccccacgccaaggaggcccacctattggctagaccatagattctaatgcactcagcacttgggtacttccagttgtcatttgaattaagcaataatagttgtgtgaggtaggataggaatcttccaagagccctgtctttgtcttatgcttctataacagaatcacagggactgggtaatttataatgaacaaatatttaattggctcatagttctggtggctgggaagtccaagagcctggcactggcatctggtgagggccttaatgctgctcatcccatggtcggaggtgaaagggtgagagagagcaagacagaaaggggaatgaactcttgctctgtatcaggaaaccactccctcaataatatcattagcccacacatgaggacagaaccctcatgacctaatcagctcttaatggtcccatcttaattctctgttgcattggggattaagttttcagcacatggactttgagggacacattcaaaccatagcaagctctcaggtcagtcgggacagatcaaggaacaaatccacaagccaagcacactcacaacttcattctctgaacagtccaagttgccacatcttcatgtactaacaggttaggcttcttctgaggaaactgcttcttaaatgcattttttaaaaaaattctgtttcttgacatcttggggcttctggttcttttctctgaatcttatgctctgaatgattctaagatattccataaacattacttgaattctaataaaaattctaatctagtgatagaatgggatccctagacactgtacgattatgctggcctggtttcaaatattctgccctgcttgggcttcctctataaaagattcccatttatattctctcagtcatttctgccagaagaaattatggctaccttaggctgtttccaaaaagaagttaggaagttgtattataatgatcctcctctctccctctcctccccttctctttctttctctctgtctcttttcccctccctcctcctacgtattttgatcataaaagaaaaacaagtatagccgtgtgacccagcaggaacactgaagcgatctcacagtagtacagtgttcaaaatactcaggacccactgtgactcctggttgcaggatgaactctccttgaagattttcttccataatttaccaacgtgaaattttttagacactttattgtggaccccatcagatgtcaaaataatatgcagccatcggcagagaaagaaaaacaccatttccccagtttggcaaactgtggaaaacagcagctccttcaacacttcgctccttaaactgtagcttaaaccactggcattggtatcacctggagcttgtcagaagtgtcaaatctccactccaaccctagatctactgaatcaggtctaaattttgaaacgatccccaggtgattgctatacaagttaaagtttgagaatcactggcttaaattaggctgtttttccagtgaggatagactttctggccaagtgtggtggcttacacctgtaatcccagcactttgggaggctgaggtcgggggatactttgagcccaggagttcaagaccagcatgggcaacatagtgagatctcatctttacaagaagtgaacaaaattacagagcatggtggcatgtacctgtagtcccagctactcaagaggctgaggcaagaggatcacttgagttcaggaggttgaggctgcaatgagctgtacggcaccactgcactccagcctaggtagcaaagcgagaccccacttcaaaaaaaaaggaaaagggaaaaaggatagagtttcctgtctccctctggggctgtaagtcccttaagggcttcatgcaatttatccaacaaagtgcctggtaccttgctcagcgaggtggagggtggtagctgagtgggtggtggatgggagccgggtggttgaaatgagagatccaattccaatacttagcactgagcaggactcttttgcctgtagggtgatggccattggaacaattggtagctctgttttatctgccacgggagtcctgtttcctatgacattatcacaatggtgggaagagttcctcattttcagccaccttaatcattattgcaactaatatcagttgtgaacttacacacagacactgagctaaactttttccatggattgtctcacggaatcctcacaacagcctctgaggtgagtagaattttcattcccatttgactgagggagaaactgaggtaaaaagtggacgtaacttgtccaaggtccgccagctagaaagagatggaggggagattctaacctggactccagagcccatattcctgtgtttctcaaccactttttcattatttcattattgcctcccccaggagtcttcttagacattttgtcctaattgctcccccatgaaattttaatgctgcagataaactatatctgtttatattttttctctctgtctctctttctctctctctctctctctctctctgactctgtgtacgtttatatactgtaggtgaaatttttttttcacccccaagatccaattttcatccccttgggggcacaatcactcctgctgagaatgccttgctccttcattccctcattccatgaataacttgtggccatttactatgtgctagactgtactcacagtgaggaggttggtgtttggggccctagaaaggctgcctttgagcaggagaacaggaccagggcccttggccaggtgcagcaacatttcctatcatggaggccacagttaccctgggttcacaatcagtacagcggctgggaatcaggaccacagagtccagccgtagctccgccatgacctgctcatttggctcttgtaagccatgccatctctcagcacccctgtttccaaccttgaagatgaggggtaggaattcaactggcacttttaagggaaacacaagctgtgtgtctaagggtaggcagattggtgagctgcaggtagcacacaggacctattggagaggtatctcgtggcaggaatacaaagatgcgtgcctataccctccggactgccttctgtttcactcccatctcccacggggttgcttggccagagcctcatcactacccacctctttttcttggatactaataaaatcttgtttctgcaagattgggacaatctctaaagtagtttcttctcctgttcccaccaattacccagatccatggctttagaaaaaaagataactgatttgcatttctctgatggccagtgatgatgagcattttttcatgtgtcttttggctgcataaatgtcttcttttgagaagtgtctgttcgtatcctttgcccactttttgatggggttgtttgtttttttcttgtaaatttgtttaagttcattgtagattctggatattagccctttgtcagatgagtaggttgtgaaaattttctcccattttgtaggttgcctgttcactctgatggtagtttcttttgctgtgcagaagctctttagtttaattagatcccattgtcaattttggcttttgttgccattgcttttggtgttttagacatgaagtccttgcccatgcctatgtcccgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagagcagatagttgtagatatgcggcgttatttctgagggctctgttctgttccattgatctatatctctgttttggtaccagtaccatgctgctttggttactgtagccttgtagtatagtttgaagtcaggtagcgtgatgcctccagctttgttcttttggcttaggactgactttgcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgtaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacactgcatattctcacttatagatgggaatcgaacaatgagaacacatggacacaggaaggggaacatcacattctggggactgttgtggggtggggggaggagggagggatagcattaggaggtatacctaatgctaaatgacgagttactgggtgcagcacaccagcatggcacatgtatacatatgtaactaactggcacattgtgcacatgtaccctaaaacttaaagtataataataataataataataataataataataataaataaataaaagaaaaaagataactgaaaatgttactttatccatccatccaaccatgggaaaaggggtccataaagagttcacccaggatctgaggagctggaagaggttgcagccaggcatgtaaaccaggagagagtggtgttctgaaacccaggagtgagagaggtggaagaagctcagccatgctaaatgaagaaggatgcagaagctgagcttttctggtctgatgaggtgcccaggcagcctcaagaggccttggggagctgagcttgctggcagcgaggtgctggaggaagcacccactgcagagaagtggatgactcagtgtgagcggccgtaggcatgcagcaggtctgccaaccaacaaatctataaacccaaccacccgaggtctgccagccctgactggcttccaaggcacctctgttgagttcctgttcacatgcagttgtagtctatttggagagagaagacctagaaaaatggtctttattttctgttatcaagcaagaaatgaatcttgactaaaagtatcacaggattgcaagaatcctttcaacttttcaatcctttcaagaagttcttggcgccttgatggaagaggaagtcttggctgggtctgggagggcattccagaaggggaaggcattgctctgctgataaggaagtgcttccaggcgtgaagcaatgattcctctccgggctaccctggtctggggactctgaggaatccgtggagctgccaattctggtccagctgcatttctgcttgagcctcatctgagaaatgaagatcttagcaatcacaggaagagtcagcaaaaaaaagaggaaaaaaaaatcatcaaggaagtgaatccaagatcaagaccttggcaaatgtccaggaaccagaacaactcaggcaaatttcagcgaagctgtgagacttactcaggatgatgtggggttaggactgcccagtgagataggtcagcagagccctgaagagaagcagagggacaaggagcccttgctgggatactgtgtctgggctctggggctggcatctccctgggttcccgcatcttgaatgtgaggccacagggttgggttcagtattgactctaagtttccaaacagctctgaaatagtctacacccatgggttagaaatcatggtaggaaatgggaggcaaagggcctgcaggtgagccagggagtatgagataaagacaagagggaaatggtaggagacaaagaccaattgaggatgtgtctgttcactgagtgacagaacctctgattttgatgggacgataactgcagaattggtccttttgcttcctccagacctgacaactggagaagaaaccctgttgagaatttgagaatcctacctgttagctaagagtaggttagctaagagttgggtgtgtgatttcaggaggaaagtaagaaaggtgatgagggagggtcaattcttgatctcttctggagggtgaaggatgacatatcagaatctggagggtgggggagtagtttgcaaaagcatccagtgtgctttctggagtgggagaggaaagagtgaggctgagctagcgcccacagagcctccagaggaggatacaccttgtgcacattgagtagaaacccatcaggcctgctcatcaaacatcctagggaccaaggagggcccaggacactcaggccacagaaaggaggcccgggctctggatcatgagcccctgaaccacagcgtgacatgggcaagcacactggttctcagagtcaccaacctctgtatgaaagcagggtcagaatagagatgccctacatctgccacttccaaaactgactttcttgggctctttgatcttcaattatgtgggtccttagaaagtcaccttttgtttactctacttcacaggaatataataaggaaatttataaaaaccaatgacccctttagataaactcaatctttataggaatattgaccagaatagactagaggtgtttttgtaagctgaacacttcctagaggtgtagctaaaagtaatcttactcaccccggtttgtaggcctgtaacacctgacttatgtaggtcacgtctgcggagatgtggaggtgaagccaccgtgagtctggagaggggaactgatgtgtctttcttttctctattaagtcactggctatggactggcacagagccgaactcagagggacacccaggagatccccctcctagagcctccgcaccctcctcctctcctcaccctctcagcctttgcttgctttaagccaaacatttattgtttctaaaaatgctggagtattgcaaacatattggctgagaggctcaatcatcctcagtgaacacttccagttttgagattctgagcctcagtttcctcaaatgtaaaacaatgagaagagtggaccccagacagtggtcctcattgcataatataaaaagttctcatgtaccaaccactcagatctaagaaatgttaactttaggcctcattgacttcagagtcttgaaaaacaaatgaagcccactcgacgagtataatttttttttaacggaaaataacaactgttggtgaggatgtggagaaattgaaactcttgtacattacaggtaggaatgtaaaatggtgcaaccactgtggaaaacagtttggtggttcctcaaaaagttaagcatagaattaccacatgactcaacaactccactcctaggtatattcccaaaagaactgaaagcaaggactcaaatagatatctgtacactaatgttcataacagtattattcaaaatagccaaaaggtaggagcaacccaagtgtccattgacaagtaagagataaataaaatgtggtatatacatacaatggaatattattcatccctgaaagaatgaaattctgatatatgccacaacatggatgaaccttgaagacatgctaagtgaaacaagacagacacaaaaggacaaatactgtataattccacttatataaggtgccgagaatatcaaattcatagagatagaaagtagaatagtagtttccaggggctagggagaaggagaatggggagttactgtttaatggggtacagtttcggtttggggtgatgaaaaagttctggagatgaatagtggtgatagctgcacaacaatttaaatgtatttaatgtcactgaactgtacactaaacattattaagatagtaaattttatgtatattttaccacaataaggaaaaaaaattatttcatcccttcaaggctttgttcaaaggccacctcctccatgaagccttcctcctgctttatcccaccccatgcccaaccagacctgatgtgccctttagcaataatctgtttcaccaatctgaactagaaaagacattttgtagtttttattttccttttcacagaaaccccaagagggataaaaaatgggacaatcattcatttcttcattcaacaggcatgactgagtacctactatgtgccaggtgctatattaaacacaacagcaggggattaatgcaatacacgagagcactgtgagtaggggcagactgcctggaagagccagagtgtggggctgtgctgagaagggggtgcaggcttcttgggtcgggggacatcctcagaggagtggcttttgagctggctgtgatatagaatgtgtaggcatgacgctgagaatagtttcaggaatggcttttgacaatacatgatcacaaaagagtgcctgggtgagaagtctggtcagagacactgcttcagtgggactgccttgtgccctgcccacctgtggccttgggcaagttactcaaggtctccatctgtgaaatggggggaaataatatctgctgtccagatcactgtgagaattaaacaggataaagtctgtaaagcaactgccttctggtgggtaccccctccttcttgtctcagctggagaagcccctggtgtttgaaggaacatctctgctgctgagaattggtttaggacagtaggtgatcctgaagctcagttctcttcctctggacactttcagccaacacacccagggggcctagagccctcctaccccatctgagctcagcggaaacactcgctacctggattgcagggcagcgttactcagtctgctctgaggactgtctgcattggaatggatcgtttctgatcctgtggtccagggtggggtcagtggtagcacccccagaggattgagcatgagctaggaaccagatcgtctgattcctgaggccaaaaacccaatgaatttgaatcggaatgtgaatgaaccctgtgtggacgttgcaaagccacaaggggttaaattgcacccaggttttggagaggaggagacagtgctgagcttccagaggcccaagattcctattgacggttttaagtggtggggttttttatttttttcccttcagttttgttcttggaaaaggcggtgaattcccattttaaattcactctgcatacatttctgattgatttttgttttgtctagagcctctgggatttgccaagtctccatcaataaactagagaggatttagggaagaggtaattaaaggggctggggcaagagaggaaagggggagagaggacaggcaaaatggagatatcgagctgtccccagcctgcagggagggtgctgcggttacaggaagtgttcagggagatggctatcaaagggtttgccggggtgaaactgtccagttggagcccttcgaaagcctgaactaagggccatggtaaagtccaggaaattggagtcaggaaacttcatttttgagtcctagttttgaaagagattcctttgagactttgggtgagtcacctaacttctttgcttcctcatttgtgaaacagagatagctcaatttgctcctagccaccctggtgggagagtcaactcaagcaaaacggctgctgagtgggaccttgtaacctggccctgctgaccccaattgacagccagggctgggaacagagacttgaggcttccttcaaaaggaagagttacaccatcagattcgccctgagaatttgaaaggaaaccaggacccattgctaatagtctcttgacaccggtagaatagagggtggatgccaggccgggccatttgcaatatgaggaaaggaagggaaggagaaagagaaggcaaaaaggcaagacaccatccgtcctgccccactttccagttccagcttgcatggaggcccgcggaacgctgttccctctcctcttatgcatgagacgtcagcattcttgccacagcctctgacttttctatttcttgagccctcctgagcaggcccacgtggaacagggtgctgatgtaaggggctgagctccagggctcagacccagtgttctaactcccctgggagcaccatgggcctttcactttctcccttcaactccccaacctgcagccacttctgagtgtgactcttttcctgctcattgtctccatccccacccccaaagcagcccaggagagcaggacttgtttgccctgctcatgctctgcagatcctggagacacctggcacacagcaggccccacatctgagggctgcatgacgctgttcacctaaccactcaaattgctggaaactgcagagtcggcctcagctcttctcctccctcacactctgctcaggcacaacttccagaaggttgctgccatcagtcctctcttccccattggcttttccaccaccccatagcttctcacctggtgggtacaactgcctcctgtgctccccctgctctcagcccctgggggatccccggggcaccaacactcttcagtgctgtctaatcacctcagctcagcactctaggccctggaacagtgctgcacccacctttccagcctcacttgcttcattcctggcttctccctttctgctacagcaacagagctgtttgaccctgaaaaggctcatctccctgcctctgttcccactgtcctttctgcctggaaagctgcactcactgtacctttcctgtcacctcactaactcgaactcatcccactcagccagctcgtcgcactcttcaaattcatggaactcagtgcagccgttgctgcttcagtgtcctcttgtgtgttcccagaatccctcgtgtttctgtcttatcagagcatctacctcactgtgctgtgttgttcactggtctgtgtgccccatgagatggtaacaaacagcctggcacttcctatgagtgccaagaagttttgtgaatatttggggctggcagagtgactcacacatataatccaagcgctatgggaggccgaggtggaaggatcacttgagcctaggagttggaggccccatctttataaataataaattaacaacaacaacaacaaaactaggcgagtgtcatggtatgtgcctgtagtcctagctacctgggaggctgaggcgggaggattactgaagcccaggaggtttttttttattgttgttggtttgtttgtaaacattttatttcattttaatttttgattttatttatttatttatttttgagacaggcttgctctgttgctcaggctagagtgcagtggtgtgatctcagctcactgtaacctccagttcctgggttcaagcaattctcatgcctcagcctcccaggtagctgggattacaggtgtgcaccaccatgcccggctaatttttgtatttttagtagagactgggtttcaccacgttggccaggctgtcccgaactcctgacctcaggtgatctgcccgcctcggcctcccaaagtgctgggaaatacaggcatgagccaccacgcctggcctaaatattttatttcatttaacacaatacattccagttttaccttaaatatatttttaaaaatatttaattttctgattattcttctttttctttttaaacttttattttagattcagggcaaatgtgcaaattgttatataggtaaattgtgtgtcataggggtttggtgtggagattatttaatcacacaggtagtaagcatagtgctcaataggtaatttttcaatccctactctcctctcaccctccaccctcaagtaggctgtggtgtctgttgttcccttttgtgtgtccatgtgtactcagtatttagatcccacttaaaagtgagaacatgtggtatttggttatccgttcttgcattagtttgcttatgaaaatgacccccagctccattcttccttgctgcaaaggacatggtcttgttcttttttatggctgcatagtattccatggtatatatgcaccatattttgtttatccagtctactgttgatgaccatttaggttgattccatatctctgctattatgagtagtgctgcaataaacatacatgtgcatatgtctttatggtagaaccatttatattcctttgggtatatatccaataatgggatttctgggttgaatggtagttctgttttaagttctttaagaaatcaccaaactacttttcacaatagttgaactaatttacatttccaccagcagtgtataagcattccattttctctgcaacctcaccagcatctgttattttttgactttttaataatagccattctgacggtatggtatctcattgcagttttgatttgcatttctgtaatgatcagtgtgaagcccacgagtttgaggctgcagtgaaccaagattgtgccactgcactccaacctaggcaacaaaccaagaccttgtctctaaaaaaataaaaattaaaatacacatttggaagcagacagatccgagtttaacgcctgctccgctcttttctagctgtgtgactttgagcaaattgcttaacctcttttcttttttttgagacgtagtctcacactgtcacccaggctggagtgcagtgcgcaatctcagctcactgcaacctccatctcccaagttcaaacgattctcctgcctcagcctcccaagtagctgagtttacaggcccctgccaccaagcccagctatttttttttttttttagtagagatggagtttcaccatgttggccaggctcgtctcgaactcctgacttcgtgatccgcccgcctcagcctcccaaagtgctgagattacaggcgtgagccaccgcgcccagccgtagcttcttcacctctatgaaagagatcataataatacccatgtcacagggatatcggggaaactaaaggcagtgatgtacagcccttagcgccgtgcctggcttgtggggagggctccatccacattaggtgctagtataactaagaaaaatatttctacatgctgttgggaggggttgggggaggtctccaaacatcacaactaaatctgcgattccaaggaagaattaagaagtcttttagaaaaccaccactgccaaatcttccttaagtgttccttcaaggaagctggggaacttaggtaaccaaccaggcacccagcacaaaccgtgactgagattttaaagtgaaaactgaaaaagtttaaaagaacacatagatctctggggggagcatggagaagactaggtcgcattaagggcctggaaggaccggtggcaaaaggcaaaggatggaagtgtggcacttctggatggaggcagtgcagggtggagattcagagccatggccgagcttccttatggaaccggcgccacccctccaaggcggtcaggtttactgggcgccccggaaacggcactccctgacttgtggcgttggccctggaaattcaggtagaaagcagcaagcagatgttttcacacaccctgaagtgtgcgcgattggcagcggctgcccagagaggttccaagagagtgggagcaatccccaaagaacccggagcaggtttggttgcccgccccgctgccctcctcgcccctccaggaaggcctagggcaaaagcgcgctggctcgggagccaagcgcgaggagctctaagccagtctcaacctcctagcttggacctcggtctcctcctccaggcattgggtttgcagcgggcaggggtgtgggaacaatcttggaggcccacccaagcccggcctcccggagcctcccccagagtttgggaacgtcccagtctcgttccctctcgacgcccccggagtcaagacgtgaagggagtgccaaggcggccgggggcggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaaggtgagggcgcgggttcctcgcgcggcgcacacccactccctttcgcccagcgacgcggagggcagggctaggactcgtcttgccaggactcgggataagcagagcccactgcccccacccagcccggacctgggcctaagagggggcgacagcggcgccgcggactgggcgggtgggctcctaggtggctgctgcggcccgagccctttgatcctcccgggcgcggaaggagggggtcgtcagtggggggcgtggcggggcttctcacctgttgcaggagagagggtgagcccggcaccccactccaccctcagtcccgccgcacaggaaagatgcctggggccgaggaagccccgaagaaggtgggaaccgtgctgagctgctgggggcaaagggtcgggctgttgagtcctttctcccgggcgcccgccgggctaggggcttcctgctcccggcaaagcgcttgggcagtggagtgggcgcgcagaccctccccgggctaggtggggcctccccaaacgtcctgccgttcgggtcatcgtttctctccaagcccttctttgctcccccacaccaagaaaggagggatgcgagggtcgggggccgaatggagtgcccggcaggtggagctcctggaggcgtccggacccgagggcttagctcagtgcgcagctgggcgagctttgggtttggcgggggccaggatctccgccaaaccccggtgggcgggccgtcccgggtgcgccggacgcccagcttagcacccacactcggagcctcggagctggtctacaagtctcgattgcggttcttttgaaaagggagtacagggagttgccccttaagaggaaccctgcgggcgctcccccctcccccatcctcctgcagaccccttccctttggaaaagcctcttgccttctcttttgctggaccggtctccgccaaacctgcgggaggaaatgctgcttctatatttgttttcccctgggagagagtaataaaaagagaacgctcagattcccaggaatctcactcccggagggctctgatccctgaaactgacataaagggacctgttgggaccggcttccctaaagtagtcttgtctttcactttcccattgctttttctcatctgggtagcctggttactggtgaaggcaaaagatccaagtcccagacagagcttcatatattcaggaagggtctttgccgacagcagggagccggcgtgggggacagggttaaaggagttggccacctttgatttctttctgtgaaccctccctggagcttctctcgcatttctaacccggtggttttcttcttctcaaattctactgggatcacgtcagttttgtgcttgaatgactgaatgcgcgcttatgctgtctcagacacttgaggaagccacagtcctgctccttgtaacatggccgtttgcactccctcccctactggggcccctccgcccttcgggagggaccctctctgggaattcaggccttgagttgagcctgacaggaagtgttggcctctggggtgccttccagctccctgacttgcaaagctggggtgtgtgtatgggggtgggggtggtgttagttgtaggttgcaagctactttctcaaatcagcatattaatctctctaaatcagggcaaatcacatttggggtctttcaaaatgtcccgttattctcagaaggcttttgtattaataacttttgacttggcccttgacctgataaaagtcttcttagttatctttctctctcaggagcttaaaatcctcccaccctcgaagaggatcagtttttgccaactgaagggaacttcgtttccaggtcagggtgcttatgtttttggtaacacatgtatctgcctgatcattttgcagtaaaccagacacagagtgataagtgggtaaacctgagaattatctaggtttcagaggctaatccaactcaaattccagtgtttgactcatgagaaaaatctttattttgtctcgctggtgtcatgctgctaataggtttactacacctttcactgaggaatttggggatcccctagccccaggatatagaattccccattctcctgagaggcagataagttgtgctttgaacaccctttaaatggaaaagttcctctatgcaaaatgcaaaatgaagcccatctctgattaaccagtgtgactgactagaatcggtagtctcttcttgcttttcagagactggggccatcttcttaaagttgagattgaatagttattggaataactaggaatagtggtttaaacaacaaagttaaacggaaaaagcaggtttatttagttgggctcctggagcctaagtaaaaactgtaaagaaaaattcttattgtgtgtgacactttttaaatgtgttatttaaatgcctcttcattctgtttctgtacttccaattttgagctctccctctctcaggtaggtggaaatgcctcatggctgtcttcagagtctcaaaatgttttctctaatttgcaaatcttataaagcagttcatgtaggagaaattgtctttccatgttccttagcctgcttgttatatatattgtacatcctccaaaaatagcctatcatttttgggctctgagtggattttccattgtcttgtaggatgtaaagtgaggtctggagatgatgggtggttggaatatcacccatgtgacatgcctgttgcagagacacttccagactttcttcccagtcccttccaagatttctgctagatagccatgactcacccaagcaaaaataagggatcggggagtatgtgggagtcccttcctagagagatggcacttttatgagagttgccataaatagcgatggtaaaatggctatgtcttgtatgtgaatctctttggcgttgtataagcagtaaggctctcgcaaatgtcaggatgtggggccaaatcctacagggtgctttgagaaggttcccatccttatgtgtttacatatttatgactctcataagagcatccttttatcgctgtgcatgagcccattggctgaactcacccagtgtggtcacgcattctggttctgactgctctcccagctggtgagtgggtctgggccaaatgtgactgacctactatctgtggattgtgcttggaacatccatgccgaagcttcctgaaattgcatcatacttggatacagatgggcctggttgagatattcagcttcaatttagatcacagtaattggttgaaagtgttattattctttttctgcggttcttttgtttctgaatttgatcatccagtccccccgcttagctctagggcattggaggcagatatgaactgcaaagagtcaatccagtaaaatactacttcaaagtttatatgggaatcctgagatctgtggtcagggaaggtctggaaaagaaaagcaaattaaaagagatgggcatgctaccttcaggaatcatctgtatttgttatttttcaatgcctacgaactcaggtttttttgtgttgaagttctatctaaggcagtagttctaaacctttgctgtgcatggaatcatctgtggagctttcaaaaatatggatgtaaaggccccacccaagacattctgatttaattggtctagggtacagcttgggcattgtattttttaaaggtcttcaggtgattccaatatgcagccaaagttgggaaccaaatttcctccaaaaaacatgaaatgtcaaaagagcaaaaaagatcagtaattttatatacactttcctcacctggaaaagtaaaagcaagtgtggggtgaaagggatgcccccccgatactcacacgatgtgccttaaccaaatcttgtaatacctgcagaaatctactgtaatcaccttcagctattagaggctttaaaaggctatgggaacgttgcttaaaaacgatctcaaatgtggtgcttaaaatcctaagctcagggtttgctccttgtacttgaccctgagctccctgactttgaagttgcgtgggagccctggatgatgtggcaatgaaatggtctgaaacagaaatactgagaggtcacttttggtgctgaaaggccaagcagagtgggggaattctgctttgggcccttcctctcttctgaaggggtaggagccctgggagctgggctgcttccagcacaattaaagggccaggaaaggccaaggagcttcaaagctgaggaagctgtgccagttttcttccaattccctttcataacgggaaatgtttctttaaaggcttctgtcattcagagaagggagactttcctcaagccaagggaggatggctttttctgtccagagccctggctgagacatgaaggcagtcatggtgcaatgaagaaagtagtggctcaggaacctggagacccacaggcttcatttccttgggcaaactgctgagctctccaggcctcagtttccccatctggaaaacaacctccagtgttcgcagtgttcctctatctgactttccaatggttcttcgatgctagttgttctgtggtcactgaggaatctttggagagaggatgtgtcttggggaggagagggaaatgagggagggaatgtgggtgggtagcccagcaaaggtcagtttaggattgtgattcttataaataaaaccaatttcctgttgagagctggagagtagcagacttagtgggaaagagaatgccgtaggccatgtgaggaattcatttctcaaggacttttgtgtgaccgtgtctccaaagattgttcatcgagcccagagccaccctctgcaacacggaccattattcactcccatttgagagacaggccaactgaggcctacagagattaagcaacagtccagacagtcagaaataggatataatatccctgagaactgagtctctaaaagggtagaattccttttcaaggatttatttaggaaagaagtgctcaaagcaatttcaaattcattccttatcggtgtcccttcagccagggagggactacctgctcagttaaactctcctcaatcttcaggacctagcccacatgtctcttcatccaggaagcctcccctgactcccactgtgtaccctcattactcttgggatagcctcattaatgcctagcacatcgcaggtgggcaacaaatatttgtggaattagtgtcacatttgtctaataattgtacatgtctatgtttgtttccctgccaggctgaactccttcaagacagggactttgtctttccttatgtccctctccagcccctggcacactgccagctgcatagtgggtatctgggacatgattggggagtggggaaatgaacaaattccaggcaaagagatcacatattctcccgtgctctagctctggagaacagacctggttcacaaaaagaaatgaagcaaaatctcaaaggcagattccagaaatggagatgaaagcccacagtggccacccttggctttcccgacttgagccttatttctgtctattccagcacaggggtgttgctgtctggtggtacagagaaggatccggcaggtttctgcgtgtgagtatgagcctgtctgtgccctctgcagcagctcacctggcctccagggctcccgagggtgcagacctggctctgcccatgctctgggtggatggttgagggagatcaaggagctgggcaccggcctgggcactcaggggctcgggattctaatctggcttttgccactaactcgctatgcgaccttgggcaagtcaattaatctttctcagccttgtttcctcatctgtatgagtgagaataatgattactaatctaccttgcaggccacttggtggaataacttgtaagagctattggtaaagactttgagaaagagaatgttaaattaacgcaggggagcagataccctgaaacctctggcatgtggttctgatcccaccagttcctgccttttcacagttcactgggctctgcccactgtgtgcttttcaatgctgttgggagatataagttggggcttctcagcctctaggcatcctagcttctcagagatagcatctgtgtattcttcatgtcagtggagaaagagataggtgacgaactgctcatttgttatgtgtagagctacatcctagccctgcctgacttttctctgatgtctcattaagtccacataggagagacccttaaattcaaatagtagctttgagcgctttcctaattttctatcactcgactctcatattctccccagttagtttcaaaaaacaaactaaccacaaactgcattgagcggggagaagggagaatgtgtagaaaaacaggaggagcctgcctccccctggacgcgttgcattggactgatgcaaaaacacagtgaggccagggaacacggatctcacatctctcaggggagtctggtattagggaggagtggggagaggcacccatgccagtagaaatcctgttctgctgttttctaagcaggcccctgagttctcttctcacttcctggagctcctcccaggacttcaaaggcagatacagtcctggtggactgtggtgagcttgtacggaagctcagccccagcacactgcaaatcagccttctgctggagattaaagcaagagaggctagccagctgttagctcagagacagcaaccactgtgtaccaggaagaatccaagctgggtgaatgtacagtcctacccttggaggtagctttcccaaattgaatgaccagccttccgggcttgcttgggactttcctggttttaccactgaaagtctggtgtcccaggaatccccttagtcctgggcaaactgagatggtgagttgccctattaccggacctaagctttagtaaaagtttctgaatcaagagtttgatttctccgtagcaaagatgagctggaaccaattattttgtctctttgacaagaaagtgaaagtccaaggcttaaaaactggcagatcgtaacttaccactagtgatacacaccagtatgctaagtgaaagaagcatactgctattcaagattcaaaagcttgcacactgaatgattctatttatatgactttctggaaaaggcaaaactatagggaaacagatcagtagttgccaggactgggactgggggaaggcgtgagccacaaagggcgtgagggaaatttttggaatgatagagatgttcagtatcttcattttggtagtggttacacagccatacatacttgtcacaattcagaactgtgtagttaaaagggctttttttttttctgtgtgtaaattaacctcaataaagctgacttttaaaaacactctagcagttgtgatgctgtggtataagatgaagggtcaaggtcaaggttgggtatcatgggttgtaattagcaactgagtcttggtgtgggtgtgtctgcaatggttctggaggtgtatgcagcagaaaagggtgagaaatttggtacaaaacaaaaaggccaagggctcatgcctgatgacatcctaaatgccagagactttttcattaggcacaatcagtgtgatagtggaagctctccctctgtttagagaaaaggcaaaagcagctcccctaaaggccaggcagccaacaagcccaggaggaccatggaatataagagcattagactcaggttcccaccctgggaactctgctgctacccacacatggatctaatgtactggctttggcagcctgtctgcaagtcttttttttctaccaataaagttattgtattagaattgagtaatcaagtctgcaggataattatttcctggttgactttttgtttttggcagtcctgcttgtctatgctagctaggattgattttgaggggaagaacccatgatttatcgaaataacacacccagtcgcatttgatgtaaagaatcagtcctcttatttctagacaaggagaagccttctgatgcaagggcagaattaccagtcgtcactgcaccaggccagcggacaggatgtggaagtccccaagaaggaagaagtatcactctgggtgatctgaatggactcttaagatcttggtgttttcctttttatttatttatttgttttttaatcaaagcccatgttgaatttgcctgttcttcaggtgaattttgtctggctctgtaccctgggaagctgggtctgtgtctgcatctctattaagcacagcctgttggaaggctgtggaacttccatccgtgaggactacatgggctgaggtcatgttcaaccatgaattatacaggagaatttcccacatgcaactttttaaaatcacagacacatccaagccactagtcacccacaaaggcaggtctcttccacctgttccagggttttctggaagaattacagactcatagccagtgcaatccttagttctaattgtcttagttttgttgggggaaagcattgatgttagagaggcaggcagtgtttttgtgcatatttgaagtgaaatttccctgatgcagggtcaggcctggcttgtggctggtctacctaagaagggtcgggtttggggcagccccaaggcccgcgtctggtttgagtgcaagggagaagctgggagcttatgagtgggggattccagatgtttccttccctgggctgcacacctctgccacaatctcccctgggctgcctgggcacactggcatctgtttgggtttaggggactgtcttagccttcttgttagcccaacaagtgggaatcctgccatttccttccatcctccaccccccgtttttttctcccccagtttttatacaacaggatttattcatgttcactgtattcaagtccccagatggggggagaaaaaaaagattgttgaatgagcttattgtttggaggtttcactgacttcttttatttaatacccacagtcctagaacatattgaactgatttactaaaattcaaatgtggtccttttggaaggaactcttctagggtgcttcgtgtccccggtatcagagctgggacctactgggtggcaagtttgcttgggccatcttcatggtcttgggtctccttggaggcaaatattctgttactatcctagactccttatcagctcacaatggtcaacaccctaccgccctttgcattgtcaggacttttgcggcacccaattctagcacattctttgaataaagatgaacaccaacattaggtactacagttaacagaagccctctgtggcttctgcttggcagtttcctgcacacttagggagaataaaggatggtgaagtggcacctactgcttgactgcctagtgcagggcagctggtccttgactgacatggcagagttggatcacatgtctttggcatgttttagagatggggtccctaccgttgatgttaccggaattgtggctgaggatcgtggcgtgcatggtggtcaagcacggtttctgtatggctgtgacacagttgtgctgtgacggttccagatgtctggagcccctggaaatctcctgagagagcaggggcaggtacttgagctgggtgagactcatgtctcccaggagtcggtggaagcttgtctctggttcaagtcggtaatatcccagatgttctgaaagtagcctggggcaaagcaggaagggtggatctcaaaaccacacacacaagtgtgagttgtgggtgcttcaggacgcctcttggacgcacaggctcacgctggctcctgcacctgcatctcttgcttcctccctccctctctccctccctctcctcttcccctctcttcttttgttcccctcttgactttctcccactttttcactctgtttctttctaccacttccattcaggtctccaggtctcctggatcttgagtccaaagaagggattcccactgagaacctgaggccagaaagacacagaggatagagtcagaccctcccaactctctcctggtccccaggcctctggtggtctcaggctctcatttcaaatagccgtggcttgaatttcaggcttctcccaggaggggctggtgacctcagagtcagggtggggaaactggggcttattctcagtatcttactccctcctagaagtgcaggcctcaatggaatttgttcactgtggcccctgctgcttcctcaagccctaaagggtgtcacttctcatggcctgctgcaagaaatgacatcttccacaatcctcaggtccagagctatttgctaaccctggggctttgccggtcgtccccccggcacagtgcaggttagtgtcacggtgattagggtcccaggaaagggcacacgtactctctttctgtgggtccttaaacagtgctgtgactcgctgaccaccaaggggtagaatcaaaattcctgcactgtgaggggctcctcccaccgccatcccaagtctcctggaactgagtatcagaggagggactggtgtcctcccagggggagcatgagaatgtgtccattgtttggataaaagttccaagcatgaaggctcaacgttgactaaaataattttttcccattgacctccttgcttctcagcgggcaagcgcccatctcccgcccttctgaggctgctttggtgtatgtaattgtaaacagctctggctggcagcaaatctccaagagttacgggatccaggtgtcgctcccaactcaccacgcactggttcccttgagagtggaaaggctgttttgttctcagagggagaattcaggctgttgcttttgagatcagatccttacaaagcctgactcactctcccattccacccccaacttccctccctgtccccagcctccaggtctctactcacgatgaaagaggcttcggggattctacttcatgaatgaagcccttagcatgtggatttttgcttttctgacccggaggtaagagtgtggatcactgagtgctctcaggtatgcagggagccacgagcatgtttattgttgagcgtaagagcaaaccagcagcccacattccctgtgtgagaacaggggctcaccaatcagggcgagagtgtgggctcaggtcagtgtcagcctcgtttcttggctacattctcacccctggtgcaggtcatggcagtatgggagtgaaagcctcttgtgctaagcaggaagccccaggagagtgttggtggctttggggcacttagttacctccctttgcctagcaatagagttgggaatcatctcagagcaaaagtgatccaaggattgtgttggaaaatgcctttggtaggttcagaggatacggggtgctcctatcttgggggccttcctgcttcctcctctccttgcagccctaagcgtttactttccgggtatcaggtatgataggggcacatgcgtgttgggggaaaggagatgtgggatgacaatcagccccttttttcttaaaatttcttaaagctatttacctaatgtcctcaagtgtaagacttgtcctacaagatttattttcctgccaagggaaggttgaggcagcttggaagagagaaagtgagagtgcaaaggaccttgttctattggagtggagagacttcagttcctcgcaggcctcctctatgctttcaggcttggctgccatgtgtctgtgcgtatagatttcttctctgtttggaaaaaataacaaaggtggtcacatagcttgcagcaaatattctccccaaatggctttttaaaaaattaccattatgagtgtgaaaatggtttagatttaggaggaaacagctggctggcagcgttcctggtgagttcctggataagattctgcggtgtcactaatgactttattcggtatatttctgacacaagcacccttgagagttggggaattttgtggctgagaactgaggtgaaggagggaaagtcctaatttaattcaggacaatccagacctgtccaatggatatctcttatccaccttgatagtttaacttggatgcacacaaaccctttttctttctttttccctttctttcaacagggtcttgctctgtcacccaggctggagtgcagtggcactgtcatggctgactgcagtctcaaattcctgagctcaagccatcctctgactcagtctcctgagcagctgggactacaggtgcacactaccacacctgaataatttatttttcatttttttgtagaggcggggtcttgctatgttgaccaggctggtcttgaactcctggcttcaagcaatcctcctgcctcagcctcccaaagtgctgggattacaaatgtaagcccctgtgctcttctttctaggattctgtctatgggtttctctgagacttcaatacattgctatcctagctaagataagcctagatttcttgagacccctgaaccaggacctgtccttgagtgcaggcggcatctagggcagctcaccagtggctgtggggagagtaaggaggtgtgctgttccttgtactgctctggagaaagcctgagcccctctgtacctggctcattcctatttttccagcctctgcagccattcctcacttggctctatgccacagtcataccgggctccttgtagctccctaacttgggcttttccacgtgctggtcaattggtttgaaatgcttcagggctgcctggtaagcacgtttgtcaaggctcactgggccttgacaccttgaccctggctgccactggatcccttaaccctcacctcatcttgtacaaccctcatggccgtggtcattgtgtctgttgatggaagtctatatttctagtaggctgtaagctccttaagggccaaggacagtatttttggtgttcacagcactaatctcacgtgtggtatattgtgagtagtccagaaacacaaattggttgggcccagtggctcatgcctgtaatcccagcactttgggaggctgaggcaggtggatcacctgaggtcaggaattcgagaccagtctcgccaacatggtgaaaccctgtctctactaaaaatacaaaaattagccagatatagtggcagacacctgtaatcccagctacttgggaggcggaggcaggagaatcgcttgaatccaggaggtagaggttgcagtgaactgagatctcactactgcactccagcctgggtgacagaaagagactctgtctaaaaaaaaagaaaaaaagaaaagaaagaaacaggaactgaatgagaaatgtttgctgtcctcaggttttcttagagttggattacatcaaagttaagggctctgttcactgagtgacaccctggacaaaattaataggcagctggcagaaaggagagagagatttacaatgtctaaaagctgttctattaacatttaggatatacaaggcacatcaaccagaaaaaggcatgaatgtacatagtaaagacagtgaatcaagggtatgaacaggagtttacaggtcaaggaagctgccaaaaggctgacaagtatctgaagaaatgcctgggcttctttagtcatcagaggcaggtcaaccaaaaccaccacccagtagactggcagaaatgagaaggtggcacaatgccccattttcccagggacgctgggttcaaccatcttcatgcagagctgagggagtataggctagtacagccagtctggaaggtaggattttttttttttttttttttttgagacagagtctcgccctgttgtccaggctggagtacagtggcgtgatctcgggtcactgcaacctccgcctcccaggttcaagcgattctcctacctcagcctcctgagtagctgggattacaggtgcgtgccaccatgcctggctaacttttgtatttttagtagagatggggtttcaccatgttggtcaggctggtcttgaactcctgacctcgtgatctgcccgcctcagcctcccaaagtgctgggattacaggcgtgagccaccgcagccggccgatttttcttaattgcattgaagatgcacttaccatacgatctagcaattcccaaagagatgtctgcatgggtccataagggggcagggttgaggatgatctctgcagcattatttgtcatggtggagaatgggaagcagtctaggtgtcacttgggagagggaacaggtgaactgatagatacatgtcttagagaattatgcagcagtagaagcaatggctgagatatacatccaatggcatagatgaatctttaatacacagtgctgatggaaaggcaggaaccagaataggacagtggacaatagcatttacagtcattcaaaattcacgaagcagtccacattgagcaaaacacatacaaacggaaaggtgcatattaggaaggtcatcgttgttgcgggaggagaatggggtatggggaagaaaaggaaattgcatgagtttgcttgtagcctattgtcaatgccagaagcctacaaataattctgacttggagcagaatttgacatagtgagaacaataccagaagctcaagccatgtgctgtgaaaggatggggaggagactccccaccacccctcaccctatggaggaatcatgggaaggtcattttccttcatattaatttctggactgtccaagaagttctcatgaagctgtgataacagactatccctacgtttgactctaaagcttgcatttgactgcgagggctgtagtggtggttagcagtccaccattgtcacagaacgggggagatgcatgaataagcctggggtggtagggctggcttttcatagctgtgtattttttcagtcacctccagccattctgagtgcctgagctcttagtcatccttgggttcacatcactaagtacaggtcatggctgacagccagcgtccaaatgtttatcacactgagtaaaatgcagtggaattagatttttctagtacctgatggattggacacaagatcgctagactctgagctagggggttcattttgctcctcttcacttaggagattcactcaaaatcagtgtatccaagcatgatacactccctctccccacttcccaccctgggttgatctgatctggacagagttggcccctgatcttttttgttccatcatctctatttctacttgaaataatagttgctttcttttttaaaaaaatccttttttgagattcagaggtccatgtggaccagatgaccagagtccctgtttgcctcgcattgtgtcctgcctgggccccagaggcaggacctggtgctgcctggggtctcgcaagtgtgggcaagagaagagctaacccttttggatgtgggctcagggtgtgggcagcaactccaattgcatttaaagtcagtaactaaagcttaagtcttccggaacatagaaataacccctgaggttggcactggtggtgtcactgttttcccagcattctttctcatgccctggatgttgcttattgatgcctcttccttctagctgttcttcatccaacctgtccatcctttactgacagtgttcagtttctgcccatgtctctgaacctgcatttccaatttctgggtcccttgggatattgatatcttaagtgaggggacaatagaaatcctcatttctgttttctcaagctcaagtatcagccccagggtcccttccagttcaaaggatgtgtgattttgtaatgaacgtgctgatgtccttaattagcccctttaaatgggagaatatccaggtattcacacaatggacattttctaagctttactttgtgccaagcattgtctcagtgcagaggtaggctggacacagtactgacgaggcccctgtcctgatggggcttgtgttctagtggaggaaagcagaccacaaacatgcaagcaccgttctaaaacaggttcatttcagagagtaatgagtcaacgtgaagaaagaaagcaggatgttgtgggagtaacttggtgatggtggggggtggtgtccaacattagcctgggggtgatggagagtctctctggggaggtgacatttgggttgagacctcagggaagaggaagagcctgctgtggggagaaccaggcccaggcagtggcagttgcaaaggttctgaatgggtgtgtgtgtgtgtgtgttcatgagggctgagaggagcttgtcattgagagggaatgtagagagagatgaaatgggagagcaggatggtgcgagggagctttcatgcagtgaaactgagcttccccgccacccatctgagtggccactgtcccttccaaatgggtaagtcaccgccaggtagaccaccttggatccatctattttccacaggaaaaatttgagcatatcctaaaataatatcctccttcatctttctcccaagaggtcagggtgccacaaacctattgtagttgtccacttttcactgaagggggcgctgggatgagagaggacatgaaggatgcctgtacttactgggggtaggggtaggaaaattgcctgagatccctgcattgtggtcccgtgtccttcccaccaggtaaagccaaggaaggaaaggagctttttgatccctgacctacccagagtcttccaagtgcttccttccatgaggcatgaatgcttcatcccccactgttcagactgtctgaggtctgtgtttagctgtaggaaataaatactgttcgaaagttgcagggtgtggcttcgtgcagattgggttcatatcaggcttggacattgcaaccatgagcaattacttactctttctgaacctcagtttcttaatctgaaaagggttgatagctttttccttggggatttgtagggttggagtgaaattttgcccttagagagcttggcagtaggttcagcacatggtcagagccccgtagtgctagccagtggtggtgaaacaaggcattgggctgtatgtgccatgggtctgccatgtttatttctgatgcctacagcctttgcttttagtaatgctgccattaggttctatgtggggcaggggaagctgaatcatgaaggagagctgtttcctctttctgaccccatcagtgtggaaaacgtactagtcttttatcacctgagcttcagtttcccccatctgtaataatcaccactttcctcacaatgcagaatgctgggaagatcaatgaaaaactatgcataaaagtgttttgaaaactggaaatcactgaacagatgtgtaagatgactctccaccattgcatcaggaattgcaattccaggctgagggaagcctgcagtgctaccatagctattgctaatttgctcctgactaatgatcagttctagagtatttatggccagaaggcagactcccctggccatggagacccagggttgggtggaattgtgtttgagattggctgacgagatgaacaattagatacaggatcacttggacagggaagtgaaggctcagtaagggattcagtcaggccagtgaagttcattccagtcctgcagggaatggacccttccatgccagggtgcctgtctgcaatgggagtgccctcattttgcgaagcatggaggccagtaagccctctgcagtcccaggaccgaggcccacatggcctgagcatgagttgcaactctagaagaacatctgcctggggatgtgccgttgctgggtgtgctttgctcggtcactccctggctgctgattccttagcctggccaggagggcctgctgggcctaaggaacccctgggcctcctggcagctgctgtggagcaggtgcagttccggctgctgcctgggtagggcagggctgcttgggacacattcatctcacctctcctaacttctagcaccatctctgccgggggaagagcccccacctgtcggccctgattctcttcatcttccttgctttgcagctgctgctgccttgttgatattaagcagggcatcacaatcaagagtggttattaaaaataataattaatgctagtaccttttccttttttccttttttctttttttggagatggggttttgctctgttgcccagtctggagtgcagtggtgccatcatagctcactgcagccttgacatcctgggctcaagcgatcctcccacctcgacttcttgagtagttgggactacagatgcatgccaccatgcccagttccttttcctttttatttcaaaatatattccatcatttccctcatttcccctcacagatattccgttgaaggtgtcagaagtcctaccataggcattttctccatgaggttaccgagggcctgggaccttaacttacctgtctcacagcaacagactgggaagctgttactacgggatggtgggttttcagactctcagccgagtctcggcctggctgcccacatctggtagtgaccgtgctccctggcttctcgttccttccttggacattttctactcattgtctcagtgaatcctcagggactcctgagcgggggcggggggtggtgagaacctgaactattcaactcgcaccctccaccaggtacctgcagcctccctggagtggctaaacaccagaagggttccaataagaaaagcattttagaatctttcactgacgttcttggcattgctttgctcagggagatgtcccctggaatgctggaacttgtttgcctgagctaggctgagttaagaatgttaatcaaaggcttcccaaggcttttctgtcagacactttcattttattacaggctggcagaatcacaatggggtgtgggggcagggaggcaggcatccaggggtaattgtcattatcctgattctgaggatggaagacattgaggctggacactgaggccaggggtaaccccagcaaaagcccacggccaacctggcagcatccaaacccagctctatctgactctctggcacattctgctgcctggtctagcttgatcaagctggacatgacctccatcctcagatggcttcgaccctgacctgcagccatgtttggatctgatgttaaccaggatgtcaagtcctccagctgcagtcaagtcatcttggtgcattcctttaggatggggaagaaggtgccccagcatcactcacagctgagcttgggactctgtggctgtctctgaagagatccctggcctgatgaaatagcctctcctaaaacggggcttctctgtgtgcctggcttcctgccctcctgtctccatgtcctgtccctgctggtccagccaggactttgttcatgctgttcctcatgacaggggcctgcttccatcccttcaccttcccgatcacacccaccttcactgcccccctgcctcctcctggaagccagccctggttgatcacctctggcccctgctgcttatacttcatatggggctcagtcagtgcttcaagtccctggcctatgtgggtctctgttcctgatgtctctgttttacagctcctaaaatgtgctgcagagtgtctggcacacaggtgggcatctgctttgttcctgatcattcccaagaggttctgttgagtttcccatctgcccctctcaaccaggcctggagcctttggaagtccccactgagtgtgtgggccccgcactgctgtgggcacatggaggatcacaggaggtgaggcgtggtccctggccacagggcacagcccccagtaggccgtgggctaggctgtggctgtacctctctctggaagtaggtgtttaaccggtgctgctgggctccccatgggccttacctactatgtgattagtgggatggccctggactcttgcttggcagaagaaggcgagtactttcttgtttcttaaaatttggaaggaaaaataagtgaggttgttctcacttgaaaaataaatttcaccccaggcaacgttcagccacatgccattcaagcccaacagctgtctctcatttgctggcaagtgttcccagtgatgaatgtcctccatctacgctcacagcggccctaaatggaggctttggacaagtgtggggggaacaatggcccttctcagagagcctgcagcagacgctccagtgaagttggttcatcacttgcagcgggggggggacgacagacaagatgccattgatgaagcaaggaaggccaagcagccgtggggagggtgcagctgaagacagaggcggaggcaaggatgggattcgtggctgccaagaaaggtcctgaataatcagagtgaatgatggtgcctctcacgcactgccttctggaagcttccttatgggatgtctcctcctcttgacatatatgtaaaaccctctgcagttgtcactggatcatggggtttgagagggtccggtccttttagggcagaccatgttgttgcgtccatcgtcattggatggacaagggcactggggccaagggagaagcgctaggggcaggaccggaaggcggggcctgcttcattcttcctgtgacgaggttggaggtgggaggggaagactgagaagaagagaagatggactgagggtttaggaagagacggggagagcctctgtcagcctgcgggctacgtgttggcaatccccacttccaccaagctctgcttccatttccctccctggttatgtctcccccaactttccagggcaaagagaaagggtcagatttccaagttggttggacccaatgtggtaaacctagttttcctttctcctcttctttttgttgtttttggtttttcagatggagttattttaaataatttaaaatagcatgcacaacagctacacatttcaaattgctatttcactctgtaaggagttcagtgtagtaattttacatctatatttttatggcaaagtcatacatgcttattataaaatatgcatatgtggcagaaatttgtaacatagaatatgaaaatccctagaattccaccctccatgataatatctatcagggatgtgttacactctccagatctttttctcctctctgcgataataaaaaagctcctttcctctctcttttctcctccttccctcccttcacccttcttgtgttccctcccttccatctttccttcccttcctccttttcctcccctcctgtccctgttttttgcctgctcctttccaacccctatggtaataagttctaaaaagcaacagagcacagcaaaaaggaagtccctcagagccaggttcattcacctgcccttgccagaggcaaacactgccccagattttatgtatctttcaaaacattgtccacatataagcagccatgtatatacaactttttttctttctcccaaacagagcataccactgttgatcttttttttcctctttcatggctatataataattgacgtatttatggagtacatgtgagtgtttgttatatacatagaaagtgtaatgatccagtcagggtatttggggtatccatcacctgaagtgtttatcatttttatgtgttggtatcctttgaagtcctttcttctagttactttgaaatatacataatattgctgggcatggtggctcatgcctataatcctagcattttgggaggctgaggcgagcggatcacctgaggtcaggagtttgagaccagcctaaccaacatggagaaaccccatctctactaaaaatacaaaattaaccaggtgtggtggcacatgcctgtaatcccagctactagggaggctgaggcaggagaatcacttaaacccaggaggcagaggttgggcagtgagctgagatcgtgccattgcactccagcctgggcaacaagagcgaaactcggtctcaaaaaaaaaaaaaaaaaaaaagaagagaagaaatatacataatatcattgctaaattgatagagtgctatcaaacattagaacttatttcttctcttaatgtatgtttgaactcattagccagcctgtctttgtccttcccgttcttctacccacccttcccggtccctgatatctgtcactctattctctatgtccatgtgatcaacttttttagctctcacatgtaagtgagggtggaccttcttccttaagtcaaggctgtatctcgagctcattcctgatagatatgctgctgtgttctttgtacttctgctgtctttcctttatatggcgagcaccagttcatataatcactgggcatttacattttcccccaatcctttgctatgacaaacaacacgtccatgaattgccttgcatgtaggttatttcagacacataaaaaatatctgtagcataaaatctcagaatagaattgctggattgaaggatatgtgtgcttacaatttgcaaagatgttaccaaattgctttctggggaggctgtgtcccttttcactctcatcagcaaaatgtcttgtttgtttccccaaaccttcatcaacaaattggtatcaaacttagtcatctttgcccccagagaaggggcaaagctatctctttatgggatctcttcctgataatttatacttctttttttatgagtgaaatggaacatctttccatatgtttaagagctctgtgtgtgtgtgtgtgtgtacactctcttcatatgcattatccttttttgttgttgttggattgttagtctttttattttttaggagctttttatgtgtgaaggagattaaccctttaagtatgagttgcaaagatttctccagtttcttatcttttgacttgttttatatttatttttctgaaataggatttttaaaaattattttgtggtcaaatttatttccttttatgtctctgggttttgcttatacttagaaagtctttccctagaattatactttaaaaaatctcctgtgttttctttgtgtttttaaaaaacagctttattgaggtattattcacataccatacaattcgcccatttaaagtgtacaatttgatggcttttggtatattcacggacatgggccaccatcatcacagttaatttcagaacattttcatcatctcaataaaaaaccttgtaccttttattgatcaccccttcatctttacatcctcctctcctcatcctcatccctaaaacaactactaatctactttctgttcctacagatttccctattctgaactttcttttgaatggaatcatatgctatgtagactcttgtgacagacttctttgacttggcataatgttttcaaggttcaatccaagttgaagcctgtatcagtatttcattgcttttcatggcttaataatattctgttgtatggctataacaactcttgtttatccattccaccactgatggaaat

SEQ ID NO: 12621 - DNA, 99498 bp, Human
  misc_feature (1)...(99498): n = A,T,C or G
gcctatcattaacaatactgtattgtgcacttaaaaattgaagacagtacatctcatgttgtgttcttaccacaataaaaatgaagttattcatgcttttaaaaaataatgaagtatggattctcaggcctcaccccagacattctgattcaggaggcctgggaatctgcatgtgaacatgcagccctgccctgggtgattctggtacagggaagtccacagatgccactttgaggatctggccctataagggtgtggtgaggacacattgatggaggtttctgactcctcagaagaaaaatgcactagaaatttagtgagacccctgtcattattatgatgtataagccaatagtctcctcttcattttagaagcacggctttgttgctaaaaccttacattttctcagcactgcttgggacttcttccaaaccagcttagagagattccacatgtctatataaaagggtcttttcatttcctgatctttgtgggcaaataatctccctaaaaaatttcgtaaatcatcctagtcttcttaaaaatgacaaacgtggcagggcagggtggctcacacctataattgcagcactttgggaggctgaggcaggaggatcacttgaggtgaggaattcaagaccagcctgggcaacatagtgagatcctgtctccacaaaaaatttaaaaattgccgggcgcagtggctcacgcctgtaatcccagcactttgggaggctgaggcgggcggatcacaaggtcaagagatcgagaccatcctggccaatgtggtgaaaccccatctctactaaaaatacaaaaattagctgggtgtggtggtgcatacctgtagtcccagctactcaggaggctgaggcaggagaattgcttgaaactgggaggcggaggttacagtgagccaagatcacgccactgcactctagcgtgggcaacagagcgagactccgtctcaaaaaaaaaaaaaaaactttaaaaattagccaggcatggtggctcacacctgtaatcccagctactcaggaggctgaggtgggacaatcgcttggacccaggagttggaggttgcagtgagctgattgcgctatgatcgtgccactgcactctagcatgggtgacagagatcccgtctcaaaaaaaaaaaaaaaaaagacaagagttgttacagaaatctttccatcatcctaagaaagagtacattaaaagggctgtgccatcactggagaaacttccagttcctcctctctgttcacatgcatagagagcctgcagcttcccctcagtcactggctcacctgagatttctgcagggatggtttcgttgaaaatgaggctgtgtgtataaaatgcctgcaacatagccagtagctagccagtaattttctgctacaattaaaaacacacaatacaaaatgtaccaaaaatatgaatcaagaaagcttgataagaggttttccaatcatatttgtctcagacagtactgcagaataatatggaaattctgaagtaacaaaagggaataaaaagttgaactcagttttgttatacttttgcataaggggttccttacatgtacctcaaaagcagggacttgcgaggaggctgcaggctgtgtgatggctgtgctcagctaggcacctttccatcatctcaaatccgagaaagaaactcaaaaagcctaagaatctcgtttcagtacaagcttatgcctcagggacaatcactgtcggtttcacatgcagacaatagtgagtgaatgcaaagaaatggtactttcctacctgcatttaaaaaaagaaagaaagtaaatctactccccctccttttttgggaacatggactggcccattgtggttgctggtgtgttgaactagtaagtaaagcgaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggtgacctatgtcctttgctttgcgtggcagatgtgagatttctggcttccttcgtgaggtcggaggccgctcggatcctccaaatgtggtggctggatgctggcgacagaagtcacttttattgccctgacatacatttatgtaaactttttgttttcctgatgatacaaaagaaacgacaggagcttttgttcatcgatacagaactagactgaagggcaggaaaggctggttatttatttcactgagaagtgtagtgcgttgaccttttaaacaaggcttatgtttttttaggctgctacccgcaagattgaaaggagactgtggttttcagactttggggttgttttgttttgtctgtggtttgtagagctctgtgaaatttacatttgagtcctgtttgggggatttggtggtggaagtggcacgtgggaatgagtagatttagctattactgtaaattatgagatttttttttctttaagaaatacccaataaatgaaaataaggaaacaaaatgtttagatgttattcatgttttattgcggctctaggttgaaagagcttgacaattgcctctctttccacctttgaaatgcagtaaaagaaatctagagattctggcctttatattgaaaatagttttcctaaaaacccagttattaatcgaatcatactgtaaagactttttttggggggaaagtgttttaaaatgtgctatactagcatgaaagaagaaatgggaccagaaagttatttcatctgtgaaaaaaatagatttatgatgttggaaaagaaaaaaagaaaacgtgagtttggccataagccagcaggagtgtggtcgctatagcagcttcatttgtcacttagctgagattggagacttaaaagaaaactgagcctgtttttctctcagacagcctcataaggaatgttaagaggatgtgaagttatttagattaccaaaacaggttctgacaagtaagtgaaaataactcattaaaatataattgttgccattctataaatggatcaaaaggcttgttgagtcactgcatacttatagaataggtgaatttgccacggctcattggtataaattacttttgagaaggctttttaagactaagcgtgaggccttgccaagcatcccttataacacttagaatgttttgaccaatgttttcgaggcggttgcctaagcattttcatgtgtcagtgagtctaatcctcgcatcagtggcttatccagtaagctcagggaatattatatcctgacaacagaagcctgcagatttttctcttcaactaaacaatagctcacctaaaaggacagaaagtgaactactcagttcttgtaacctgactttctggagggatggtcatgattttggctcctgtagaacagggtttctcaacctcagcattattgacattttggatgggattatagtttgttgcaggggactgtctatgggatgtctagtagcatccttgatctctacacaccaggcgacagtagcactccctccccagctgtgagaaccagagatatcttcagacactgttaaatattccctgtgggcaaaatgcccctggttgggaatcactgctagagggaaacctgtcttggggcctactgctgccaacgagggggaagggtctatgagaggaggctggagtcccagggaggcctggcggggtccaaggaacagtggcaggacaggtgtttttgcctgaccatttggtttttattttgtttgggttttgtctgaaatcacatcttgggaatggggtatcagattcaaggacttgctgcggatatacattcttctgcccccttttccttctgtgcccttgtgggacttattttatacagtgctatgattggtatagtagtcaaacttctttcaattgaattctaaagtgcattctggggatatactattttgtctttttttaaaaagaagcttatacagtgatccattttataaagcaaatagttacccatacttttcccttctgtaaatatagatttttttgttgttgttgttgtttgtttgtttgtaatgtgggtttttagtaaatctggccatgcctgttagtttttttttcttctagaatctgcaagtgaatgctttcatttcttttttcttttcgccgtctgtaccagtgggtctcaaactgctttgatttttttaggaattgggccttgttttgtgagtgcaattgaagaatcacagcttttttccaatttacagataacgatgaagtcaatggctgggattttttccgtttaaaatttttcttacacctttagcattaatgctactgcttgtttgctctcaaaggtttacagattacaaaatgcatgaagctgcgagtgctgctttttcttggtgtttctccaagaatatagtacattgcactgagcaccgtgacttccaggagctaccaccaccacccaaaccagatgagatgtaccactgcatagtgcttagtggtgcttagcattggctgaacagatagggaaacaccttgacttattgaagtctattcttggtgacagacctggactggcccataatgttatcagagagctgtggtttctgcttttgattgcaaagcaaatcttgcatttatctccacctggaggtaccaatgtgacacacaccatgtgctctctaagtaacagttcttcgtaattaaaattcaccctctccccccattcagtagaccaaagatccctgagtgcagcaaatgtgagcattttaggtctatttgcccccaggatatagcacagtgcctgctcatactatttgctcagtcattgatgaacagacaaatgaatgtcaatgatttctatggaaagaccacccaggagcttggtcagcaagccacatgtctgcagcctgtgtccatatttctgtaattttttaaagaggacaaatccagtcaccatctaagcaggttttaatgtctgaggggctaccagaaaactctttgaaggatgcaggaagagtgggtctgtgggttgtagaatttgggccttcataaggcccagaaattaaatttctgctcttattataaaccccacaggttaatgcttcttcatggtttcaataagataaagagcacactaaccatagggtctgacccaaaggcaaggtatttaccacctctttaagaaaactcgccagttgaaagagcttatgatcagaggtgaaaaaacggcccttgttgatctatgtgtcctgtggggagtcaggtggtgctgcccagagaacctacctggttctctgaaccaggttatcagggcaaggggggtgcagatggggcagatgtcttgaaattggaagtttccagactgtgcagaatgtaaagatgccgtagtgagagacagagaagccaaagatcctctcaatctcttgctttggttcacaaaccaaccccagctccatggatttttttgttttgttttgttttttgagatggagtcttgctctgtcacccaggctggagtgcagtggtgcaatcttggctcactgcaacctccacctcctgggttcaagcgattctcctgcctcaccctccgagtaactgggattacaggtgtgtgccaccatgcccggctaattttttgtgtttttagtagagatggggtttcaccatgttggctaggctggtcttcaactcctgacctcaagtgatccacccgcttcagcctcccaaagtgctgggattacaggcgtgagccaccgcacctggcctagctacatgcttctaagcagagccctgggaatgagcaagcgtgagcctttcttgtaccttaagctgcagaggcttaaggtgcagcctttgacgggaggggaccttcatcaaagaggaaacaaaccctgctgctttattattcgccaagcctggaatgtttttagcaaatacgtgtttgtgtccttctcagcattgctggttcacactgaggccatttgttgctcataaacactagatgaagcaaaaatacttgtttacacttaagactgcttttatctttccttactgctgaatagtaattttttactagattgtcttggttctgtgcagctggttccttatgtctgtgctcatatccgtataccttgtccaaataaacatacttgaaaacatagagaattgtgttttgtgaagtttagaacatcctctaacagagtttaagctgagctttctgctttgttttggcaacttgtttaggatgccaaatgtatctggtctggcaacagatgaaagaagatgttggcccttatataacgaagtttagggaataagtggggggtggggtggattgccaggtttcctttgtggtttgaaaagagttctaaagcatgaggaaaacatgtgttcgactgggtttttgttttgcctttaaaccttggaattttgaaaatctgttgaaatatcttctcctggcttatgcagccctctgagattaagtttctgattacctacatcttccctcctctttcattccagccctgctagccttctttctgcccctcaagcacagacactgtccatctctgggctttcactgctccctgagcctggcacattcttcctccagatcttggcttccttctcattattcaacctgcctcttttgacttggagaggtatcctctaatcacctagctaaagttgcttccacctgcccaacccctaggccatcttctctcccctggttctgttttaggttcttcatggcactgttccccgactatctggaattcttatctgcttgtatccatgtctagtatctgtcactcattgcaagaatgtatgcttatgacaggtactatcatatccccgaaactaaaacatcatctgatagaaggttggtgcccaataagaggatgagtggatggatagaaggatggatgaatgggagggaaaaggagagggaaggaaggaaagaaggagcggggaaaggaggggggttgactaccgagtaaatttctactctcttttaagtctaagagcttctctcctgtgattcctctttgactccccaagacagtagccttggagaattttctccccacacccacctcactttgtacattacactaaccatcttatccagttacagtcacctgtttgctaagctctgcatactaagctcttgaggacaggaatgtgtaataaaggtggttatggttgtaattattgtttgttcttattgccttagcactttataagcatacttcatcaaagtcctttcatcaactctatggcttgagtatgactctcatctttgttttgcaagtaagtaaactgaggcccagagcagttgccgaaaggcgtacagatgattactgcagggccaggaattgaatacagatttcttcttggtagcgcagattatacagcctttctttcctcctcatcaggtgtccagtgcctgacccacaggttcatcacaggcttttgccaaatgaatgaaacctaagacctcacctcctcccttctcatccctattatttgagcttatacatattatttatactatttataaacataaacatgagcctatcagttcataatccagtgacatctctaaggataactagctgctgtatcttaagtcacttatttttattgtttttttagaaacagggtctcactctgttgtccagactggagcacagtggcacagtcataacttactgcagcctcaaactcctgggctccagagattccctgcctcagtctcctgagtcccgggactacaggtgcatgccatcatgcccagctaatttttttttattattattttttagagacagggtctcactgtgttgcccaggctgctctcttaactcctggcctcaagtggtcctcctgccttggcctcctgaagtgctgggattacaggcatgaagcaccacacccagcctacgtcatttttctttctttcttttttttctttttttaaccgataggacgtcattgattgcttaaaccctctcattcttcttatgtaaacaaatctattagtcaaaagttaagcagctgctgagtcacatggcactttaatccagggttacaattggcagccctgggaatgagttctcctttttttagctcccacgatggcactgatttcccctagaatatgaaacttacaccaaggaaaccaccatgacaactgtaggtagcaatttcaagcagaaaagactaggaaaatgcctaagaattttaaacctgacagagttcttctacatttttaatataaccaagtgctgttcatcacctgccttgacaccggtgtttgtgaggttgattggccccaggatgttccactgcagaacagaaggccaagatcagaagcccttgtcgacatataaatgtaatgctgtaagctggcttggagctgtgactccatggagccaattctaaaatgattaagacttctgtctatagagagttgaggtggagactgtttactatggccctgcccagaggcttcagcagctgagggtgtaccctctgcagtgggagtcttcaggcatgagcctgaagcctgtgctggcctctagggatggagtcccttgttgtcttacagcttgaattttccagcacaggacaactccagatgacagctccaacagggcagaggctgcagccttgccagactggtccgtcaaagctttccttggcacataatccagtttcacccaggtttgggggtaacccagctggttccttttttcctgggttggtggtgagctaagcagggaggtagtacccacaggttatttatggatgtcaaaaactcaaaaggccctcagcactgggggtaggaccagtgagaagtgctcaaccatggcatgtatgagggatctgtgggcgaaccctgatgtgtcatttggctcctctatccatcacaaagagcagggacccctgaaccctttaaccatccctgagcaagattggagggatttttgcccttttaatacaacttcttaaatggcctgatggccttggatgtactcattaataaatatgtcttgtggtttgcaatttaactgtctgtgtgatgaggatattggaaaggagtttctgactgattcattgttcacacttgcctctcccagccgagggataattggggccttgcctaatctgcactcgctcacacccaacatgtgctgggcggggaaaaaaggctgcaacctggccggctggttcccggacctggccttgcaccaaccaggaagatctcttctctacctccttttctgtgttcaaggtgatacctgcttaggactcccagaaatatcattagcaggaaagttccacagatttaatctagtctaaccctctgagagttgaggacactgagacccagaaaacctgagtgattttcctaggaacacacagcccattggttagtaaggcaaaagtagacctcagagcagctcagtgcttctctatcccctctgcacctcccccaggctgcctcttgaactacttctctgcttgctgtacaaaccaaagctatctttcaaagtcttttggaatattaaagccattacagggaggcagggtgtgtggggattgagtagatattcaaaagatttttgctcaaacctttatttcactttgtttttaaacaacttccctttcccatgcctatggagcttttcttgtctcatcctaaaaactcccaagttcccacctgcttctaggaagattgttgatgattgtccaggcatcccctgccactgtctgagcagacaacttctaaaagtttttttttttaagtagtgtgagctcatcgtaaataaataaatgaataactgagtaagtacacttgtttgtacttctctgaatcacatgtaatgggccagatagtacatattttcagccttgtggactatgctgtctctgtctcagctacgtatgggctaaagcagacctagagactatgtaaatgaacagacatggttctgttccaataaagccttatttacaaaaaacaggtagtgggccaggtttnnnnnnnnnnnnnnnnnnnnaagtgtacttattcagttatttatttacaataagctcacattactttaaaaaaacccactcccagaggtagctattgttgagagttgggtctatagtgtcactggcatgcagatacttacaaatacggggttggatcatgtaaattttttcatataggatgtagagttctgtatcttgctttgctcctgtttcttgcacatagatacctgtgggagggcatgtattcttttatacaaataggaccgttttatgcatgttgttctacaatttccttcacttggcagtaactcagtgttgatgcttataggatgatgacattctttttaatgaccacatagtggtaaaatcctttaccatacactaagaaaacatgacaaataccaaaaaaaaaaagtatgtgtgtaaataactaccagcagacacagatgatgtcttgttcgtctcacatggtcccatgtgtctggtgggcacatccacggggatccatgtcagcccgtgcagcgttactatgtttccaaagggggttttgtttcagcctaactttctgccagcacagcaccacatacaggtgacgagctaataaaagatttgcatgacgaggaaggtttcagacaaactttagcttcaacattgtggttgattatgaggcaatttctgtgaaatcctaaaaatcccaagttttttgtcctgctgtgaacacagtttatcgcaaaaaagtacagacccacattgtactgtggcccccctccccgccctttaaagtatgcgctgtcgttgatgccttgaattcgttcctaaggatatcatagatcaccacaaacttggcagctcaaacatgacagaaatgtattctgtcacatttctggaggcctgaagtttgaaatcaaagtgttgtcggtgtggagtgggggttcttctgggggctctgctggagggtctgcttcatcctgtcccctggcttccagtgctgcagcatccttggtgctgcgtggcttggagctgcatcgctccagtctctgccttcatcttcatgtgggtccagcttgccctcttggtcagtttccttgtcttgtctggtcccgtcctgtcctgtattttgtaaagacttgtcattggattcagggcccacctgaatccaggatggccttctctcaacacccttaccttaattacatctgcaaagcaggttggacatatctttgggggaccacagttcaactcagcccatgccctcccatctaaaaatcggagtgcttgctcttccctctcaggtttttcctcctggaggtgaggaaaggggcaaaagccttgttcttgtcgtaatcaacagccctgctctttgaggataaaaagcaacaacaaaaaaaaacggagtcccaaggaatggcatctactattagttaatcgcaggtcccagaaaagcaccagccagaactgcaagtcttctaggaaatttcttactgaattcagcaaaataagaggctaatgagaagagtgtttgcatatctgatagtctaactgaaaggaaacagaggaagaaaaatgtgcttttgtaagccctgagagttttagctgaatggcagcctttccctgtgattaactggcattaattattgtttcaaagagtttccaaggttgactgaatccagtgtgaagctcacaaaaccaacaccatctatttgttttatttctcaggagaaagttatattaatgcaaaaataaagaattgtggctgggtttgtgatctgttttcaatagtttctttaaggaagcagctgttttttgtgttgcacagggtacttggatgcgaaacagtttttgttgttttggctttttttggagacagagtcttgctctgtcacccaggctggagtgcagtgatgcgatctcggctcactgcaacctctgtctccccagttcaagctgttctcctgcctcagcctccctagtagctgtgattacagccacacactaccatggttggctaatttttgtatttttagtagagacagggttttgccacgttgaccaggcttgtcttaaactcctggcctcaagtgatctgcctgccttggcctcccaaagtgctgggattacaggtgtgagccaccacacctggccgcaaaacattttttatgtttaaaattgatacctgctcacctcactcccttagacaatgtttaaaattgatacctgctcacctcactcccttagacaatgtttaaaattgataccttgctcacctcactcccttagacaatgtttaaaattgatacctgctcacctcactcccttagacaatggctttggtcgcaagggacagaaactcacctcaaaccagctgtattttggagccagcataacaaagcaccactacttggatgttttaaaaaagacaaatttaatttccaacagctctggaggctggtgaaatcaaggtgtgggtagagccatgtcctctctgagccggtagaggaagatttaccctggcctcttccagcttctggcctcttccagcttccttgcttatggcaacaaaacaccaacctctgcctctgtttttgcttagagttctccttgtctgtctccctccctcttctgttcttataaggacatcagtcatagtggattaacagcccaacctattccagtatgagctcattccaactaattaacatctgcaacaaccctatttccaaataaggtcacacgctgaggtattgggagttagggcttgaacatatctttttgggggacacaagtcaaccagtaacatcagctgaagcagaaaagaggctcacatagccaagccgctggaggggacagggccttagatgtcattagcatcccgtcagctctgtctgcttatctgtgtgtgtcattcacactcacgaactcactctgcatgaaaagcataaggctgcagctcagggattctcaaccatggtggaaagggctcttgtacccccagctcacatcctgaagtcccaggaagagattccatcggaatgtcacctctccagctctagaccattcactgtggccagggagagggtcacgggagggaatggcagcttccacatctggatttggggaaagatcccactgccgcacaccaaaagcagggtagccttgacatggccgctgcgggaattgtgagctcagggtagctggcccaatttgtgtgaatctcagaactaacctaattcgaatgcagcattgcagtcacgtgtcacttaaatgacccttgtcatgacttacctttaatgtgattttatgcacgcgctccttctcacccatcccctgctgcattgacctggactaaactgctttcaggttctgggagatctcctcagaagttgtgttagatttttcatttctctggaaggtcagtgcatttgcatttgggcagaaactcatggtgactatactaataatttaatctttagtctcaaaggacaccatggtgggtaggtctcaatgacaggcgcttttcctctcttttttagttttcaatctgaagcttttaaacttccaaaaagaatcacagtagtgtagaaatagtcttaacttctgctaaatggcctgtgggaggcctgcttcctgtactttgaataccttttcataggttttcatgcagtctgcaagaaaagacagttttatttcaactataaaaattaattcaggttgagagtggtggccacgcctgtaatcccaacactttgggagatcaaggcaggaggatcacttgagccgaggagcttgagaccagcctgggaaacatagggagaccctgtctctacaaaaaaaatttttttaaattagttgggtatggtggcacatgcatctgtagacccaactacttgggaggctgaggtgggaggatcactgagcccgggtggtcgagtctgcagtgagctgtgatcacgccactgcattccagcctgggcaacatagtgagaccctgtctcacaaaagcaataattcaaaggaatgactgcagaaattacaaaaacagctgataattcagaatgctcatttcactttattttttttttttttttgagacagagtctcgctctgtcacccagctggagtgcagtggtgcgatcttggctcaccgcaatctccggctcccctttccccctcccattcaagtgatccgcccaccttggccttccaaagtgttaggattacaggcgtgagccactgcacccggcctcatttcacttaattatgtttgcttccagctagtatcggaaagcaacttttttattctgtgagtcttaggtgagcagcagtagagaaacttacctgagataactaatctgtagatcctaaaagtgatgcttgtggagcctgtaggacagatgcagttattccttgagtatagtcattgagtgatggtgtcatgtgaaaactttgcaggcttggatgatattttcaggagtatatgtatcttggaaatttgcagtatgacccaaacttggcacatcttaatagtcaataagaatttgcaggggcactaaatccttgctatctctctggcaaaagatagatttcttggtagtgttggcatcgacacctttcatggaaaaatcgattgcttgtatctactagctctgtgctagacaggaagcactaagaattcatttggtggttctttcattcctggcttatgagggataccctttgctcctacccgccaccaaggtgaattcaccttgaccctgagcataccagcacacagaccaagttgggctttgattgctggtcatttacaataggttagaaaggggtgagctgaagcatgtcgactagatgaaattgccacagtgtggtattaacctgctcaggataaattgagtgtgaaattgttactgccggatgttgcttgccagtggggtttctttttttttattttcttttatgtgataaatgtttttgcttgatttaagaggtggtagaatactggctgttactgaaatgaagctaatttcttcctgttctgagccattatagcatatcttgcggacatttgaaacacatttttctcctaagatagctgcatttctgaatgaagaactgatatgctttctttctaaattcatcacatttctttctaaattcatcacgtttatcagttaaatgtacaaggggtaagaaatgaattttcagcagattgttgtacctgaaaaattacacagaaaagtaactttaggtgagaaagtatctggtaagtttctcaaaggtttaggttttctgggtctggtttggtttggtttgctggggaaagggaggatggatggaggaggatggatggagagtacaggtgactgtcttcttgactatagtgtaagtgataggaaaaaactctcgagttttggtatataagtaataaaagcaaaattcggcttgcttgcttgctttctctctttctttctctctttctttccttccttccttccttccttccttccttccttccttccttccttccttccttctttccttccttccttccttccttccttctatctgatggagtctcactctgtcacccaggctggaatgcagtggcacgatctcggctcaccgcaacctccacttcctgggttcaagcgattctcctgcctcagcctcctgagtagctgggattctgggtgcacaccaccacacccagctaatttttgtatttgtaatagagacagggtttcatcatgttgcccaggctggtcttgaactcctgacctcaagtgatccgtcctcctcgggcctcctaaagtgctgggattacaggcgtgagccaccacacctggcctggattctgctatccttctaatcccaatttacaagttatatcttccgtgaagtcctgcctgaccccttgaattatagttagacattgtcccttcctctggattcagaagcaggatctttcactcaatgaatgtctattgtccacttactatttgcacacttcgagaatgcaaagatgaataaggttcctacgtaaagccttttggcttctctgcagactggtccccagaggaatcagcatgtcacgagtgaataagaggtactccgtgagtgcacattgcattggattgtaacacattttctttccccagttcgctaatttcagccctttttacgcacaggaaaaaaacatccttttgtttgggctcctgtctttaatagacccattacttttggaataagcagcttccccccaggaaagttcacctgagtcatcttgtgctcagcacgactggcctgcagcaaggaagtggtaccaagcagctttactgtcctaattggacagaaggaaattgacttgtcttggatggggattatccaggtctttctgctccaggaagacactgagagagcatctgtccacctgagattgtttgttgatgagaaagtgatgccaccgtgttcaagtttgagggaactgcagagcaagaccttctgggtccacaggaaagagaggtctttaaacttaatgatgctccgaacagctggaaggggaaactggagaatatggacagttggcttttctgctgagagttgagactagtctctacagatgacctgtttgatgcaaactgaaagaattagaacaagtctttgccaaaatatacactgggaacaaaatgataggaaatgggacttttctagaaagacatgagaaggggccaggtgtggtggctcacgcctgtaatcccagcacttagggaggctgaggcgggtggatcacttgaggtcaggagtttgagacagcctggccaacatgatgaaactctgtctctactgaaaatacaaaaattagctgggtgtggtggtgcatgcctgtagtcccagctactcaggaggctgaggcatgagaatcacttgaacctaggaggtggaggttgcagtgagccgacactgcaccactgcactccagcctgggtgacagagcaagactctgtctcaaaaaaaaatttttttaaagaggtgagaagggtataaaaaaaattaaaatgaaaaacattgcttagaatagaataaaatctcgtggattcagcaatacatcttgctcttaaatatttgttctgccattgttctgtgacgttagaattttcctcagtgataaacttacattttttgtatactagtttgaggtataattgattctataaacaagaatttaacatttcattcttgtactatgttaactgattatataattatacttataatgtgcgattataaaaagacaacccctaccttaatggaacttaaactttagtggaagacttcaaagatattgataagttcaaggcactaccttaacagaataaataaatgctgtaggagcacagaggagggagggaacacactcagctaagactgaaaagaccctgtggcagggcacaatggctcaggcctgtaatcccagcactttgggagactgaggcgggtgatcccttgagcccaggagtttgagaccagcctgggcaacatggtgaaaccccatctctaataaaaatacaaaaagttagctgggaatggtggtgcatgcctatagtcccagctactcaagagactaagatgggaggatcacctgagcccaggaagtcaaggctacagtgaaccaagatcgcatcactgcattccaccctgggtaatgggagtgagaccttgtctcaaaaaaaaaaataataaaataaaataaaaataaaatccctagagaaggtagcagtagaagcttggagcattggtattttgttatatgaaatagactattttatacaaaaaaatacctaatatgtgttcaacgcccattagactctggaaatacaaaaaatgaatgagacaatgtccttgttcccaagaaattaaagtctagtggggaaaaatctgctaggtagccagcagttataattcattgcattatataaatggcatgtgctttatatgaatatataaatgtatattcaagtcaagaaatacatgcaaatcaaagaaaatgcctaagtccaggggagctggagaaggctcatttcagtctagaagttttcaacctgggctacaccttgcaatcactttctctagaggggccccaggcaactatacttttttaaaactaccctgttgattctaatgcacagagaagtttgagagtagcttctctcaggaaatttaagatgtgggaaggtataggcagtgatatggtttggctgtgtccccacccaaatctcatcttgaattgtagctcccataattcccacatgtcatgggagggacctggtggaaggtagttgaatcatgggggtgggtcttttccatgctgttctcgtggtagtgaataagtctcacaaaatctgatggttttataaatgggagttcccctgcacaagttctcttgctggccgccatgtaagacgtccctttgctctttcttcatcttccgccatgattgtgaggcctccccgtgtcagccatgtggaactgtgagtccattcaacctctttcctttataaatgacctagtctcagctatgtctttattggcagtgtgagaacggactaatacaggcaggttaacatatttgaggctgacgcagagcccacatggccaaggcatggatgagggtgtggataccaggtaggcaatgaaactggacaggtagattgagaccagactgcagagggtattgaatgccaaggttagaaaacttaacttttttcagtaggcaatgggaagacattcaggtctttttatccagagtattgtgatctacatcatatttaataaaaattagcctggtgttcagaatgcacatctttgggagggagggagaggaagaggttgtggcttgtggtccaagtgaggccccgaggcagaggaacctcaaaggattgggaagaacagcacgggaggaaggataataagagcctggagaccgactggtgggacaaggggagcaaagagctccttggttgcctcaacaaataccgcctgagccctgactgcttgaagacacgaatggccacaaagaccagggtccagtaccttggaggctgctggcgcctcaccctgactcgtcctgggagtcctttctcacaccgcactctccatgctgcttcctcaccagcacttgactgtatcaagcagtttgccctccttatgtgaccctggttgtcatagcctgggtagctccagggtgtgcggtttagagttgtcttttcctcctgctctcctgagctgctctccgcattctccatacgaatttattctcattctaaatttcccagtcattaaagacaactatgtgcctctctttgctcatctgtaacatggggatagtaatggtaacttgatgttcctatctcatgatctgttgtgagtatccagtgaggagagatatgtgaaagtactttataaactgaaaagcatagcacagatactgactgttgctatcttcatctgtttgtagaactttcaattaaatacaacagtttagggctcagggacaaagtttaatcactgtgtggtgaccactctgtcaatgcagtattttcctatataaggcttgtttaattcacagtaactgccaatgaagatgtcctaaaccattcccattttactctttcttatttttaaaaatatttttgtgggaacgtaaagtcaaggtctcactttgttgcccaggctggaatgcagtggagagatcatggctcattgcagccttgaactcctgggctcaagcaatcctcctgagtagccaggactgcaagtgcgcaaccacacatggctaatattttgaaattactttttatagtgacagggctttgctgtgttgcccaggctggtgtccagctcctggcctcaagcaatcatcctgcctcgacctcccaagttgttgggattacaggcatgagccattgcatctggccaatattttttatcttttttcaggaaaatagaattttggagctagaatgtatcttaaaggtcctttaatgtaaccatctcctcctgcaaataaggcgcctgagaaatggagatattaacccagcccaaggtttcacaagttaggacccaggtttcctgacttcatcctagggctctttgacctggaaagttcttcctttatcactggggccatctcctaaacagggtaaatttgtgatacgtttgtcccactcaggtagaaaaaaaattttgtaatgtcatgaaatgcaacaaagcctggtatttcaattgaatgcccttaaggctcagtaaagggtttctgagtccagactgctgagcaacggggatggaagcctggcccaagaggtaccccagcatttctttgcagagcagctgctttggctgggaagctgggcttttctttctttctgttgtcagaggaaccagctaacttagactaaggtcagcagactttgccttggagtacctggatgcctttactccagaactcaggggggtctgctgccttgagggacaacacagacttttcatcagcctaggttgcacagcctaacacttggagggtcaccccaacagccatgtgactgtacacagtggaacccacagttcacaaatcacctgttgatataagtgggttgggctgtctcccttgagtctcagtgtccagccatggcacggtccctagatctcctctaacaggccctcctgtcacctgactgtgactggcgcctggtacagcaggtgtggctggcagggtgcccgtttgcacagcactccctgcttatcctggctcaggtctctgaggcctgccctttcagaagaatccagacgacttggggcagggcaggcacccacccagcatgtagaggtctggaatgtgaattgtgtgtctctttctttgtgggatacagaaattctttggttgtcatccaaaggtgtaagccttgccttaaaaatattctcatttggggcattgccaagcctgggggtcctgaattctttcatatgtcttcgttccttcttcagatttatttttcagtcggttttttgcttccttttcatgattggaaccactactcaatgattgttagatacaccactcctcactgttcccagtgaaatcacagaatttgtgctaggtaaattccaggctggaaggcatagttgtttattaaaggagatgaagtccagccacaataggagaggaaatcagacaaggatgtttttaaaagcaagctgtgtttttctgactgctccaatattcattcccaccctgaaggctcctctaaccctggggaagaaaaaatatttttagtctgatagtgtactatagagctgaaccatctgtaaaacagtcttgataactcagaggaatggttttagtggaaataacttgtaaaggatcacccaagactccaaagctaaggcatcaactacccacagagcaccggttcctacccagctcccatgaagtcctttaagatttattttagaaccattgcagccaaaccagaaattgacaagtgggacttaattaaattaaagagcttctgcacagcaaaagaaactatcgacagagtaaacagacaagctacacaatgggagaaaatattcacaaattgtatatctggcaaaggtctaatatccagaatctgtaagaaacttaaacaattaaaaaataaataaccctatttaaaactgggcagatacttctcaaaagaagccaatttgcagccaacaaatatatgaaaaaatgctcatcatcactaatcattagagaaatgcaaatggaaaccacactgagataccgtctcacactagtcagaatggctattattaaaaagccagaaaacagatgttggtgaagttgaggagaaaagggaacgcttatacactgctggtgggagtataaattagctcagccactgtagaaagcagcatgtagattccttaaagaacttaaaacagagctaccatttgacccagcaatcccactactgggtatatacccaaagaaaaataaatcattctatcaaaaagacacatgcacttgtatgttctttgcagcactgttcacaatagcaaagacatgcagtcaacctaggtgcccattcatggtggactggataaagaaaatgtggtatctatacaccatggaatactacacagccaaaaacggaacaaaatcatgtccttcgcaacaacatggatgctgctggaggctgttatcctaggtgaactaatacaggaacagaaaaatacctcgtgttctcacttatgagcaggagctaaacattgaatacacatggacacaaaggtgggaacagtagacattagggactactggaggggagatggtgacaggggaagtgggttgaaaaactacccatcagttactatgcttactacctgggtgatgggatcattcatacaccagacctcagcaacatgcaatttacctatgtgacaaacctgcacatgtaccccttggacctaaaataaaagtcaagagaaaacaagacctttttaagaatagaaatactgaggaaggaaataagagcagggtgggatgggaaaatatttataattcatgggggaaggagagctatcacagagctggaatgtactttagagatagcaatatggtgacgaaaagcagttgacaaactagaatcccactgaattgggatcagccatttgctgcatactgtaaaacaagtttaaacatttttaacttaaaaagcctggcttctgaatgcttattgcaacttacaaagtcatgactaagatattaaataaagggcacttgttatgttatctgatactgccctattccttcccaccaaatgcacttaattgtactatttggcaactaggagatgtgtattgagaactgattccctcagagcagctggcatgggagcgattctttggattgctgttattgtgcattcctgactccaacatgctattgtgttggaaaggaggccaggaatgaggtcatgagtaagaagaaaccttaagtttttgcccttgcacaagagacaaaaattatccaattggagttagatttcaagagtgttgaacttgaaggcaaatatttatcttctggtgttaagaaaggaaaggatgtgaaacctttgaccttgagtgttagggcagtgtctgagtttggaaagcagttgtctgaagccagaagcatgatgaatttctcattgttccttccctggaactatgctaatattttttaccacacgctgagcagcaccagccgacttaatagcctgctcaatgtcacattccattggatttggggtctctccctctggggtccaacttcctgaagatacccctttagaattctaggtaagtgtttggaaagaaaatggcttagagtcatctggtgttttgcaacctacttcatcctctctccatgtcatatgactcaaagtgaatttataaagaattaacatttctcttatctacacagcaaccttgcaagctaggcagaaccactactttatacccttttaacattatggaacatgtagcttttcatggtctgaggatttttcagaaagtacatagcattggggcatataaacagctaagtccaggtatatccagtcatcctgaaagttcagtccagcctaacagattgatcagacctccccctttttatcattcttgatgtacatgcagaaactggggtagcccttataacacgtcaaaaatcaaacaaaccattgtttctggtcccagggaccagaatcgttttcctggccacattttcaaattatcatcacttaaagtgacttgctatttttcaagggatggccttaggaagatccactggatcttaccaggcggttagcttctgtattccctcatgataatttatggaaggaaaaaaagaatacttactttaaactgtccaaacgactaaagtaatttctagttcttctgagccttaacatgtagcaggatgttgggggagtggggaatggacttaggagaaaaccttagatttgaactctagctctgtaactttggagacttttcttagcccacagacaggcataagaataacaggcgcccaccaagtgttggatggattaaatgtgaacatactttctaaacattcaactacagaacaagtacaaagggtattgttaacaaaagtaattgataagggaagaaatatttaagctcaatcaggagaggaaaaagttgatcgtttggtaaccaccgccaaagtcctcaaacttctaaacccaatttttttgtgttttcagtgagccttggtcctgactagaagaagccaattttgaggcttcatgacaaacacttacagaaagttatccaactattgcaatgtcaacccttgcttgctaatatcaggtcaatttaggaattaaatatggaggttattcgcatgccatccatgtctctccatcagttcaaaggataccagcaacagaaggatgaagatgaaaggaggattgaaaattgttcagtggcactctggaggtcctagaataatggatacctgatgagattaaactgcacagcttttacttagagaccattttataaagatcattcacttcacagaggttagaaaaacactttgagaatccatttggcaaagtgctgttaatatgattcttcttacttaattcctttaaattcctcttggattaaaattgtaatacaaagcaaaaaccactttggaccatggtttggcagtagctactgaagcgaaacataaacatatcctatgaccttgccacatactctctattcccatgcatatatatgtatatatatacaactgaaatatgtatataatttaccaaaagacatgggcaggaattttcatagcaacactattcagtacagccaaaaccaattttttttcttttttttcggagacatctctttctgttccaggctggagggcggtggcatgatcacggctcactgcagccttgacctcccaggctcaagcaatcctctcacttcagcctaccaattagctgggactacaggcatgtaccattatgcctggctaatttttgtattttttatagagatggggttttaccgtgttacccaggccagtcttgaacttctgggctcaagcgatccacctgcctcggcctcccaaattgctgccaaggcatgaggcaccatgcccagaaaagcagccaaaatttttaagttacccaaatgcccatcaatagtagaatggataaataaaatctagtatatttccacaaaggaattgagatttagtgaagtatgactacacacactaacatggataattctcacaaagtgttgagtgaaagaagtcagacatatttgcttctattgatggaaactgaaaacaggcaaagctagcatgtggggttagaagtcaacatagtgattggaaggcatagtcatcattggaagaggacacaagggggtttcttagtgcagataatgttcttttcttttttaatttgggtgctggttatagagtatgttgcatttatgaaaacttatgaagctgtgcacttagaatttgtgcatttttctcaatgctatactgcaataaataattttacttaaaaatttggccaggtgggtggatcacttgaggccaggagctcgagaccagtctggcctacatggcaaagccccgtctctactaaaaatacaaaaattagacaggcatggtggcgcatacctgtaatcccagctgctcaggtggctgaggcactagaatcacttgaacctgggaggaggaggttgcagtgagccaagatcgcaccactgcactccaacctgggcaacagagtgaatctctgtctcaaaaaataaataaaataaaataaaataattaaaaaggcatacctctttccccctacaaagaaggtggggggaggtgtattgcagactttctacctaccttgtaagagagagttgatataacatgtaaaatttatggcttttttttgctggtgaagaaaagaaaaaactctatagaacaggatgtagcaagtgcaaaggaaatgcctggtcagggaacatcagattcagctaactcccaaggaaattcaacaccacatcctcaggtccctggttaccctccagactgtgttgtattcctgaataacttaccagaagagactaatgagaggatgatgtttcatgctatcatatcagttcccgctttcaacaaagtatgtttggtacctgggagacatgacattgctgttgttgaatttgaaaatgatggacaggccaaagctgtcagggatgctttgcaagaattcaggatcacagcatcccataccatgggggtcacctatgtcaataaataatactgagggatgaataggtggagcacagaggatttttagggcagtgaaactattccatatgatactataatgatggatacatgtcactataaatttgtctaaacccatagaatgtgcaataccaagagtgaacaccagtgtcaactatggacttggatgataatgatgtatcaatgtagattcataatttgtggcaaatgcaccactctgttgggggacgttcttagtgggggagactgtgtgtatgggagaagggatatatgagaactctctgcaggttccacccaatttttcagtgaacctaaaactgctctaacaaagtctgctaaattttaaaaaatacatttggaatagttgtctttaaagcacttggtgttgtttatagtggtactttgcttcgttttttgtaacttttgattaggccattttaatagttgggaatgggaagggtaaaattttcgttaaggacttacaacatgatctagtcgttagccttgccaaactgtgaaatatgaaggctcgattttatataataaacttttatttgtatcctttaaaaaagttgaaagaggatatataaagtcatgggagatctgctttgccagtgcagatcttgactagagccttcccaatattaactgagctcctgaggcctgggaaaacaacattggctctgttggacagtctctagagttggacagacctggattcagatcatagctccatcccttgctaactgagtagccttgggtgatttcctgatctctctaagttttgatttcctcatctgtgaaatgggcatattacctacctcacattgtggctgggagagtcaggtggggtaaagtttgtgaggtgcctatcatggtgtctggaaacaagcaaatactgaaactatagctgaggcacagaagaagttgatcttttactcatcttttggccaaagtaattgtatagggaatggttgcaaatctatttagaggtttctgttggcatattaattcactggacacttctagaacaccttcttgtgggaagcatggaggtgtagagttatgaagatacaggtgtggcccaattctttaagggaatttataacctagtgggaaagagaggaagaaagctcacctgctttgattggcaccagttactttgctaccaacttgcctttgtttatttaactttcataacaatcctacgtagtaggctcccttcccttcccttcccttcccttcccttcccttcccttcccttcccttcccttcctttcccttcctttcccttcccttctcttcctctttctcttttctccttctttcccccccctccttcctctctnnnnnnnnnnnnnnnnnnnnttcccttcccttcccttcctttcccttcctttcccttcccttctctttcttttttttttttttttttctttcgacacaaggtcttcctctgtcacctgggctggagtgcagtggtgcaatcatgtctcactgcagcctcaacctctgggctcaagtgatcctcccaccgcagcctccccagctgctgagactataggcaagtaccaccatgcccagctaatgtttgtgttgtttgtagagatggggtttctccatgttgcccaggctggtctcaaactcctgggctcaagtgatctgctggggttacaggcacaaaccatcgcactttggccatagtaggttttcttatactagtttttacaggtgaagaaatgagtccagaaaagtgcccaaagtccaattttcagtctagaatttaggccctgggttctcttgctcccaaagcccatgtctttctactctatgatgaaagttagagtataatggtttatttctccctaaactagtttatgcacccttactcagaaggataagctgctgacccttcctctgacatagcacacgtgtttaaagcagtgtttgtgagctcagaagcctcgcagttagtaaggctgtagggctacaggatgttctcatttgtgcagattggctttgcacagacttgtatagagccctctaggctttgtgaaagctgcctgggcagactgatttattcacctttgcccaggatacatatttacggccaaggcacgccctcattatcctgcctgttcatgatgctgcatcaggagaaaagcctcctggaacaggtgagtgtttagcttagagatcaagccagtccagttgcattggaagcctctcccagttgagggtgaaaaaaccagtagacgcaaaaaagctgagtcagcctctgcactgcctttctgcaggagcataacagggaacttgcgtgattctgcctctcccttccgcccatgcacctgccacgtaagcagcacatctctgttactccctttggcttcctcatctcttcatccaccctcaggtttgtggttttggtaccacccagaccagtgttttcccatctcatggtgatctgcatagactcatttcagtgcttataaaataaagacactcatatctgggtcccaccttaaggccatcgaacccatttttaaaaggcttcttgggtgttgcttatgcgcaataatgttagaaaactcctgatctaaagcaacccaccagcctctaggtgtttgtatatccttagtctgaaatcaccatccaccagagctgtgtttgggagagtcttagggactggaaaacaatttgcttattcctttggggattctaagcaccatctctgaatcaagttagatcttttaagataaaacaagaaacaaaactacacacatagtcctcgatagtttaacttcctctatggaagtgacttcatttagtgatctttcagtgctacgtctttggtatttctcaagggtctatatgagaaacaactacttaaatacttcctatcatcagtgaaattcctgtggaagatgtttttctgtcccataactgagggtccctgtatgagaattcctttggtgcttttaggaggtagtttaacagggttaacgtgtggaccttgagtcagctacctgggttctacccctagctctgtcttctggaagcactggtgggtttgggtaaaacaatttagtttccttgcttgtagaacaagactggaaaatagcaccgacctacctcatagggttgttgtgaatcatttaaagtcttgatacaaagccttacacaaagcaagaccttatagaacttcagcccacaatgactgttattaacttagaatcaggaaacctaccttctgtagtgacaagtgtgtgtggccattttttcaaacagtgagactttggcagcctatcagttcctcttttgccctcatctgctaagaagctcacatcacaacaaacatgtttgcctgagcttgggtcttttgaattttaaggttcttgatcaattgttttaaaatcatgtccttctctgataagaatcagccagtcctttttgaaagtaggcagaacataagttataagtggattaaggttgaccttcagggccatcttcccatctcctgggctcatgccacaagtagagcactcctagagaaatggaggcggtaaaggaaagaaactaaaagggactgtcagcagtccaggagctaagcaggttatcagatgagcagattttctgtccaaggatgggttctagaattacaattctctttttctgttcccaggagcatattacatgggctcagggcttagggcattagaatttctcctgggtaacagacacggaggaatcattggttaaactccatttttctgccatcaagaatgttctttctctaccaaaattgctcttctgttagcactactatgtgagcttgtagagggtatgggatttcacaccgaaacatagaattttacagctgaagaggacttgaaattgtctagcccggccctttgcatttttgagatgtgtgtcctgaggcttggagatgttaaatagtgacatatttgaggccctatggatggtaaattgaggtatgattctcagacttcctgattccaaagcttgtagccctttccctgtacctcatgtccacaaagaattcggaactcttttctgctcttccagacaaagggtttcataaaaaatgttgtgacttacactaaattttgcattagagtagatgttatttccccagaatcctggtttgtatgctaaagttcatacttcaatttagagattaactaaatagcaataataactacagatgtctgatttaaccagcactattaaaggcaaacaattttttgcacttcaaatgtgtaggcaggtactttgtaaaactcacctaaataagcaaattgtcagttgttcatagagtttcatgctagccacaatgtagtctttttataaaagcattttgaatatgtgaaaatgcagaaatggggacgtgatttttttttttttttttttttttttgagacagaatccggctctgttgcccaggctggagtgcagtggtgcgatctcggcttactgcaagctccgcctcccgggttcgcgccattctcctgcctcagcctcccaagtagctgggactataggcgcccgccaccaagcctggctaatatttaatattttttttagtagaaacggggtttcaccgtgttgaccaggatggtctcgatctcctgacctcgtgatctgcccgcctcggcctcccaaagtgttgggattacaggcatgagccaccgcgcccggccagaaatggggacgtgattttttttaaggagcagggtacaaagatagatggggaagagcagtgatggcgctctggtgagctctctagcagcaccgctggccactcaggctcaggcaggacggctgccagttatgtgcctggggccaggtatctggtaaaccaaccttcatgccgttgtctgccacaacaaagctcctgctgggctttaaaagtttatagtcaacagcatcctctctgcagtgaattgcaagcttattatctgtttcttatatgagcgctatttagtctttcattttgctcatgatctgaaatacttctccttctcctaaaaataactccaatttaaatgattttgattcagcaacatctgatttttggtaaatttgcatatgcactgccgtctgtgttcagctctgttacttttcctggccttgtgcacatggcttctctgtgaaccatcatgggtgcctatgtaaggagaaatgaaacagaagggtgtctcacacatgcgaaggagggcctcctttgtcttgagcatctgaccctggagcctctcaagcctgcactgctgcaaaaacagaacgactcctcaatgccttttgactctggctcaccgaatgtcttgacatgttcagcatcttgggatgaaggaaatacataggtcaagacatccctggcattacaatgggctagggttaggttttttagcagtgttttctttttatataattattttattttatttttaagttccatagtacatgtgcaggatgtgcaggtttgttacataggtaagcatgtgccatggtggtttgctgcacctggcaacccatcacctaggtattaagcccagcatgccttagctctttttcttaatgctcttcccccgccaccctcccccaacaggctccagtgtgtgttgttcccctccctgtgtccgtgtgttctcattgttcagctcccacttgtaagtgagaacatgcagtgtttggttttctgttcctgtgttagtttgctgaggataatggcttccagcttcatccatgtccctgcaaaggacatgatctcattcctttttatggctacatagtattccatggtgtatatgtagcagtgtttttactaatgatttatagagcgaagtcctgccacatggggccttgatgtaacttccattcatcttgtgagttgatagaactcttataagttgatgtaatttcccttcatcttgtgagttaatagaacacagtgactctcctatgcctgcccagggcatccagagagccttttactggcatccaaaccacactaatgtgccttctttttgtgaatgaccttgggactgtctctgagcagagagttattacattgttattcgtatcattattgttattactttgtgcaatgtgtcacaccattttcaaaatgtccttttggtcatcacaccagtatcattgtgaggtagttacagcagtgacatactgtatggttattagtggtggtactgggtaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacagcaacacaaaaatatatttttgttataaagggttgagcatgatatagctgcaaaggagaatgtgagggtcccttcctttacttcttcctgactctcacctcttgctccaaaggtaaccacagcaaactagttgtatattctcgctgtcttctctctaagaagggcacacatataagatcaatatacatatacatgtgtgtcctcgttgatgtaaataatcataagagtgtctgccttacaggattgatgagggggttgaagaaaattaggcttttaaagcacttaacatggtgccaggcaatatactaggttcctaatagtgctctcatcaactgcgtggggtaagttctattatttctacccattttattgatgtggaagctgaggattagagagattgtcacctgcacaagatcacacaatactgaaactggatttgaatccaatcagacttaccctagtgtctcaacagctttggccactagcttatgtggttattttataggcatgatttttccacttgattattttctcttggtaatattagcttgaactgtttccatgtgtgtacatatgagtttacatcagtcttgtaatggctacatgtgattcagtattgtaagtacttctttattggggttgttttctggttttgttgttgttgttgttgttgtttggtttggtttgcttttgagatggactcttgctctgtcacccaggctggagtgcagtggcatgatctcagctcactgcagcctcagcctcccaggctcaagcagtcctcccacctcagcctccaagtagctgtgactacaggcgtaagccaccatgcctggctaattttgtttattttatttgtaaagacaaggtcttactgttttgctcaggatggttttgaactcctgggctcaagtgagcctcctgcctacgtctcccaaagtgctgggattagaggcatgagccaccacgcccagactggaattgatttttgtataggttgtgacttaggaatctagatttatctttctctaagtggagaaccagttgtcctctctatttattaatccattctttcggctcatttgaaccattacctttatcataaactgaattctcttgtatgtatggctatgcaactggttcctctcttctctactgttgatttattttctactcccatgcccatactaaagtactttaattattttagacttagaaaaaaattttatgacaggaagggaaaatccttccttattgctgttctctttcacaaaaaagtgtattttttgtgtgtgcatttattctgtcacgtaaacttacagaagcagcctgtcaaggtctatagagaaaattcctgtgggtatttagactgggtgttgcattaataggttcatttttgataaatcagcatctttacaatatttagtttctccatctagaaatatcatacatttttatttaggtcttttatgttcatcagttaagttccataatttgctttgtgtagatcttgcattggagggtttattagttgttattacaaatgggatcccattttcccattacatttacttaatttttattgctagtgaataggaaataatggtttttatatgttaattttttatctagccatatgacttaatttttgtattcgtgatctttatacttatttttcttgacatcacattggccaggaggaaaatgatgtagaatgatattggtaaaagtgtacacctttgtcttgttcctgtctttaatgagaatgcctcgaacgtttcaccactaaatatgataaatacacttgatcagcttgaagacatttctttctatttgtagcttaccaggaggtatgcttttcactgcagacgacaccatggtcttgccaaggggcctttattttttcacttaacattttccttaagagtccagagattgcccggactaacttgggcctcccagcactggcatcctagctgagcgaacctggtttagaactgagcacttaggactgagtaatgtcttctttcttcctcctttctgctcacatttgacttcagatgtcctacaggcaggagctactttgtgttgatatttcccgccttctctcgccactctcctccagccctacccttccttctgcagaaaagtaaaaaattttacaaataaataaaaagtagcatgtggacgaggacaagagcaccacttctggaattttctggcaggcaccactgaaaagatttttattcctaacttctaatttaaataacttcaatttttttttccacctgattatcttaaagggctaaccaccacctcacgtgctggttgctaagtggatcttgtagtttttacaggaaagtatgagaaaggaattaccacgtgacatctgatttcctgttgcagtttcatgcaggttctgatgcaggatacagtcatttttaactctttctcggccactgccttgtacatggttaatgcagaataaatgttttgatggtggattgatggaaatgatttaatcagagtccatctgagagttcttaggtggtgatgattttttgctaggctgtgaacgaaaggatttgttcttgtcaagcatgtatgtggagcatgactctaatgtgatttggcacctgtctagaaaattgtccctgtatccagtgacactttgctttggggaagtcaacacctgctgtgatggcatctgtcatatttaggaatgtgaaatgcacatgaataatgcacagccaccttagtaaaatgccttctccagaaaactcttcatgtaagccactggcaaaagattgttgcaagctgcatagaggagacttagggccccccttgagataaaaacagtggatgatgtattttactatagcttttctcaccttgatgccattggggtagattttattattttcagattgtttagccaagaaagcaagaacctgctaaatataagggtcatttatttttggttggtttgttagaaacagcattagctcccaacaaggtggggttttggggagatggagtgactcatctcaggcatatggtgtgttagtggcagccatccaggtcaagagggagacatagaagccagaaacaccgagaggcaaggcagccccaccaggcagccacgagtagctggccttggagcccctcccgatttcagtgaagttggctttagcttccggggctgttggtgtaggaagtttggtcaattagacaattatttttcctttttcagcatcctctcttttcttctaaatcatcaagtccagaaaagattctggaatccatgacaaggagcagactcaacgttccctaccttttctcttgcaggcaggtgacaaacattaccaccccagctgtgcacgatgcagcagatgcaaccagatgttcacagaaggagaggaaatgtatcttcaaggtgaggtggactcaagaacactagaagttttccttgctgggggaaaggaaatcttgctatgtttgtttgattgtttttagagaaggaggcatgttattagctgtgaggctacccaaatccaagaagattatggccaaaagttacctcatcagttagtattaatcagccaagcagttgacatgctggcagtgagcccctcaggctgttcacgaatgaacttgtgatgctgccttaatcaaatgaatggaactcgacatttgatggctcggatgtgagggaagagtgaaaatcagcaatatctcctctccaactctccccaggaatatgcttaggaaacaaaagattaaaataatttctagaaatttctagaaatgttacttatttgatggctactttttttctccttttactctcctgtgagaagggctttttgaggcctcccaggctgctgttctctgggttttcaaaaagaaaatctcatatttgatgaattacgtcacagacttgtttcaccccattaagttgattagctcttatattgagagagagagagacagagagagaataggagataacaagagagaacccactctctgaaagagaaatttctggtgtcaaagaggtactttttaccagggagccattggaatcccagcactttgggaagctgagttgggaagactgcttgaaccgaggagttcaagaccatcctgggcaacatagggaatcctcaactctattttatatatatatataaaatagaccatatatatatatacacacacacacacacacacacacacacacacacacacatatatatgccgggcgtggtggctcacacctgtaatcccagctctcagggaggcagaggcgggaggatagcttgagctgaggaattcaagacgtgcctgggcaatatagcgagaccccgttctccacaaaaaggaagaaaaaaaacaaaaaagacaaaaaaaataagcatacatatatatataaaggaccatatatatatgatcatagtttttatgaaactgattatatatatatatatatgatcagtttttatgttctctgaaattctggaacttctcagagaggctttgagagaggattctcttctagtcaaacagcaccatctgtgtaagcattttactgtttttagctggaaaagagttattaatcaaacaagggtttattaataaaattagcaaaacccataagagctattgctcgttccgttgtggtaattactgggtctcaactacctgtgcatgtcatttcttgatttctctttgcacatggcactatgtgtacctgtaatgagttgttcactttgctctctcaattttgtttttaggcaacttaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaagcacccgcatctgtggcctcatgcgggatttatatgacacgttttcccaaggacaacaggccttacatctgcagtggcaataggcaggtgtcactttgcatttctcagcacaaagcagatttattctttatttggtctgtgggcttagattttagcatgtcaattctagcactcaaaagcaaagacacaggagtgccaatcaaccctgtctctgctagaaacagactcagaggctccgggtgcagctctgcaattcagagtggttctggaggctggagagagaaggtttcaagcagtgcacaaatgcagcacattcgggctacaaataaatggctatctgttgaggctgcatttggaattccagggattgctctaaaccttctggagttgtgcttccgtagcctttgtgtgccctctcggcacatctttgaagaaagagcagtttcatcttcttcagcatctgatgttctgtccgagtcacattccttgtgtgcctgacctctggagaacaatagtgccattgtgcgcagacccggtgtcctggccagtgactcctgctcagcagaaccttcacggcgaatgcttctcctgagcctgcacctgacccctgggccctctgcattcagaggatttcctgtgctttgtagttagcctttgagccagagttagtgctgaagggacctatacgtctgtctgctttttgtttgatttttttgtttgtttattttggccctgggttaagaagatggaaaaaatgattgttaaataaggattaaagtattatgctgatataaaatgtattttttcttgccattaatttgatattagttaagctcagtggtgtgaaataactcatgagttattttaatttggttacttttcaagtatgcacaggttgttgcttaaaagagataaagattttggccaggtgtggtggctcacgcctgtaatctcaacactttggtaggccgaggtgggtggatcgcttgaggtcaggagttccaaagagcctggccaatatggcgaaaacctgtctttactaaaagtacaaaaatcacccaggcatggtggtgcatgcctgtaaccccagctacttgggaggctgaggcaggagaatcgcttgaacctgagaggcagaggttgcagcaagctgagattgtgccacttgcactccagcctgggagacagagcaagactctgtctcaaaagaaaaaaaaatgaggtaaagatttaagtcatgaaatgtggaaactctgatattcatactgtgaattttatttatgtaatttatgctttcaacatagtaactttattttcttaagtcttcttaagtgctcatttaagttctgtccatccccacacttgaatgtgtccttacatggacatatcagccttactcataatcatataaatgacatatttgatatgtatctagtcatacaaaatcatatgagcaggcattggattcttataagagcttctattggagataagtgttttgtttaattctgtgatgctggtaccacgcattaaagtgcttcataatatgagaaagtgagactgttgactcaggaacagaaaataacacctaaatagttacttcactagtttaaaagcaaagactttttagaaaattacttaaaagattgaaggccaaaggcaatttttggatttataatttaactttcaccctttctactagttggtttctcatttctctgtaggtgactatgtataattgaatcaatgaaaaattcagtaagtcttgcttctggacatagactatctggttgactttattcccgtcaactaaactgcttggttgttttgatgttatataaacaatagctattattttttaaattaaatgcagcttgtagtaagcactcaggcattccttttaaaggatgataataaggtttaaaaataacaagacacgattaagaactaaatatctcttgcatcaaaagactcatgcccagttggtggtctctgtggtctagaattatgacctttatcaaacaagcttgggctagatcaggaaaactcacttaggctttggacatgtctgatttttgtgttatgattcacttggacataaagcaataacaccttcctatgatggggaaagagggataggagccattctcagaagtgctgtctcagaggactttgtatctttccattttcctggctccttagtagtgcattctgtcttctcaggctccaccgtttggcatcccgactgtaagcaatctacgaagaccgaggaaaagctgcgggtaaggacacaattaaaacatgatgccagctgcatttgtaggccatacgctcgtggtcactaattcttggggctagggtttaggtgaaattactttttactgactttttcccttatagcaaactaagttcaaaggccatttggctagggaaagggttcccctcttaccttaaacgtactgtggtttttattccaaatgcttgtgttagacaaagtaagccttggccttactagtcagcttcttagaaaagcattcaagagaaaagtcaaatcatgcagatgggaaaacaacgactcatcaggttccaggtgcagcatctgctgacctcaccagactgttttggtgcttagtctataatgcactactctgaccccagctctacattggcacattttactggtctctcatttactggatccaaattcaccagaatagactctaaaagctgatggcttgtcagataaaacctttggggaaaataataaccaaccaagacaggtaaattagtcaattctcggaacacctccagatggcagtattttatgtttcagaagcaaagcgctgtacacagttgtaaaactgtgatcataattctctgtcctgttcagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacaggcgtagtcacctggttgtgggctctagactctgggatttttgagaaactatggatgctttggaaatgagttacctttataaaatatgagaacataaatgatcatccttattgtgacttttatcgtaagaatgtaaagttcacagcatagcttgaggatgctgcccagaaaccaccccagtagctatagtagtttgtactctctctccagtgttgcttttaggttttctaataatcattttaacttcatctctgatgaagtcgtttgggagatgaagagaggaatgctaatgaggccagactgagtggaatgtgggtcttttctgtatcaggattgcttgagtttgcaaatcatgtgactaaaatgatttttaaaaaccaacaacactctgataacatcttgatggaaaactctctggataagcttatgaaaacaactagtgaaatacttccacccattctggccaagaggagctattgttttcttcctttagtaagacttccagagaattctaaagctcttctcctaaacccagcattcactacgtgggaggtcaggacagtgctctgggtcactgtctttggaaagctcagaagtgaggaagaggctcccacgtacccagagccggggttcacactgatgttggtagggtttaaagggaatacgttttgaacagagaaatacatcttgtgctctcttgagggtgtgtctacacatcacaaatcttgagccaagatttccaggcctttcactgcatgtcacattagtgcagtttccatagcaaaatgaaaatgttttaagaatctttcagcaacccactgggtagtccacattttttatatttaagaactcatggggcatttgtaacaacagattctcaaggatggctctcagttggcttcactggctttcttaccctttatatattgtaagaatgtctaagccaaaataaatggagaggaattgaaggaggttggagcttagataaatttactgtaacttgaagaccagttaatatgcttttaaacatgggcccaaaaatccacatgtacatcaatgaaagaatcccacttgatgtttactctcaagttagttttacctaaggtggttgttgttttgttttattttttaaaataattcttctgatttgaggctatttctgtgttcgttcttcccttttctcatgtttcatggcagctgccaaacattcggcgttcttcatccgatttcttttattccaaaagtctgattcgacgcacaggacggtctccgtctctgcaggttggcattgtgtctaggctggggctcgaagccactgtcctgggcccaggcttctgttgcttttcccctgggctgcttttctcacataacttcttcggctcctgcagaaagcagatgcttttctcacaccacaagcgcctctcacactgactctggctgttgtcttcttggatggatgttttcattcagagcagcagctaaagctttgtgtctgttcaagcaagcacatcagaagctatcttttggtcccgtgttgccacgtttgttcactgcacaagtatctgctcagcacccaggtatagagctgggctggatgtggcagatccagcctcataggcaagaaaagatgataaataattataagagtggtacagaaacccatcccaggctatggctcatgtaggccatgctccttggaatgtcagatgaggaaaaggtttccagggtcgcttcctgggagaagtggtcttggagttgatttttggaggctggctgagatttgcccatgaggggatgaggagaaagtggtggacctgatgaggagatgtgaagtgtgcagccgggaaaggcagtgcttgggtagggagtggtttcactcaagaaaggaagagtgagaccaggcacagtggctcacgcctgtaatcccagcactttgggagaccgaggcaggcagatcacttgagatcaggagttcaagaccaccctggccaacatggtgaaaccccgtctccactaaaaatataaaaattagccaggcatggttgtgggcgcctgtaatcccagctacttaggaggctgaggcaggagaattgtttgaaccctggagacagaggttgcagtgagccaagattgcgccactgcactccagccgggatgacagagcaagactctgtctcaagaaaaaaaacaaaagaacagtgaagtgggaaaggaagaaactgagaacaggcacctactctatggagactgggggatttacgtataatctcatttcctctccctaagaattcctgcgaggtagctaatcttattcccattttacagatggggagactgagacccatcatagttaggtaacttctccagagttactctactggtaagtggaagagctaggattgaaaaccatgtttccgtgagcccttcactcatattcatcctgctatactgcaaggggacagtgagagaaaaacccgaaagaagcagaagaaggagaacattaaatactggctaaggctgttgtcagggggccactgatggagtgtaaggaagagagacgcaccacctgcccggggcatcctgcaggggaagggagaggactcaaccagcccggcagaggaacagccaggctggagattatgctgcatgcacagtgtacctgaccgtctttaggggtctctgagaatcagtggaaaccttggcctgttaaactagaagcgactttctacaatctcatctcagcccagatgaaacctgttctgtagctctgctaacaattcagggttgcactgcagcactttggctgggctgtgtgcctgtacattctgtgcctgtcagaactgcgctaaggataagaagagtttgagtttctatttttgttaaaccttcaccttctttctttgcacgatggaaaagacagaagtatagaagcttagagtagaagagaaccttttagaggtcaaccccctgagtttcctcattgatagaatgaagtcggatgggctggacatggtggctcatgcctgtaatcccagcacgtcgggaggccaatgtgggcagatcactagagcccaggagtttgagaccagcctgggcaatatggcaaaaccccatatgtacccttccaaaaatacaaaaattagtgagggatggtggtgcgtgcctgtattcttagccactcaggaggcttagatgggaagatcacctgagcctggggaggttgaggctgcagtgagccaagatcatgccactgcactccagcctgggcaacagagtgagaccctgtctcaaaaaaaaaccaaaaatggacagatacagcagcatgtctgagactgcacaggctgtcataaacagcaagccaactgcacacttcagttcttgaccccaggcctcagtgccttgcgttgtcccgtgatactgggttcctatgatatgatgtatttttcatacaatcttcattctgtgttaaagtttcagctccagtggcagagtttccacacacggtgaagtcaaagtcacatgaatccagaggaacagccaaagattgtccccactttaaatgagtgttgctcagaattaagtgcttccacttggcaagaagccactttttcaatagtttttttttcttattttttccagtagtatactgttaaatagtattacattttgttagcctgtgtctacaatcaagtaatacattttcatgacttgaagaaaaatgccatcatcaagtgtgaaattttttagtttgccccagacctttaagcttaagagatttggagcatcttgagagacagagagggagcgagagaggtctgttttcaataacttctctcctcctatcttgttgttcaaaagggacatctgattcctattatccagctgtaactatcaatgaagtcaactttagctccatcacagaaagttgtaaacagctggggacctggcagagaaaatgggctgtgtggcaaggtctcccttcacccgttggcgattgaagaatggctcaccagtacctttaagattccagaaaactccaaagcaatgcagttctcaagtcacagatatgttatcttttaagtacttttggctacacagcagctcattttccaccacttaaaattcagtacccttagttattagataaactgtcttccttgcagggacattcagtactctgtgctgcagaaataaatcctggttttgttgtagaggaaagtaaaatctatagcaggaaagtcatttttgttatctatattgagaatgagctccatcttttccttttgcctgaattacaggtaaaagaaaatgatgaaaatagaattacctaagaaaaacgtattctggttccactcacttggaagttttctatgaatagcaaattttgtctacaggtaaaactcagtactgagcatgtgtaattcattatacacaaagcacatggtattcccaggaccaagtctgtaataatctggggggtgtcacttgctttcattctaaaagggagtttttctcagccatgcctttggaggttaaagcatgaattgactgacctacaaaatgggtgtgacttttttctttgaaactaatattcaccaattataacatatgcacttgtcaatctataatataccgaacaaataccatgtgtatatttttaaaggagctaatttgaggctttatgtctgtcaagaacaagcaagtaatgttagtggtgtttgatttttgttttgttcatgtcactacaatacatactgttttactcccagctttcacttcgtccaagtatttcatccttttgagtgtgtctttacagttcatcagacagctgaatgtagaggtgtaaagatttatactggaaagatttcatgtaataacggctgatggcatttgtgaaactgtccccagagaagtggtgtgtgcgcacagcaccctcctgcctcctctccaaacacaaaattcttttttccaaaggagttgatttcactctttctttgcttagcagtgggcattcagtatgtgcaggttttaaaatattcctttttctgcagctgttatccccaccttgtctagtgaacttcaacaaaaacccaaggcaggtactgtccacatcaacaggacttagtataaggtgtcagtcaccttatatcagtagttgtcccatcagtgttcataagatcattctgatctagttgccagatgcctgtagtttctctccttagagcatggctttggataaatgcaaattagatgaatatagttgttgcatccctgctcctgctgaatggggggagggcaggggctacaaagtgcttcccagcactgtccttctaggcgacccatgtgcatggtggatcataatggaaagtaaatggaaaatgtcatttatctacttactcaaccggcagagctctggtaagtgtttttaatggttagtatttgaagaataataagacctgtaatggaaacggaagaggatgtcttcaattaatttttgttctgtgactgtgccttctgaatggtaggacagatggacaaaatcaaggcataggggaaaaatagctgaaaggtatttagagggcttttcaaagagatttcatgaagaaaacaaaaagatgtgctttttaaagcatttggctacttatttgtaattaaatgccatgttttatctctcctgttgaactgctagtcttctaatgaggcatctctttgttatttgtgtgtgtgtgtgtggaaagtaaaaatcgttgttgaaatcaaacgtaaagacatgaaagtgtgctggggagataactatagagtaaatggaccccttcatcatgacagactgaatgagaacagccatatcaacaagaaggttcttaccgaaggctcctttcttccttttgccaaaataaggtttcacctacttgcctcatcttactggcaaaatactctgagcgatcactaccatatataattctgtatctatctaccttgcctgctttcttcatctcacctcaccccacctccatgccaaagatggcatcagaagatgccaaagatagcatcaaaaggaagaactgaatttctccaactgcactttcgagttggtttttctgcaaggaaaaggtgcttaaatgaaagtaaataaattgtacctgcttttagtatgttagccataagtccttgctgtttcctttattctgtagaagtgagcttacctttggtgataaatatttgaaattgtatgcatttataacatagaccagagagtaatttttttttactgtaactctcataaagaattccagaaacaaggcttctgacccattgggttattgagttcagttcataattattgggtcactgttgttaccctggacatctgaatgggtggaaatggtaatttagattaaataactacaggtaaggatcatcagttacatgtcacgatcacctgtaaaattctgtgatgaccaaagaggtgatgatagggttgggttaatggtaaagaagaaactgtcagtgggatttgaaagtgggacagcatgtcagtaagttaagtgctttcaagattgagatggtttctgtctgagtggatatatgttaatgtgttggagaacagctctgagccttttgaagatatcttagccataacagcaaattatggattcattaggaaaagaaaaataacagctggaagaataaaaatggttcttttaataaacaagatgttaatttgaaattcaacatgtttggaattctagatgtttcaaattgaaatgtaaaattctaagtatctaggattaaaagtccaaaaataatcattcaatttttaaaaagtaattttatgaccttcataagggagagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctgtgtagctcacgtatgaaaggaatattcatgaagagcaaaacagaggcattatttgagattaactgcctgagaaacctagtctaatcccaagtgtctagaaaatgttgactacttgccatgtgcccagtaaggtgcttggagctttatatgcatcctctcatttaaccctgtgacatagttatgctggtacaccttgctgcgttctgtacatgaagaagttgaagctcaaggaagttaaaagaaaaagagaatggaaaagaaaaaagaaaaactcatgtaacatcaaacaactagtagagcccaggtttgaactgttatttggcaccaaagccagccttttaagtccactgtattacactgtcttacataaaatacatagatgtgttttatcccattatttcaatatagacaggtaaacagaattgggccattgtaagaaaataagcaagcaagaatgcaactcaacctgcaaacaagatgcccatggaagtaaattttaccataaacttaggaggtcagaatgaagcaaaaacaaacagtggtaaattcagtgaaagaaaaagcagtttccgaatctccaagtgtattagtccattttcacgctgctataaagaactgcccaagacggggtaatttataaagaaaagaggtttaattgacccacagttctgcatggctgggaaggcctcaggaatcttaacaatcatggcagaaggcaaaggggaagcaaagaccttcttcacatggtgtcaggaaagagagagcatgtgaatgcagtaaaaactaccatttataaaaccaccaggtctcgtgagacttctctcactatcatgagaacagcatggggaaaaccacccccacaatccaatcacctctctccctggacacatggatattacaaatcaagatgagatttgggtgggggcacagagccaaaccatatctccaagatacatcagggcatttctcaacactaaagtttgaagatgcgagtagcagagggatggctctaagacaagccagaacatcagcaaatttgatgaccagttcacctgactttgaaaactgcctattaaaacctaaaatatttatttctgaatcagagaacttgggggtaagtgtattcaaattggaggtaatttggatctgaaaacttttaaaaaccaaatgggtcttgaaaaaattcaaattgttgaataacttttaaaatctttagctcaacagtattaatagtgtaaataaaaaaagataaatgtttccaagaaagcctgcataactcacaggatcccctaatccagtcaagaaggaagggagaggccaggcgttatggctcacgtctgtaatcccagcactttgggaggccgaggcaggcaaatcatgaggtcaggagttcaagaccatcctggccaatggggtgaaaccccatctctactaaaaatacaaaaattagctgggtgggtggcaagtccccgtagtcccagctacttgggaggctgaggcagtagaatcgcttgaacctgggaggcagaggttgcagtgaagccaagatcatgccactgcactccaggctgggcgacagagtgagactctgtctcagagaaggaagggagagagaaactgaagtgaaataggctagttctgccaagagaactgcctttactgcccacgaagctcttcatccctggaaggtgctgttaaagacccttccctacatgtgcgtgcgttgttcttcagctctgtttctaccagtacatgcagtacaagagcaaataaaaccattcagagccatccccaggtgcatcattacagcaaaggctgaaagtatccttgccccacacttggcaaaaataaggatgagtaacatacgagtgaccccaaagccccagtgtacactttggctgttcacacaatgtcctggatgcttgttaatgaaaacaggcctttgtcatagcaaccccagtaaccgaagacatctgatgctcctgccgcacaccctctccccaccccaacccagtgagctattgcagtgttcttacagagctagcgcaacaaaaatattttcagttagcaagcattcttttctgctacttgatctcaatatttctcttttagtttcaccccatttgtcccatagttatgttgataggaaataaatgatcacatttgccctgcaatacagcaaaattttagtgcagggcttaaatgcttgggctgtggacctagagtgtctgagttcaaatcctgactcttcatccctttcctacctgtgtggcttggagcactgatactttttccttatctgtaaaataggaataataatggaagctacctcctagggttaccgagaagattacatgagattaagcctgggaagtgcttggcacagggcttccacgtagtaagtgggcagtagacattcgttgccatcgatattcttgggttgctacttaagaggtttcattttgacattaagtttggaaaatgtgagatcctggccacttgaaactgaaggactacctgtggttaataattatctcacagagatggatacaggttcagctttttcagggggtagcatctccttgtaaaggaggaatacattttgattgtgccacttctatattttgattaggaaatggatctagaaattgcactttattattattattattattattattattattttttgaggcagagtttcactcttgttgcccaggctggagtgcagtggcacaatctcggttcactgcaccctccgcctcccaagttcaagcgattctcctacctcagcctcccaagtagctgggattacaggtgcctgccaccacacccagttaattttattgtatttttagtagagatggggtttcaccatgttggccaggctggtctcaaactcctgacctcaggtgatccacccgcctcggcctcccaaagtgctgggattacaggtgtgagccactgcgcccagcctgcacatttcttgaatagtgttatgtgagtctttcctttttcaacatactcagaggtagaattttctcatattgagatatgcctgtgattggtataactctagcaggaaagcgcttgtgcacggcaggtcctggggaggaggcccagaagtgatgcacctggtgcacctccacctgggtgtggtgtgatttctcccagccacttccaccctagcatctcaaagataccaggggcattggctgaaaaagactgatcacagtcttccagcaatgagtcaaatcactgcctgacctgaattggccagatatgtttgccttcattgcttcaactgtgaacagcatagtgagacaacacccttgtctgaaggagtttctttggctcagtggtgcccacattcaaggtattaaacaccaatagaaactactgagaaggcaaggtcttattcctattgtagaactataagttactctctttaggaaatggctgcaacagaggggaggaagtgttccaaaatgaggccttgagttttctctgcagagctttccagaatatgttaaacagaagcaggaggcagctgatcctagttcataagtttccttcctgctcacataaccacctctcactctccacgttcttcaggtatatactatgaagtccagtttctttcatccttcccaaaggccgacccaccagccttacctcagtgactctctatatagttaggctcaaatcgtgtaattaacataagtcaagtgtctgcaaactaagtatttgtttacaagtaataaattctagctcattccctcaactaggatttgtgccttctgtgtacctgtggaaagcattgggtatagacagtggttaaaaaataaactctatgagggcagagagcatgactaaagttaatgagggagacagacacgatgcaaggaaaacaataaatatataattatacattttactcatgaaggaaaaaagaatgacactatgagagaaaacaacatggggaaccaactctggattgaatcagggaggtcctctctgaggaggtgatatttaagccaagactgaaggaagagaatcatccaagtaaaattgggagctagggcatttcaggcagagggagcagtaagcgaggatgagaactccgaggcagctttgtgcgctgtgttctgtgagtgatgacaggtgagagacgaggtaggaggggaaggcagggatagaatcctgaggccctggttgttgtgattttattctgaatggatgcttctgttaggtctgttctcatgccgctagtagacatatacccaagactgggtaatttataaaggaaagtggcttaatggactccagttccacatggctggggaggcctcacaatcatggcagaaggcaaataagaaacaaagtcatgtcttacgtggtggcaggcaagagagcttgtgcagggaaactcccatttataaaatcatcagtctcgtgagacttattcactatcacaagaatagtatgggggaaactgccccatgattcaattatctccacctggacctatccttgacacgtggggattattacaattcaaggtgaaacgtgggtggagacacagccaaactatatcaatgctggagacaaaagcagagtagtgaccatccaaattatgttcttgaaaggtctctcggctgagtgcggtggctcacgcctgtaatcccagcacttggggaggtggaggcgggcagatcacgaggtcaggagatcaagaccatcctggctaacacggtgaaaccctgtctctactaaaaatacaaaaaattagccgggcatggtggcaggtgcctgtagttctagctactcgggaggctgaggcaggagaaaagtgtgaacctgggaggcggagcttgcagtgagccaagatcgcaccactgcactccagcctgggcgacagagtgagactccgtctcaaaaaaaaaaaaaaaaaaggtctctctatccattgcctgccaggtggatttgatttgaagaagggaggggagaaggcagaaaactcacagggaggccattgcaataatctggatgaatggaggtggtgactggggctgggactacggcagtagagagggagagaaatgggaagctttgaggtgtgctcaaaggtaaaccagaaattctcgtaggggacaaggagcaggaagggccagagaaaggcctccccatgccttttcaaaactggatcgtacaactagtttgcatttacctttccttctaggttgtattttaccttattcaaaaaggtgataagtgtttctttttttcactagctgagtttttagtaaagcttaagggcccaggacagtctagattctgaagccagggtccgaagtcttacaagtcactgtttattttacagcctaccaggacatcctcggaaagtatttattctaggccaggctccagtattcctggctcaccaggtcatactatctatgtaagtatctacttctggaagtgacatttctgggacaggtaaattagtggattgtaatagcagaatgggtaatccaaaacaaaaactgattcaaagtgatttctatttttgttatgagacctgattttcatttttgtagaacagtctcctcaatcacttttacctttaggtaattacatttatgtgaccatcaacagagtgatcagacgacctgtaaaatgtagtaatatgttgcgggacttaaaaaattcttgcacctaagactccgtctcaaaaaaaaaattcttgcacctaaattgcatatagatatttggggattaaatatatattttatgaagctgatactgagtgttcctaaattctaccacaaagatatttaaatatttagtttattaattatgcggttcttgtttttagccatctgagaggattattggaccatctgtttgagctttttcctttactatcataaattcaggaaattatccttaaggtttgcacatttatctatttcatgaattctacacagattttttcctaagcgttcagtgacttttttaaaaaaacatgattaatatatggtataaagggcaacttctgaagagtataactgtgttaggcaagatgttttggtttttgtttattttaaggccttcactttttaaacaacaggaaatgcgccaactacagtttcctaaagcagtcagactacaaggtaattgttctttctggttaactttgccaggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagaggtaatacattcctactggttgtgagttgtacaacaatttaccttcccttttgtcacatttgtaataactaccatttggagttcaggtaaatcaggtggtcttttgtctgcctagtatttgcagatttctagaccaggtgctttgaggtattcagaagcccatcatgagaagtgggagaacagaacaatggcacatcaaacaacagtgaagaccagctaaacattagcatgctgggatggaagctgtcgggaggtggggagggggtggggattgtgtgagctgggcagagcaaataagggagtgagggtctcctgggggtcttagtctagtgataagctttaagtatattcatggcatcatgaggagagagaacacaccccctaaattttggtaattacagttttcagcaacttaagaaagttagcatgtgaaagaaaaaataaagtagagcgcatggggcaacagtctagcacaggagtgtgagccagcattctggaatcaaattacctggtctcaacccagggatcaccacatgccgattgtttgactttgaccatgtgacagccattctgctgctagtttcctggaccaggtacagtgctcatacctgtaatcccaacattttgggaggctgagggccggaggattgcttcaggccaggagttgaagaccaccctggacaacatagttgagacctcatctatatatattaaaaaaataagaaaaatggtcctagtttcttcatctgtaaaacagatagggtgatgatagaatctacctcatagggtgttagtgaggattaagcaagctaatctatgtaaagcaattatcagaggccagacttgggggaaatactgagcatgtggcaatttctaccattgttgctacctgtcctcttggggctcgttaatactcggcctgcagacccatctgctgcgggaccagagcctctcagccccttggggtcctcccctccccggtcccatctcagggttgaaggttctctgtggtcgcttcctacccaagtccgtttcccctggccaatcggctcactctcatttttttctcttttattttttgaattagaatcatctgtagactgattttagtccacaaagatgttaacaaatagctgacaaatcagctattcaacaaaggttaaaacagaatataaacaatctagcatctcacagtgctttgaggtcttggagaagaaaaggcatgaaaatgtgattctgtttaattgttctcaattccagatgtataatattatttgataattatatttatgtttattttttattttatatatattgttccttttatttatttactttctaatctgggttttattccagagcatagctctgcgtggaaaaggtccctgtggcaggaagtgatatccattttcatgtagtgccacctagtggtcacttagctgtagctgcacttgcggccgctctcaagcgcaggtgcattggcccgggttgtcagttgccattgaaccccacagagtttcgtagggcataagaggcgaggggaagttcctgaacaaagtgcatagagattggccttggaccctgtggatgagaatttactaatgtttaacccatacaagcaaggggatgtgagtttttttaatggtgttaaggatttggggttcatggtgtgcagtgtacgtgtctgtgtgcgtttcccagcagctccatcaaggcagtaaaacattaagcactcaagagtttgggctttgaggtgaaaatctctgcatttaaaaccagactctgccagacatggtgactcatgtccgtaataccagcactttaggaggccaaggccaaggtgggtggattgcttgagaccaagagtttgagaccagcctggacaacataccaaaattccatctctacagaaaaaaaatacaaaaattagccaggaatgatggcacacgcctgtagtcccagcaacttgggaggctgagatgggaggatcacttgagcccaggaggttgaggctgcattgagccatgatcatgccattgtactccggcctgggtgatagagtgacaccctgtctcaaaaacaaaacaaagcaaacaaaacaaaaaccaccaccacaaaaaaagaaaaaaagaaaaaccagaccgatgctgactaaccacataactttggggaaattatatacctcaatctccttatctgcaaactcaagatagagaacaagaatacctatgctagaagttttctgtaaagagtaagtgagctatttacattagaacagtactgggcacataataagtgcttaagaaaaatgctggctactctcgtaatcagcatacttactgtcataacctggaattatgtcccatggttttctctatgcatagagggtgcccctgggatcagaaatcagatatattagtgaactctttcccaatacttgcatcttgcaactgagagaaatttacaagctgttctattatttattccattaaagtttaacacacttcttttatagacctcatatacatattgcctttttttttttttttttttgaggtggagtctcactctgtcacccagctggagtgtagtggtgcaatcttggctcactgcaacctctgcctcccaggttcaagcagttctgctgcctcagcttcccaagtagctgagactacgggcatgtgccaccatgctgggctaatttttgtattttcagtagagttggggtttctccatgttggccaggctggtcgtgaactcctgacctcaagtgatccacccgccttggcctcacaaggtgctgggattacagatgtgagccaccgcacctggcctttatacatattgccatttaagaaacactgcaagagtcagattagttctgtgcagccattggtgcctccagggccttgctgtcagtgcaggtgcagacctgggccctgaccttgagaccagccttcacccagctgagaccccctagagacaggctgtagctgcagaggagaccctggagcttgtgaaggcttagaatacagacagtccgcccacttactatagaatgtggggaaaagggcaaattctaaaactgagaagtccacccctggctgtgttctccatagctctgtttgaatttcatttctatttgaaagctttttgcattttaattgtaaacattttattcatctggaaaatacttgagcaactactgtgtcccaggagctgctgtcatcactgggaatatgtagttgtaaacaaacagtccttgccctcatggagcttgtggcatcacgtgggagacagacagtaaagaaacagatatgtaatataattttacagagtggtagggctctgaggagaaatgaagcagagtaaagagaaagcgtaccaggggctgggttgctcctctggacagaatggtcacggagatgctgtgtgacagtgggtttgagcagagacatcagcgctgacagggaatgagccctgcaggtgtctgggtgaaaagcactggcagcagaagagacagcaagtgcaaaggccctgaggtgacagaaagcttggcctgttgatggccccaaggaagcctgtgtgcctaggaggatggaagccagaggtgaatgatagtgagattggcgaggtgaatgatagtgagattggcgatgcagccaaggcaggatgccccatgcctggtcaccaaagtcctattttagttatcaaactattttatggtgattgctgtggttgtaatttagtcaacaaccatgtgaacaagatcctatgtttcagtagatgctgtaactcatcatagtaaaatgagcgtagtttgaatatataagggaaatggttccaacttgtctagcttaatcacctaagtatgtatcacaatcatatctagtcatggttcttttttttttttttttttttttgagacagagtctcgctctgtctcccaggctggagtgcagtggcgtgatctcggctcactgcaagcttcgccttccgggttcacgccattctcctgcctcagcctcccaagtagctgggactacaggcgcccgccaccgcgcctggctaattttttgtagtttttagtagagacggggtttcaccatgttagccaggatggtctcgatctcctgaccttgtggtccgccagcctcagcctcccaaagtgctgggattacagacgtgagccaccgcacccggcctattcatggttcttaggcagagatgtgcaccagaatctccccggaactttgtcagagtctacctgtctgagccccatggcagatgcatttgtacctgatcagaagacagggagatgtggagggatgctggcaggtacatgttggctaatatttacagctgactctgataaacaactctaattaaaactggcaaagaggccaggcgcggtggctcacgcctgtaatcccaaaactttgggaggctaaggggggcggatcatgaggtcagaagatagagaccatcctgactaacgcagtgaaaccccatctctactaaaaatacaaaaaaagtagctgggggtggtggcatacgcctgtagtcccagctacttgggaggctgaggcaggagaatcgcttgaacctgggaggcggagattgcagtaaaccgagattgcgccactgcactccagcctgggcgacagagcgagactccatctcaaacaaacaaacaaacaaacaaaacggcaaagagttaacaaacattgtgactttaaattctcttttatttttctagtctccgaggactttgtctcctactccatcagcagaagtaagtaccatttctttttatcattttaatgggtggaatttgagaattgcttggcccttccctagactgggatttttgaaaaagaacataacatacaaaagaacagaaaaactgcatgtggggttatggtggctttggggattacctccgtgaaagaggagactctaagacacagcaatatatttctcttaaattggagaccagggagtaaaaatggcctcactttaatctgtgtctgtgcctgtaagtggaagcaaagtgtctgcaggaacataagtcacttgtcccaatgtggggctctttgtccgcatctataattaatttttctgaaccctaatatactgaaatggccaacagccatcatggcgtattctataagcagagccatcttgatgggaggttactctgtttagtctgaaatcaatcatctgatcctaaaaccaagcaactttctggatattatgaaactggactacttttagggaatctctgtaattcaaagtagtaaaaataccataatattttcatggtttatgactgctatgaattattaatttctacctatattctaataatttgcattgaatttatgaagaattaatttctattgaccaactgtgcaagcttgaagcacataatctggggactttttgttttgttgttgttttatttaatttattgttatagacaactagtatcaagccaaagtttccccttgccatttgctctcaaattccacaaagctatggttactgaggtgttcatttagtcgttattaatgcattctttcaaactttttacttttattgtgctagtagaaatttcataggacaacagattcctaaaatgtaaaatattctttgtactctttcaactctttagacagttttatattgtgtgtgtgcatgtggttttttgtacttattacctaatatatccttttctagatttggagataggtgacattttagtggtgctatgatattccattgaattcgcatgtcataatttcctttttttttgagacagagtctcactctgttgcccaggctggggtgtagtggcacaatcttggctcactgcaacctctgcctcctgggttctagtgattctcctgtctcagcctcccaagtagctgggattacaggtgcacaccaccatgctcagctaatttatgtatgtttagtagagacagggtttcaccatgttgggcaggctggtcgcaaactcctgacctcaggtgatccacccaccttggcctcccagagtgctgaaattacaggcatgagccactgtgcctggcccgtatgtcataatttcttaattgtgccccaatttgttgaacatgtaacgcaaatttttgcctttatgaatagtagtactatgaaagtatttgaataaattattcctccttttaaagggcattttaaattattttcttgggatatgtttcccaaagtgagaagtaaaataccggctttatggcaaccatcaacttgttattcaggagaatttatttaaaatgccaccagatcaatgtcgtagacagtacagtttggttggtggtcagaacgaaggaagagattagagtcaggagtctggttccgaagcaggctctgcccataccaactacatgcctacacacagggctcttaccagcttggaaccatgtttctacattagtgggggagggaggtgatagtatgtgacctaccttttcttgttatgcagatctggtaggtatgtgaacatacttatgaaacggaaaagtacaatgtcagcatggtcattggaattattatctcttgtcccatagccctatctctattaaggtttatatgttttcatccttaaaattttttttttttaaagaaacagtgtctcactctgtcgtccaggctggagtgcactggcacaatcatagtttactgcagcctcgaactcctgagtagctgggactgcaggcatgtgccatcatccctggctaattttttacagttttttgtaaagacaaggtctcgttgtgttgcccaggctgttctcgaactcctggcttcaagccatcctcccaccttggccccccaaagtgctgagatcacaggtgtgagccaccacacctggctcttaaaattttgtaataagcccaagtactgcagactttgaacaaaatatattagccacagaatgcttatttgcatataaaatacctgcaaaatttgcacataaaaataagtgcatatattaatcaaatatatataaacaagtagacatgatggttccttggcagtgtttgtgaagcgtggttcctactgaggcatggtgatagcctgaatgtgttgaactttgtttccaggggtaccaggatgttcgggatcggatgatccatcggtccacgagccagggctccatcaactcccctgtgtacagccgccacagctacactccaaccacgtcccgctctccccagcatttccacagacctggtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcgagctactggaagcaaggggtttttttaaaaatttttttacgattaacaaaaatctcttcactttgagacttaaaatggagatctcccaaagaaaatattttgatgtgctttttaggcataccaacatcatctaaaattcagtattagccatttttaacagctggattatgtttcccttatctaggtgttagtaagcatgcttggttaagcactttctagaaagaggactcagggctgttcttgatcacttttaagatcgttccaaccctaagattttcagtcattcttaggaaacataaaatcatttccaaccctaagattttccctcagacttggaaaacaaaatcatttccaaccctaagattttcaatcagacttggaaaacatacaattattaggcatcactacagtagagaatgccacaaagtagcagattttagtggaccttcatctgcagagaatttagtctctgtagctactagtgggtgtctcctgtgtgtagtgggagaagaatggagatcccagtacagatccaagattccctgagaaatggattcacaaggaagattctggcctctaataaaacttaatggtgacagtgcgcgtctgtgaagacttcatgttaagcttcttgcttctggacgcatagatgagagcaaacccatatgctacctttttaaaaataaattgtacaagaaatgaaaccaaaagaattaacaggatgataaaaagctgcaatcttctaagaccctagatttaatgatcgtagagaattcaaactatttgatcctttgataatgtataattttctctacactgataaatgtttgtgctatttattgaattacattaaatgaaagttctcaggaattttttttcctttatttcatgggctattatattcattttattcatgcccaggacgtgagtcccgatttaagcctttgtccatttgggtaataagaaatcctttatgctgggccaggcgtggtggctcatgcctgtaatcccagcactttaggaggctgaggcaggtggatcacctgaggtcaagagttcaagaccagcctgaccaatatggtgaaaccctgtctctactaaaaatacaaaaattagctgggcatggtggcatgcgcctgtagtcccagctacttgggaggctgagacaggagaattgctggaacctgggaggcaaaggttgcagtgagccaagatcgcgccattgcactccaacctggatgacagagcaagactccatctcaaaaaaaaaaaaaaaaaaatcctttatgctgccaccctgctcatgtacatatgctgaggtcactgagaccccagccatggagttgccggagcggcgtggggttataggggcattgttgttccaaagacccctgaacagtgaggggagtggtcagtcaacactccttcccccaaaagctcatgtccttactgagaaagtttccatctgttccaattatggttctgatgccaatagactttagaatcttctccttctctcctttcacaatatattacatgtatgcctgatgccacttgttaggctttaaagttattattttgaaggctgcccttccaaagtgaagctggagggattctgatagcatacttgtgatccatatagaacaccccaaagtgtccactccacaagttctagatgccagatgatgatttaaaaccccctcggtctgggttgaatttgaatggtccattcttcctgagataactgagtttccagcctccagtcctcctgctgaagttctcgggatcatatagacctctttgccacacagggaacacaaacatgttttccttctatgtaggcaaaatcaaattaaatttacagtgggatgtttgcttaagaaaaaaaaaacctgacccttacatataaatacaatgattgtcattttttttaataagcatttcagagggttctgttgtgtcaggtgctttttaaaaacagctgttgttgagtctaaatgacgtgcctgctactggctgaacagagaccatccgggtgaccatttctcctcaccaaagccatttattctcagagagtgactctgtacccacctgaacctctttgcaaactctcccctactttgcctcagccttagcaggtgcactcttaaccctttctccttcctcccttttcagcctcctgattaacgttctttattttgttttcccttggaacgatggcactttccctgctcctgtgttaatttctgttcttcttttctgtttccaccgtgccctgcccctgactccttgctgcacagagcttttgtctcctggtgtgcagaggttgtcgtacctgcgcaccagcagcctcagccccacccacagcgactcccgccccaacccccctttccgacaccacttcattccccatatcaaaggtaaggaggcaggtttctccaggcagcaccctgcatagtggagatttattagcaccctgggaaggctaataaggtgtatctccaagagttagtgccgagcttttgagctctcagcatgcctgcgtgtgtcatgactatacccaacagttgtcttagaacgggcatagcatctctcattgggagaaatatgtcacttctaagggctctagatgaagaagcaggaagtatgtttaagaccataagatttattatccactactttgaaaaaagaaaatatatatatatatattattattttgtttttggatgcatcgaaacaaaatataatatatataattggaatattttcctgggttcaatacgcaacgtgtctcagcaaaacacgacagtgtttagtaacagatatccaaaagttgtcttaccggtgataaaccatgaccatattaacatgtttgggcagcattaaaagatctatggcaacatcaatgtttctctttgagccgactctcagagcagtcatcttttgatttgtcctaactcccacatgatgcagaagagaggctttgccttctgttttctgttcctgcctcacatttctgccccatcccttctttttcatcattgtcggcaatgcttctgcagccgtcctcagttgggactctccacactgggggagccgagaaccctgaagaggctacaaaggggtcataatttaaaattaagtaggagttcccagaatggtgcgaacttgatttgaaccaaataaaccaataataatagctgaaggaggaaggaggaggcaagcacagatgttatcacaggtcttaaaacagtcctaaaggactcttaaccatgtgctgctccatgtgtcatggccctgatgcttccattgaggagcttgttctggtttactgaattttcgttgtcagtctaccgaagctttttctttgtgctcacttggttgttgagcggctgaatcctaaaaggtacatgtactgtacttatcagtatgcagtgattttataaatttgctaatttcagcattctctatgttttgaaaataatattgcttattgaagcaatcatgcttatcaaagacacacatacctggagttaaggtacacgtgccatttgccattagcaaattttttgataggtgcaacactctctaaaactcttgacagattattttactttattttatttttttattttttatttgttttgacacagagtctcactctgtcacccaggctggagtacaatggtgcaaacttggctcactgcaacctccacttcccaggctcaagcgattcttatgcctcagcctcctgagtagctgggattacaggtgtgcaccaccacacccagctaatttttgtgtttctggtagagactgggtttcactatgttggccaggctggtctcaaactcctggcttcaagtgatccacccgccttgacctcctaacgtgctgggattacaggcgtgagctatcatgctcagccgacagattattttaaattataagtgctaattagtattttgggggaaaatttttatttataaannnnnnnnnnnnnnnnnnnnggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcaagattatactttagagaatgtttataaaatcataaagaaattatgctgtttttttttcttaaaaaaaaaaaaaaacccttcagttgtgtattttaaagagactttaatataacagccattagccaaattaagattttggttatttctgctgaggtgggcagattgcttgagcccaggagttcaagaccagcttgggcaacatggcgaaaccccatctctaccaaaaatacaaaaaaaaattagccgggcatggtggtgcgtgcctgaagtcccagctactcagaggctgaagcaggaggattgcttgagcccaggaggtggaggttgcagtgagctgagatcgagccactgcactccagcctaggtgacagagcaaaaccctgtctcaaaaaaaaaacaaaagaaagaaaacaaagattttggttatttctgatatttaagaaaaaatgcattattgattcattaaaatgtaaacttcctcacttggctattatatgttttaacttgtagagagatactttttgtagaaagaaaagtgtcacaggccctataaagttacacagtttgtccaaataacacagcacaaagtgtccataaatggtcaatgactaatactgcttcatgtccatgagtggccatgtggagagttgaaaagcccatgggcattggaatctgggttcagatatgatctccgtcacttgctagctgtatcaccttgggttgcttatttatcctgttgagtgtcacttgactcctctataaatcaagaacaatgagactcctacatcacgaggtgaagtgtcttggtgtggggcacacccaccttggtcagcatggtgctcttaaattgcttttttttgtttttttggagacagagtctcactgtgttgcccaggctggcatgcagtggcacaatctcagctcactgcagcctccgcctcccagcttcaagcgattcttctgcctcggcctcctgagtagctgggattacaggcgtgcgccaccacgcctagctaattttcgtatttttagtagagacggggtttcaccatgttgaccaggctggtctcgaactcttgacctcaaatgatctggccgcctggggctcccaaagtgctgggattacaggcgtgagccaccgcgcccgaccttaaatcatttttgatgccatcattctgttcacttttcacagcattcttgggaaatgggctcagtgaggagaccaagtacagaggccctggctaagtaactgtccaggggctcaccactaggacatggcagtgctggactagacccaggccccctcctccccaggaacgctccttcatatgagggccatgcgtttcagtataaatatgtgtgaagataatttttaaagcacacttttatttttcatcccttttagccagaaaattgcattcttattgactcttagaccaagaatgatcctcagtcatttagatcacaaaattaagaaatatttacttttccatagaaatattaaatggttataaaaattataacacccctatgttcctaaatggtgctttattaaaaatgtagatatacattcttttctgttttcagtctgcatttgaagtgtttgacaccgtcaggtgttctggatttaaatgataaaaagcattatccaaaaggaattagtgaccctgaacttaaaaacatctaatagtctctctccctttttctttttactagacgtgtgcctatagtttgttcatatgaaatagtctttatgcttcagatgcaaagtgtaatgtacataacagtatatacttagtttttcaatcatatgagctttttgccaaccttaaagataaatcattggctgctttgggcacactgcctattgggcagtcctgctccacagggagcagtgtaaaaaaaaaaaaagatatgtggtggagattttgtacattaaagatattgctttaaaagcctagtgtatttggctaaatgtggattctccaaggaattacgtcttagttattttgaaaaacatgcatccatttacatggaagacctctccagcacttagaaatttctgaatggggggagcctatggccattgataacacatccaagatatctttgagataagtcaatgtcttccagggttttttgtggcccttcattgacttttatcttggagcttgtcttggaacttgagggagtttttgtttgtttgtttgtttgttttgttttgtttttaatggatgtgagctgggagcttgacctaaggtaggatgtccatctcagaggcagggggcgccctttgccactctggcagccagaagcccagccttccattgcccaagtccacttcctgttccttgtttttgcagcatgtgacccaggcctggggcctcactgagctgaggacgcctgcatggttgtaaagctgagatgcacggcacagactgtttctctccttcactggcttccccattcattttccataacatccattgttggttgggtgtatttttatttctgtcctccaaacttccttgtagcctcattctatcttagtatatctttgggccatttggacaaccttatgcctagagatttggaaaaaccattttcgctttgtttcgggcttcgtttgtaaagtgtctgctaagtttctcttgcttcccctttgaaatactgctagacatgacattctgtgtccatgaagtataaattggatttctgagcaggagggttacatatattaagtttctttgaaaggaatctttcctcttttgctataaatatgagttgccatgatgtaaatatatatttgacacttgctgaaggaaaccgtaactcttattgacgctttagacaagaaccggcaatcttaaaactgtcacaaaattctggatgctgccaacttatcttaaggttccctcaagatgttcatttatatttggggatgtaagcactctgagtccagaaagctaggcagtgctccaacaggtccccacagcagaatcgcacacccccatctctattcgcttgtcttagaattagtcactcgggctctcatggtgccaaaaagaagaatgaaagtggagatgggcatttaaatgtgttaagtacagtgagagtcctgtgagtgaatgctcccctgaggtctaaaaaattagcttactaggctaacaggaaaggaggtaaaaatgaaggccaagaaatagaaatagaaacataaatagaaatatagtagcttgtcactacaatagatgagaacactaacaacttagggtagcccaatctgaggacttaaaggaacaaaatagctatgagtgtgatatatatatatatatgtactattgtattatgtgcgcacacacacacacacacacacagagtagttttgttttttgttttgaggcagaatctcactttgttgccccagctggagtgcagtggtgcaatttcggctcactgcaatctccacctcccgggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcannnnnnnnnnnnnnnnnnnnggttgatagagatgacaacgatgatgatgaaaataatgatatcttccaaatatgatatttcatctggtgtgtcacacattactttgtttaagtaaggaactatgcacagatggcctcttagggcccccataagttatttcctgccagggttgggttcaaagttatatcatttaaatagggtattggccaggtgcagtatctcacgcctgtaatcccagcattttgggaggccaaggcgccacagatcacttgaggtcaggagtttgagatcagcctggccaacatgatgaaaccccgtctctactaaaaacacaaaaactagctggatgtggtggcgcatgtctgtaatcccagctacttgggaggctgaggcaggagaatcgcttgaacctgggaggcggaggttacaatgagccgagactgcaccactgcactacagcctgggcaacagagcaagactctgtctcaaaaaaaaataaaaataaaaataaatacagataaggtgtttaatttagaaaagggaaagaggcctcttcctgagaattttcctttttcttttaaaaatgcccaaaatttgtcatgcctttggtatttcaagggctaagaatttggtacctagcaacattatgtattccaagaacttattccccgatgagcggttgtgatatgtgaaaagcacattctgcagaattgctgagatgggtgtgttattgggtctctctttacctgatttttaaaaatgctttgtgggaagttttaaatgattatagttacatctgcttacaaaatttgaacaaagtagtgttttttttttttttttaaaaaaaaaacaactagagaggtgaatgtttgctgaagacatccagcctaatatagaaccacacccaactggtgacagcattcagccagaatccagtccttgggaattcagacagctactccataacctttgagaggctttgaccatattcaagaagtgaggggcttctacaggcactggccaacacagggtcttgttgatagaaatattttaatccctggacaaatgtctaattctaataaccttaaagtttgtgtcctgcatatgcagatatttttgtgtgtgcgtgacactggctaataatgataaaaactgatttaatgggggttcatttgattgtgtattataaccaaaacctacgagaactttcctggaaacatctgattttctgcaaggacagtggaggtctatgtgaaagaacaaaagcatggggcaggggggttcagaagcagtagtaaaagttgagacccattataccttctttcgagaaaagaccgtaagaatgattctgtttttcagttatggattactcttgttaatttctaatgttcataggattaaatcatttttcttcagtgaaacatttatattggagttgtcaaagattagctgtaatgggaaacttataaaaggggtgttgttgtgagcccagtgctgtacacaggtctttacttatcatcatcatttacttggaaactgtgacttaagtgaattgaaatattaaaaaaactagtttttcccctcatcagtgttctaggttgaaataaacgacgttcttcaaggacctgctatatgttgttttgcttaaagttgcagtttccagccgggtgcggtggctcacgcctgtaatcctagcactttgggaggccgaggcgggtggatcacgaggtcaggagattgagaccatcctggctaacatggtgaaaccccgtctctactaaaaaaattcaaaaaattagccgggcgcggtggcgggcgcctgtagtcccagctactcaggagggtgaggcgggagaatggcgtgaacccaggaggcggagcttgcagtgagccaagatcgcgccactgcactccagcctgggcgacagagcgagactccgtctcaaaaaaaaaaaaaaaaaagttgcagtttcctgtaacctgttgatattaagtgaggacttattgcactagcatctggcttcctttaatttagagaaaattgatggtgaatcttgccatggtgcttgctaaattaggccaataaatagctgtggaggtaattaattggcctccttcaatcattcattcacagacatttattaagcacttactcctggccaggcgataccctgagcactgatgatgacaaatgagaccaagttttaattcagcaacaggtttaaaacactatttccttctaaatgcaaattataatcttccttcccctgttttcctctgtgttttttatactcattttttcccgataggaactagttacttctctttaggagagggataaatgagataacatttttataaattagctttttaatagatcaatagtttgggatgatatttcataatttttaggaactaatatatgacttaaataataaagtcaacattataacatatttgggtctggatgctaaaccagctcttgagaagaaaagacaaaagtttcagaacaccaataaccaaaagccagaaatctaaatttgactcagtaatagacacagatcccatatttggaatatcttactgcccatttagtgtagatctgtactctggttacttaaaaatgtacatgctgagacattaaaattctcttaaatgtatattcaaacggtaacaattgacatctttcacacttgactggatagatttagaaaaatttgacctgaagcaactggccagacctctattttctgatgatctatgatttatttaaaattattagtgttaatagataaataaattggactttatcaaaaattttaaacttttgtgcttcaaagaattccaccaaaaaagtgaaaagacaacctacagactgggagaaaatatttgcaagttcatattatttctgacaagagacttgtatccagaatatataaagagctcttacaactcagcagtaaaagtcattacccctactaatttattgagctttaatagtcctgcatcttctggtgtcttcttgagacaagatgtttgcccagacatagggtaggaggacaatttaggccagttacaaatctctttctaattttgcacaagctgaattagtttatcttggccattctcctggtcagaagggagtgatggtggctatggtggcacttaaagcttttgcagccacccctttgctctcttttctgccctggtccctcttctctcctccaagagcaccatgccttccagacaaggtggccagtcctgttgctcctccagtctgcacccttccacaccctcctttctcatgacattccagctgtctggaatatgggcttcccaccctcccattcacctaccctctcacctggtgagcttactctttgatgcccagctcaaacctagcttgaagaattggtgtcaccttcatctgagtctcatagcatttttcttatacctcagagtaaacaattgcatgtcattatatggcatttaagtttgtctccttagatagcctctaagtcccttgagggcagggactatatctcattcatctatttgtcctcagtagtactcagtgcccagccatagtaggtgttcaataaatatttcaatgattgaatcattggcctgggttgagcctcatctttgaagtgaaagatggggagaggtataaatggtcgtgaaatacctggctgacacgcgtctgactctattttatatatttcaaagtgaggaaaacagaaacatatgcaaacacgctgcaattgaaggcactttgtattcctaaggggaaggacttggtgaccacacgggttcccagacttaaccttcagatcggagaaacctctgctaattgccagctgctgccatcatgcttgagagtgatttgtatttgggtttgcctagcccgctcctttacacgcttgggatttaaccacctgacaactgatcctgaatcatgagcaagcagctttccatcgctcccaatctcccctccatctaatcagtttgctgcgagctcacagctttcaatgcatgccattggaatgacgcacctgaccgctagctgcttctaacccagctccacctgagttcaaatctctgcaacggaaaactaaacctgatatcacctttgcaagtcaagttgataaattgagtttgtttcttttgtttctcctttttgatgaacctccttccagtctgttgttttgaatttttattacacttgctttgttttctttgtttctctctcccttctctcattttgttttttccattcttctcattggaggcaatgagccgtccagcggccggaactcccctctcccttaccggccagacagccgccctctaactccaacttacgctcaggcccctaaacatttccatgttccaggtaggagctgacacagtctgtgtcttggtgtcctgtcacagtgtagaatgtagccttgtaacctcgtcttgtctcatctctcatgctcttttaattgggatgcacagttaacaaaccctaaattgcaggatctgacctagggggcctttcaaaagttttatgtgttaaatgccaggattatgttgaaggtttatgttttctaaaataatttttgaagagtgtgggtgatgggtaaaagcagttgggttgttttgttttgttttttactaaaattttaattgtacctttttatcattgccttctgagatatctttctgtggtttgctgtcattgactaattatggcaatggcaatctagttatcttctcatcctaaagactgaaccacagtatcacctgagagaatacttttatatttcctgtttttctctaatgtggagactttctccaaggacttttcagagagatgtagaattgggtgaattggttggtctttctgcagcgcataacagactagccatctccatagcccgtgaagatatcttgcaatttaggcttggtgctgcaagctttgctctagtagtcacaagcatttgctgtcataatgcaaatagtaatttgacatcagaaactgaaataatcagagcccattaatataatatcttaatgtttagaatcagctcactttgtaaggacaggattagccatcagaggtaataatactatatttctaccagcagtatattgttttttgctttgtttagctactgaaagtagtttaataaattacccactatattaatgtaagtgtacatatttagaatctataatcatttttttcttttgcttctaaacttacctaataaaacagaggaaagttcactgagatttatatcacttagttgggactgtcctttctaaaaaagtttaattgaatcttgaaaattaatgttctatatctgggatttttcacataaaaatgccccaccaagatacagtgcccacggttctggggaaacagaaaccttttgaaatttcctgagtatttatagttaaagcaaaatggttccataatccaagggggtcttgtataaatatatacatagtgtttagcatctcttttctttttcattcattctttttttaaaaaatttggcctgtataaattaggatttgttgaacatcccatcagcacaccaggctagccttgcacataaaaagtttctgttttttttaaaaaaacttttgatttttctacattgctttccactgttccactcattagttgaaaagtaaattgagccactggtatctactgggggctcaatttctagacaatagcaatttgggcattttccccaagctggttatgtctttctcaccataagagtacctccactgcttgcgtttcttcctgttttaatcccactttcaatgaagtgtgtatttgaaataaatggctcatgagttaatcacatctttatatatcctaagatgtattacaaaggcttccataacacttgtctatagtaagccactcatttctataatttttctttcaataaactcaatctttgtaatacagaaattaaccttctgggttgtttttgttcaagatcttcagtttgatttgccccttggttgatctgtttttcccatcgctgaactggttcccataatcacacacctttgcttttcatttccacagatcaaggaatcaacatttaccgaaagccacccatctacaaacagcatggtaaaacccgctttcctccgcgtagcttttaaatagcaaagtcagctgaacttctccttgctgtcctctgaaaggcttttcctgctgctgcttttgagagtaaaactggggcatccagcatattatgcctttctggtctactaagatgtaaatattgtaaaattgattctcctggatggagagacttagcttgattagaaagcttctaacctgttgctgagcccatcaaaccatgtatcattctgttcctagagaaggggaagtactggtcacacagcaactcacaaacatcctagcaagtcttttttctttttgccatcaaatatagtcaccctttaaaataattttgatgagactaatttaaactggtgaaaaaccagccacctagaaaaactaatttgactgagcctacatcaacttggctgtccaggtctccagtttcttattgggcatgaagatgtgtgcacagtggagtggacaggatacaggctaacacagaggtcaaggctctgctcccactttctccctaaatggctctgtgacgtcatttctctgtgcttcagttttctcttctgtaaaaaccagttagttagatcagtttgtctctgaacttcctgcaaactaagaatcactaacgtggatgtataattctgttttcctttttttaactcaggaactcacatgactttatgtaaatcacattttcctccaccattattaagtctctgtagatatatcgaccataaatctttgtgaaaagatatctaaagctggtcttcaggcgttttcagaaaattctacacagattgtgcctggaaatttgaaggctgcctttagaattcagctgacattcatgagtccttaagaattaggataacatgaggccaggtgcagtggctcacacctgtaatcccagcactgtgggaggccgaggcaggtggatcatttgaggtcaggagttcaagaccagcccaaccaatgtagcgaaaccctgtctcctctattaaaaataccaaaaaagttagctgggcgtggtggcgcacacctgtaatctcagccacatgggaggctgaggcaggagaatcacttgaattcaggaggcagagattgcagtgagctgagatcacaccactgcactccagcttgggcgacagaatgagactctgtcgccaaaaaaaaaaaaaaaaagaaagaaagaaagaagaattaggacgatgtgaaaatcaaaatcaaataacattgaaaatgcgtaaggaaaaaaattttagaccaaaatcaggaagacaaagagaaatgtatgtatcgtaatggttctagagctatgattttttttctcatcttttttttttgaggttttaaaccatacgcttgctttttaagtttgttaacattgtttttgtttttgtttttttttatggtttattgtctttccacacactcattaacatgtgaatgtttaactactgacttcaccaattctaatgcgtaagtactgtttgaagtcatccttttgttgttaatttaagaataaaattctcagcatttgatttgtcaacttacaggctttaaaaaatactatctttaggtcctcctctctgaacaaaaataatcaaataattaaaatttaaggagattggataatgttagattatttgtttggaaggaattagttgacttcttttcataatatttactttgactgaagtctttcaggcctttgttataattaattaaaaatagcccagccagagcagcgctttccaaaggatgtttttgcaaaacagccattccatgccaaagaaatagttgttatgcccaaaactggtgtctgtgccctgatgcgtttgagaaaggctagatttaaatcaagtcacatttgttcttcataatgcagaacttctgagaacttcttatatgctaacatgttttgtccatctttaagaaggggatttcctatgtagtgttttccaagctgaaatggttttctcatgaggttagagattcagaggaacactgtttcatgcctggccaagactttacctcctaaactgggcacagtggcccacacccatagtctcagctacttgggaggctgaaatgagagacctgcttgagtgcaggagttagaatccagcctgcacaacatagcaagaccctatctccaaggaagggaaaaaagactacccctttgtattgggtgaccttggttgagttatttaagcaaattgagacccagaaggttacccgaaaaatggaggacttagagctgaagattcaaaaggttatttccagattttaaaatatgtaagcccagaagaaaaaagttatttaaggcattataaatacattttgaaatatttagtgacatccctggccgatttgcaaaattagccagaatcagggactgtccatttaacctggtttgttttgctccatctctgtaggttagatctggggctctaagctgtgactcctcctctaagcatagccaataagaactttgtgaactaatattgctgctagtttggcttttgttgttttaaagttggataactcacttgtgtgcacagacctttgaacaaaacaatgagtggaaacggcaaacataagtttcaatgccaaattcctgcaagctgaaagtggattttccaatttccatttctcctaggactcaaggacacatgtatttagtatataaggattagaatgaagtggaccagacagggtgtggtggcccatgcctgtaatcccagcactttgggaggccatggtgggcgaatcacctgaggtcaggagttcgagaccaacctggccaggagaaaccctgtctctactaaaaatgcaaaaatcagctgggcatggtggtgcatgcctttaatcccacctacttgggaggctgaggcaggagaatcccttgaacctgggagacagaggttgcagtgagccaagattgtaccactgcactccagcctgggcgacagagtgagactctgtctcaaataataataataataataataataaaagaatgatctggaccaacatatttgtggcttcttgcccaaagatgcaaagcccgccaaccctctaatgattaacaactacagtcaagtgatagcgtcatgctttcaacttagctctttaattttagattactaattactctaggagagtgttgtccactggaactttctataaggatggaaatgttctatatctgcactggccaggacagtaggcactaatcacatgtgactactgagcagttgaaatatggctagtgaaactgaggagcagaattttaattgtattaattttttttgtttaaatagcctcatctagctagtgctgggcagcactctagaatagggtttttcagatgtagaacacatgtagaatgaagctttgcttctgacgtaaagtaaggaaaatgagttgacttgtcaataggtacctctgagtgactgggccatggataatggtaataaacagaactttctggaactgaaacttttgccagagaacaagaaaactatgtaagtggggttgtaccgccattgtcttacagaccaatagctaagcaacccctgattcccatctagatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggtatgcaactgtcacggctaagtcaaagggacaaactgctaggagagctcaagatgacatgcttaaaaacatgaaagaaaatgtatcctattatgaagattttaaagaaaagtatgaccaagaggtagcatagtgaaaagaactaacgtggtattaacttgttgtacaaaacgcttaaaagttacaaaaacacatccaccagagtcttgttctaaccaaacccactgggatccagaactggtctaaaaccaatggtttgcatggactctcagagttaatactgcagaatcagtaactctgttgaacatagttgagtgaaagccttatggcaagaacattgttctatataattagagtctagtgggtgaatttaccgaatgtttgtagaagcatgacttctttcagttaaatttgttttagactatttctgggttgtagttataattcttaacaaccaatcttaacactgaagcactttcatttttcttgtaagatcatgttgtccatcatgcaaaagggctattgcagagtagtaggtgttctgaaatattacttctgtgaagttatgtgattttacatctaccattttcatgaattctgtgctaaaatgtcatatttcagctgtttcattctttgctccatgctttccaattatgtctgtgtctttactatattatcagtagtgaacctactcggcctaaaaagaagtattagcaaactcagaagctaatactgaaaatttagcgagtcagctttacaaagacacgatcttatcacatttctgttaacaacctaaaaggccttcaattttccaaaatgtcctaatcttcattgtgctatttttaataagttatttttggaatatctttcacaagcaatacaagtggattttaaatcaattgatacttatagaaagagtttaaggaaaaatctacctcctaagttcattattcacaagtgttgtgtacattatattaatgaaatttatctagtccttgcaaacttgtgcctattgattttcattagtgtaaactaaagagagaaacttcacactgacatttataattgtaagaactaagaaccaaccatcagcttttctatgccaatccatgcccttcaggaagttcttgaggccttgaggttgctagtttagtaaattgcttactgggacattaaagcagctacattttggaaagagggagaattaagtttttgttgttgaatttattatcactaagtagtttaaagctcttttagattccaaaaggaggaaaaatttcaggtccattaatcaaaatgctgaaaactaagactattagttaaagtttattttgattagattagcaaactttcctgtttcctcccacagccagattaatccaagcaatttaggaaaacaataattatcttaacctctcaaccattcagacagattcctcctttcctttccctgtctcccctttccagaaagctaaaaaattgaacacaatttactatattgttccaaagtaaaattgtacctgtattaatgcttttgatttacctattagtataaaactcttttgtgaccatttttcaaaggatgagaaaaagaaaaccttagagacccatttctcgaaagaaatagtaaaagtatgctttttattgaatttactaagagtagaagacagagtgatagtattatgaaattctaaatattcagaaaaagagaaaactacaaggtttaaacgcatgtcacaaaacaatgactatcttacctatctgttggtatgtagataaatttgcatttctttctatttgaaaattgaggctgggcgtggtggctcacgcctgtaatcccagcatttttggaggccaaggcaggaggattagttgagccctggagtttgagatcagcctgggcaatatagtgagaccatgtctctataaaaaatatttaaaaatcagtagggtatggtggcatacacctgtggtcgcagctacccaggtgggtgaggtgggaggattgcttgagcctggaggtcgaggctgcactgagccatgattgcatcactgtactccagcctgggcaacagagtgaaaccttgtctcaaaaaagaaaggaaaaaggaaattcacttcaaagacatcaaaataacaactggagatgcccttccatttactaaagtgatctctgaccagtgaacttagactaagttgcaaacccagttctaatggagcagggaggcctaaattcaggccttccttgcattgcacgttgacctggcttgtcacacagggccattttcttgagaaaccagccagtagtgctgagttggtggcaggcatttttgttttctcttgtattgtttacttaaaagtgttaaagaccgttgctgaccttgccagcctaacaaactgaacacagatggactagcccgttaagattcccttgtcttggggctgatgtgagaagttgtctttgctgtggaattaggacctgacatgaaacgcagatctagtggcagagaggaagatgatgaggaacttctgagacgtcggcagcttcaagaagagcaattaatgaaggtttgtccttaaactaccttgctgctgtcttcaatgctagttacataagatctatattttttgaatgactactatgtataaaccatctagataggcaagaggtggtcccagtcttcaaggggcttgaaatctggcaggcaaggcaagacaggtgtctgttaatagtaactagaatatggcagaatacctgctgggctctagaggagatggcattggtgctggaggtcagaggggtgtggaaggtttgggttgttgtgggaaggaaagagagaccacatgggggcatgtgtgcagtgcatgtgttgaaaggctgctggagggccaggcagagcaaggtggtatccacccaggtagtgccacaccttccttccctcatgcagttctgctgaaggaatgactgtgggattgaacatttctccaagtcttttcccaggatgtgggccaggagaaaaggaatgaaaggaacggccaccatgaaggggtcctcttcataccctccttcctgtagcaagggcctgcagcagcccagaaggacagtctgttatcagtcaagaggctgctgaatcctttcaaatgatgttttctaagcatataggaaatgcacgtgatattagtcaaaggatacaaagttgcatttatagtatgatctcagttttatatgtgtgtatacaaaaatactagatagatataaatcaaaagatagtgttatttctgagtgacatattatgggttactcttcttttcttctagattttccaaaatctgtaaaattagcatgtattacctttatttcttgtttttaaacaaatcaaggcaatttctttttaaaggataccagccccagtcttcccttcccacatcaaaaatccacacacactcacacatgccttctgaggtctcctggctctttagggaaagcagaggaaggaaaacgttcttctaacacagagcctgacttagggaaatggagctttgaaactgaaagggctaagagggtttagggtcccaaacttgacctacctcttcaggaactaccaggctctggggccacatgcattcaggccctccagcaagagaaacttcttgtgggatctgctacaaagaaactgcagctccatgaaagtaattgcaagctttgctttcttttttttttttttttccttttttctgtgaatagcttaactcaggcctgggacagttgatcttgaaagaagagatggagaaagagagccgggaaaggtcatctctgttagccagtcgctacgattctcccatcaactcaggtaagcagcaaacccccaaccttccctgattcgagagccagccacctgcttgtaaggcacctgccttgactgttcacttgtggtggaacctacagagtattccacgggaaaggaagtgtgggaaacccactccatgtcaaatgagctcataagcatgtcatgggtcttccataaatgtgtgtttcctttcttctggaaatgggtgaacccttggaggttctcaaaatccatgaaggccaatccccatatactaggtttgtcttctagaacactcatctccaagggaagcagcaaaaggaaatcctctaaaaaacatgatgctttttttcttcttctttttttttttttttttttttagataacatgaataagacattttctaagcattatgattttacattaatatcttcaatagaggccgggtgcggtggctcatgcctgtaatcccagcactttgggaggccaaggcaggcggatcacctgaggtcaggagtttgagaccagcctggtcaacgtggcgaaaccccatctatactaaaaatacagacattagccaggcgtggtggtgggctcctgtaatcccagctactcgggaggctgaggcaggagaatcacttgaacctgggaggtggaggttgcagtgagctgagatcacaccattgcactccagcctgggcgacaagagtgaaactccatctcaaaaaaaaaaagaaaaaaaatcttcaatacaagaactgaggatgaacagtgtttttgatacttttgaagaagatgacttatacactgggctgaaatagcctatcagtgtattttcccctgtatctatttgtcataagccaattctctcttaaaccacaagatttcttctctcatattctgagctagagcataattttctcctctaagagttcctttaaaaatgcatttagtggggagaccaaggcgggcagatcacaaggtcaggagatcgagaccatcctggctaacacagtgaaaccccgtctctactaaaaaatacaaaaatcagccaggtgtggtggcgggctcctgcagtcccggctactcgggaggctgaggcaggagaatggcgtgaacccagaaagctgagcttacattgagccaagattgcgccactgcactccagcctgggtgagagtgagactctgtctcaaaaaaaaaaaatgcatttaatgttcactccatgcaagcatttttgctaaacattttatttaatgttcacaacatgccagtgaagtagatgtggttgttattagcaactgcagcattttcatctctattttagaaatcaggaggctggtatagaaattgagttaacatacccagcgtgatacgccaataactagcaagactaggatttagaagtccacatattataaccccggagcccacacccttacctggaattcccgctacccttcatagatgcctcactggcattgatcttggattcggtggtttacaaatctttagagttccttggaattctgagattctgctctataagaatgtataacattgtacctgcatagatgaagaaatgaggacttcagaaagattaaacaccatgtccggagatacagaggtattaagttgcagaaccagaattcaagcccagggctgctccctctcaagcccagcagcttatcaggcttccatatcattgacagataccctgtatcaggcctcccaggaggccagctgtagatggctggtagatcttgataacatacagggttggcttccagttcagttactgctgccttatcaactggggcatgggctaatgtattcagatatccctgatttacatccttgctcagctgtttagaagcttagtaactgttggcaggatatttttcttagcccctatttctccttctgtaatatggaactaataatcatagtgttattagggttatattgaagattcaaagaaataaagcatgctgaacacttagctccatgccagagctataggaagcacagccagcttcagcccccactcaaccgcgtggacttgactttcccttccctcctcagtcatatcactgtccacccactccttgcaaatatgatggcatatttttgaacatttgagcccaatatgatttgaatttttttggtatttctatcctgtgaggtagaagatactgccaatttcattaaaggattggaccttctgatttcctaacaattggttttttacttttttcttactcagcttcacatattccatcatctaaaactgcatctctccctggctatggaagaaatgggcttcaccgggtaagatttctccccgattcattgtttctgcctttactcccacctcggccctggttgaagtattgacacattgcctgaatacgtctgactcttgatctcagtgttggaacataatgaaaattttaacctccctggttgcctagtaaattaatttgagttacaggcaaaataaaatgtttctattgagagaagaagaaattaactttagataaaagaatggcttgtgtatgattatgggaaaactaaattgcaaaactgtatggcaaatattttttacaatgaaacaaaaagtaattacttgaaccattatctttgctgtaaaaagatataagaatgtgtgttataaccatcctcctcacaaaagatggaacaaatacaattatgtaactatgtaggacaatgcatttttatttatcagcaagagatccctgcttaccaagagcctgctgagtggtggcattagtacactaaaaaagacaaagagatggcatagcagtagaagaatcatagggaaaaaaaaaatgaaggtctgacatttagcttgggaagaattcctaggattttgtaaactctttcttccttttcacctgactccaaaacgatcactatggagatttcctaataattgtttttcctcatttcagcctgtttctaccgacttcgctcagtataacagctatggggatgtcagcgggggagtgcgaggtgaggctcccatggccaggctgagcatggccacgtcttccctcgaggctgaggttcatgagagtcaagtatactggctgtgttcatgctgtattgtatccttagagtaggatcacatctgtcttctgtgagctaatagggcaattatttacaaaatttcaaagaatatctaatgaaatcaaactgtaagaagtgagtttgtgagaatttattcattgctcatactatgtgctgagcactctatcagatacctagaggccaggcatggtggctcatgcctgcaatcccaacactttgggaggctgaggcggaaggattacttgaagccaggagttctagactaggttgggcaacaaagtgggcctgtctctaccaacaacaacaaaaacaacaacaacaaattataataattagctggtggcacatgcctgtagtcccagctacttgggaggctgaggcaggagaattgcttaagcccaggagttcaaggctgcagtgagctatgttcatgccactgcactccagcctgggtgacggagcaagactgtctcttaaaaaaaaaaaaagtaactggaggtacaacaataagtgagacatggcccctgccctcaaaatgcatatggcagaaagaaggtctgtgtgatgaacattgggatcagagatgcagagaaggaagcagtaagtacctttaggttgtcagcgaaagcttccaggggaaaatgttttaactgttaactaacactggaccaggcatttcttggcttcagggaggctgatgggataacatgtgcagagtctgggagcagaaaaagaacatggtttatagggcgaatatgttgggaatttcaatataatatagtctgtgaatggttccttgcttttccatggtctttcccttatgatattttcttttcctttccttttcagattaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgttaaaaaaagaaagaaagaaatgtgatggagaataagaaaagaagaaaaatgcatagaaaatcatgattaaagataagaaactaacaataatagacttgggcatcttttaaatgtactatatgctttcattcatggagcctaattcaggaatttgtccataaccatcaagccaagatctctccccaacttgattgcaaaagagctgtattcctgttcctatacagcaaggatctcattttgaaaaatacatggtcatttagatgacacaaataaaatagtggttaggattggagacccaacagggaattgggagcccaagagtactcccttcagtttcctagactatttcatgcctcacctggaactggcatttctgttgcagacactcccagatggccacatgcctgcaatgagaatggaccgaggagtgtctatgcccaacatgttggaaccaaaggcaagtgcagctgttctttttcctctcatatgggaatggcgtaaccctaaacagatttgatgttctatcttttcatcattctcaaagtgttgtaggctggtgtgttcaggtgagccatgtcatgaatatgcaccttgccattctgctgttttgcccacatcaggtcagcaggttaaacccttactgggcatgatgctgtgtgtttacagtgaggtgccagtccctctctgcctatgaccaaggtattcccttggcctctgccatgtgcattacagagcatatccggtgctgagtggagtggctgcagactcaccatgtaggtgaggcaaccctgtttcaccattgaaagccctgcatttcaagaacctcagtcctgggtacactggggtgactggccaccctagctccagagcaccctgtaccttcagagttgtccaagggctcatgctccctggtgaccataaccagggcttatttcaatatggcagttgccagagcactgcttctgggcctgcctggccccatagattcatgagctagtcatgggacaagattgttaaccccagcacaaatgcaccctgccctataacagcatcctataaaaggtaacacattggctgggcacagtggcttacgcctgtaatccaagcactttggaaggccaaggcgggtagatggcttgagttcaggaatttaagaccagcctgagcaacatggcaaaatcccatctctactaaaacttaaaaaaaattgcttggcatgacgacatgtgcctatagtcccagctactcgggagggtaagataggagggtcacctgggcctgataggttgaggctacagtgagctgtgatcacaccactgcatccagcctgggcaacagagcaagccctgtctacaaacaaaaaaagaaaaacaaaaacaaaaaacacgtgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggaggtaaaacaaaaccgaaaaatccagtcccaactgcagatccctatgcactcccccaactctcccctaagcaatgttttatttcttcagtgaaaacaaaaaaaaattataaagatcaccctcatgtcataggtagaactaagaaataactttggagaaaaaaaatatccaggttttcacttagatcagcataaaaatgcctggtaatatccagaagaatgacccaggaggtgggcatggtggctcacgcccataatcccaacactttaggaggccgaggtaggcagatcacttgaggtcaggagttcaagaccagcctggccaacacggtgaaaccctgtctctactaaaaatacaaaaattcacggggcatggtggcaggtgcctgtagtcccagctacttgggaggctgaggcaggagaatcgcttgaatccaggaggtggaggttgcaatgagccaagatcacaccactgtactccagcttgggcaacagagcctgactccgtctaaaaaaaaaaaaaaaagaaagaaagaaaaagaaaaaaagaatgacccaggagacacagaatgatttcagtcattttctttgaaacttgatgttgccataattatggctggtaattcagaatgggagtcgctatttctcttgagatagtctcagatccttatcttcccctgagctggggttgagttcatgggaggctgtgggagcggcaaaggctctcaggagagacatttatactgatttatactggacaagtttctttcttggctgtttccacattccttgttgaagggttatctgggtacatgtacccaagatctccttagacatggaagactaatttttgtattatagttttccatcccaatgattttaattaagaaaaaccctggctgccagtctccgaaagaatgcttactttttcctgacaaaaggcagtaccttggcgtagaggtacagagaataaaggctgcaggatcttgggggaacttttctaggggggaatgactgatgggaagtcttctcagtagaacagacatccaccttaccccctattcctcagccaggaggaagccctggggctccccagggaccacgctggaggtcattttctttggctttctattgcgatagtccattttccctgcatcttctcaacgttccaaggacctgggatggagttgtctccaatgtaataaatcacctctctgtgtcccatcaccagtcagtgttattattataatccccattaatactctgccagctcttttatctgatgggaagggctcctcacctggcccaaccaggtaagggatactgatgtcacaagcattaaagatgggctcctctcccgtcctcctgccttgttcttcagaatgactctgtataaactatagagcaacgctcaaggccatttgtgtggccatcaggactgacagcagctcttttttttttttcttcttcccagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagatgcctccatacctgtgtttcatttctcgttccctggctccctttgaaggtctatctcattttaaaaagcaccaacgcaacttccaataatcaaaacaaaatcagaatgaacccaaggctgtgggaatgcatttttatcatgcaggtggaaaaatgcagcaaataacagcaggatattccaggactatgtgtccaataacccagaccatattgaccaagctgtccaaaggaaagaaatgtttagtagagccattacactgtgctgtgtcatgggtgtttgatttggtttgtgacacagcagggatagtcccatcatttcgacaaagctggggatttgaggaggtttgaagcttctgagccactatgagtgtgggccactttttagtaagaagctagaatgcagtaggagaaaagcatccttccaattttgggcatcccctgcatgatcaaactttacatgaagaaattgtagatgttaacttccttgttatcatcactgccaagattttaggcttgccagaaagtacaaggatctatgtccaagatggcccactccaacgatagccttccttctgctctgtgtctgctgagactacccaagacccagtcacactggcattcacatgaccctcccctggaagcgggatgcaggttgttttcaagacagttggcatctttagttcaccaccatggaaaacaggccgggagacctcagctcaaggtctgtgttctgctcatctctgcctccacccgtgggaaagcatccctgctgtggtccataattaccatagctaggggtcatctccagtccttatgaactctctgtgggatttggctctggtggccacctctccaatggaagttgacccgtgcctcacttcagttgctagactttagtcagcgaatctcacactgcctttgctgggagtggaaggatctcgcctcacccactgctcagctgcctctcccccagtaccctgccttcagatcttgccaaaccactgcaagttcccaggacataccatgcttgctccctcccaggcagctttatcaaaggtatttcttctttacgatgctcaactcttcaaggaggtggtggagcagagaggacctggccccagggaaaggaagtaatgatcaatgttgactctttaaaaacagctacccatcagctctttggagttacccatgtgaatttcccatgggctccatttgttccaaattaaagacaagtccaagttcacaccctctctatgagcctgtcttaatgggcccagcccaatctgcatgtaattctttgcatgcctctagttgaacctcaaggtcggtacttagcaagtgttgcctcgaactgctagctgcgtgggtttctgctcttcagttgaactgtagtgagatctctgtgctgagcgccaggcaccctagcttggcataactatattgctcgtgagagcctttcaaagtagacaattgtagctccactatacaggtaggaaaccaaagctcagagtctaatcaaacatgcccaatcactcagccagtgagcagcagagctagaattctccaggtctgcccttttcagatcccatgctgttatcctccacatcccattccctgtgactttcttagggcaaggactgtgtcccacattctgaatctcccagggcacactgcacagagtgggttcttagtgtgagactggccagcgcccttcagtgtggccatgagccccaacactaccaccaaggcgcatttatgaacagtttgggggttactcactgtctgtgtgtcttggagcctgtttagcctctcttcagcctcaatttgttcatctgcagaatggacaagataataatatccatcaaaagactgttgccaaattatagcacgtgagcacttaggtggttgaataaggactagtattattttaaataatcatttgagaatgaattagttttcactctgggctttttacccctccctctagtcattttgttt

SEQ ID NO: 12622 - DNA, 16802 bp, Human
ggcctcagccgtgtccctcctgatcccttttctacctctccacccccaggcttcacaagggctgtggcgccggctgcaatagtggcgggaacgtggatgattcagactgtagtgggggcggtggcctgacctccctcagcaataacccccccgtggcacaccccacacctgagaacacggcaggtgagcaggcgaggctgggctgaacccgtgggtgaggagtgcagcccagctgaggcctctgctgtcttatctgtctcctacaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttctttttttttttttttttttgtgcttcggagacatcagaattaataacactatttttgattttggttggcagtttctttttctacctgggaatgggtacatgatagtacaggcggctaagttgggatggacaagcacgcagaggggtgaaggatgtggggctgaagtctagtagagatcaagggcagaccaaggtggggttcaggtagaaccgggtcctcttcaccgcatggctgctcccttttcaagcctttatctgaagggtattgtctgccatttcccaccatatggtcagacttccaggtctggtggctcctacatttatcaggcttgttcttggccaaagcctttctctgcacctcagctgctccagggcgtaaagagatgacacctatctaaggtgtttttagaataaatgagagcgcgctagtggaatggttgcccagggcccagtgcttagcaagtgctccataaaatagtggcagactcttgagcacctgctggccgggagctggacgctaggtggcctccgctagccctcccggttggtctggaaggcaggcacaagtttctcaggagaggaaatggccttagaatgagcactgctcggtgctgacctccgccaggcctggaatccccgctgctgcgcttcccgccgcagacagctcccggccggccccgcctcccggcatggccccgcctcccagcatggccccgcccccaggcggagccggcgccgggagcggtagcgggagagcggcagcgggaccccagcgcgggcggcggcggctgggcgggagccccagaggtactggcgggagcaggggacgggaggcactactgtcgggcccgacaggggagaggtggcctagccgtgggcccgggtgatgtgtatgggagtggggtcctcgccacgttcgccgccagcaccctcccaacttccctccgggctccagctcagtcccgagtcaatatgtccagccccctgtctctgaccagccgttcctactctctctgtgtgacggcttagcctggccagccagccggtgagtggaagcggcggctcctgactcctggtggcggcactgtgaccccctccccctcaacactgcaagtgtgtgcggggctcccccttattctgaggctcctcttcttcttaggcggcctccaccccagtccctggcctggcctgggaggaaacatctgtcgcgccccctggcagccgaaatggggtcatgacctccagatgtgctgggaagtggccagctcctcctcctggggcagccaggccttccggatctgtgggggcggggccggccctttccccccacccctagtgacacaggcccggaggaatgtcctagcctcaatggaccctgtgtgaagcttcagggtggggggcagagcccgagaacacccctcaaggcagcgccagagcctggcactgggccacagcaagaggcagcgcacaggctgggtgcacacatgcacagatctcacttccaagcgtgcagagctcagcccacaaggagcggggcttgcacagaccccctccctcatgccctcctactccttcacacactatagcccaggcccgagcgctgaatgtgcccagagcttggctcatggagccaggggctacacccgtcacacacacacatagctagcgacactcacctcattcttctcagtctctcagcagccttgggaggggacagaaataattaaacccaatttttttctttgtttttttggagacagtctcactctgtcccgcaggctggagttcagtggcgcgatctcggctcactgcaacctctgcctcccaggtttaagcgattctcctgcctcagcctcctgagtggctgggactacaggtgcgcaccaccacacccggctaatttttatgtttttagtagagacagggtttcaccatgttagctaggctggtcttgaactcctgacctcaggtgatccccccgccttggcctcccaaagtgctgggattacaggccacagccaccgcacccggccagttaaccccattttagagatgagaaaacagaggctcaaggtcagcatgggagtttattcaggagaaatcaaggtagaagcacctgggctggggagccgactcttgcttggttctggaggccccagacgaagggtgtgtggagcccctcctccacccccctccggcccagccccgcatgatgttgctggatgctgcatgaagacccaccattagatgcctgtacccccagtggaggttccccagctccctgtcctcactgcctactccatccagggcttgcctgggtgtggcttccctcaagttctcacaccaccatttgcacctgcctctggcgtcacgtttccgcacttagcaggtccctggggctttgggtgtctcaatcttgcatcctgtgagaccttgaacctcagcccaacacccaccccccaaaacctacgcacacagacagcagtgggcaggtgcagccctgcttagggcctggagatgggcagacccaggctcacatcctagctctgacacggaattgcttcaggcaagagcatctcctctggacctcatctgaccatctgtcacatggggttcagacctccctgtctgcatcagtgagaccaggtaggcagaggtccctatgggtccctgtcattgtgactcctcttgcccccaagcctgggcacagtagcctgcaagaaggtgagttggcctgtccttcagggcagggtgactggggtcccatgacagctgctgtgaccccagcaccttcctcaggatgtgggggcctggcagagggctgggcccacagttggggctacttcctgtgctgaaggaagtcctcttgccattcctgctgccctgccgctgcctccctgggaacccatgtgtccttgtggtattgaggccttgaggtccagggcactgagatcagacctctctgggtgatcagctctccagggaccctgaaggaagtgggaggggcagggaggaaggtctctggggacaggacgtcctccctttgttaagtgggcaggacccagacaccagtggcccctgggtttcccgtcccagccaatacaagtcatctgtccggttgggctaggtcctggtgggacccttactctgggcccaggccaaagctaaggtgtgtgggtggcgactgggggaccctggcagtcccagggctgcccaggctccaggaccctcaggaccaagacccaacagcccagcctctagccttgcccagctaagctggggagggggctggaaactttagccctaggcagacaaggaagtggcctggaaagcggaagcagctttgatggtctcggagggggccggaagccaacacgggtggtggaggaccaggctgggggcctgggttcctgttttctgcccaggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaaggtgaggaaaggcagttccagggagtggaggaggggggctgaagaagaggtccctgtcacctgcagtgcacacagtagggctcatgaactgtccatttcctgtaaagtccctggccctgggagggctcaagagctgagctggggtcctcctggacctactttcaaccaccttcttaaggctaatccctggctcctcacccccagccagggctggtccctctgcctccgtattggttcatcctccatctggttcaacctgccaggctggggagagattccctatgggcttttctgtggggtgaaaactcaggcctcaaatccctgcatccgtgaaccttgttcgcaccagcactgcggagagagggctccaggacatagaagggagaatgagggcgtggtgggtggagccaaggcaggatttaggcctgggagctggccgcgtgggtctaggtctgggtctgggtccacctctgggtcagggttgagatcaagatattgagctcggggctacagaggggcgggacttagtctagggtcaacatttggtggtgagatgaagcctagggcggggcttagtgatgcgcgtggtcgagcgggggcggggctgccagagggcgggaccaatcgttttcttcggcgcggtcccccagaacatcagaacttcttcgggatggacgagtcgctgggcccggtggcagtgagcctgcggcgggaggagaaggagggcagcggagggggcaccctgcacagctaccgcgtcatcgtgcggaccacgcaggtgggccgggatcgcgggatcaggacgtgggttgcctccccgacaccttgtatgcatcctgagtgcccttacaccccttcctcagctccggacactccgtggcaccatctcggaggacgcgctgccgccggggcccccacggggtctgtccccaaggaaacttctggagcacgtggcgccgcagctgagccccagctgcctgcgcctgggctcagctttcacccaaggtaccacggacgctgctcacactggatgagcaagtggtgagtggcgggccgcggagcccccagccatacagctggccccagtctgaacccagcctgcccagctcccaaacccctagccttgaccctgatcctgggctgggtggtgaccccagaagagctggcttttcagagacagggcatcagagttcatctggagccttgcgtctcaaagtgagctctgtagaccagcagtatccacatcatgtagaaatgcagattctggggccccaccccagaccatctgaatcagagtttgcactttatttatttatttatttatttatttatttatttatttattttgagatggagtctcgctctgtcacccaggctggagtgcaatggtggaatctcagctcactgcaacctctgccttccgggttcaagagattctcctgcctcagcctcctgagtagctgggattacaggtgcatgccaccacgcccagctaatttttgtatttgtagtagagatgggggttttaccatgttggccacgctggttttgaactcctgaccttgtgatctgcccacctcggcctcccaaagtgctgggattacaggcatgagccactgcccttggcccagagtctgcattttaaaaagatatttgcagccctagatgccctggtctgactcaccccactggtcctgcagttcccgcatcattcctggccaatttcccccacagcccctgctgggtttcctctaacatgtggtgctcacagcttcctggagcggctccttccatcccccactccatgctgaaagctgcccattggctgagtcttctcctctgtatcattcaacccatcagtcattcaacaaacatttcttagacctttttggtgccaggcctcagactggatgctggggacaggtctagaccaggtgctttgcttgagtagctcacagctgggtgggagaaagagacccacagagaactgctgaaacacaggagcagtactggaacactgaaagggaatgttgagggctgcctgggccacgacggtagtgatgagagcccttccttggccagggttttccagcatggagaacacaaaagggctcaggcccggataagcaggtgttttctggtcagaaggaataacttgtgcaaaggcttggagaatgagagcatggcacattaggcagtcagttcagcgtggctggggttgggattgtggggaggggcgggggagaagcttgcatttgttcccgtggacactggggagccatggagggatacggtgcagatctgagaggggcagctctctggctgcagcatggggactagactgtacggggcggggatgccaggctgaaggctattgcagttgcccaggctagacacagtggcagcgatagtggaggtgaagaggaggtgacagtccaggaaggactgggtagtcatgtggctgactggaaggggtgaagtgctaggatttcccagcttcttggcccccaggagtggtggtttaaggaggaggagcagggtgggggagtcacagcaaggtgagacattaggcagccggagaaaaaggcccggggtttggtaggccggtctgaatgggaggcggagatgggggtgtcatccttgctgcagccagggagggggaggagcatgggtggagaagaggcccaggcagaagagggcggggttcctggggccctaggcaaggtgagtttccagctatccccagtgccacctatggctgagagggtaccaggatgaggccacatctggggaccatatggggagtggggggtgcagggggttgggaggaatgaaatcgaagtggggactgtaagtgcagacaagtttagttgtagaaaagggaggtgaccgctggaggggagcctgtgctgtttggaggagttcagagcaccttgagctgggcatggttatccagttatccgcagagggaagagccgggaagagggcacagaaatgggagcatggggggcagaggtggtgcctggcctgcaggggctggggtgggggtgccttggattcaggggtgcagaggacagtccagccttgagataaggaggatgataatgtgtatgtttattggaagggtcctttctgtgaatcaccttctctactgccacatgggaaccagcctcctcccatcccttcctacctgtgcactcccaagcacgaggagcacaacagactgtactcacctgacaggcaagggcacaagtggctcagagagggctggtgctcagccccaggccagcgtcccatccattccctaagagctggtggggtggggctgcaggggactgagacctatgccttctgtctcccacccacagctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaagtgaggcccaggggcaggaggggtgggagcagatctgtgctgaaggggtgagcacaaattgccttgtcactcctttgtccgtacaatcctggggctggggactggagagttctttgggtgagctaaggatctgagtcagggctatgagggccaagctatgggctgaaaagaggggctgggactgtccctcaaggcccaagtaccctactgcctgagctggggctaaagtggtttgggggcactacccctccaccaaacacattccagcagctcagcctcgtggaagagaggtgcccctacctccctggtggaaggggccccaggacccctgggaggtgttgtactgagcaccccctgcctgcttttcactttcccagcatgccacacatgcttgggcctggagtgacacctgtcctcctaggacacctgaccctgccctccctctgagaccacttctcatttctgtcttcattctatttcaactctcccatcctgaccccccttcactctggcatggggctggagcctgtggagggagaggaggaggggcacccagggctgaggcccttgaatctcgctggctgggcattggctggtggcatgactggttgtccacctgctgtttggggcacagaggctcctgtgtacaggcaggaatggcaagttcaagccacttagattccccttgttttctccttctgtgtccctaacttcctggccacagcggattccacaggcacgcactccctctacaccacataccaggaccacgagatcatgttccacgtgtccacgatgctgccttacacccctaataaccagcagcaggtgtgagggggaccaacgtgggggtggggcttccgggaaccatggagggccctgcatggcccatgacgtttgagctttggccggagctctgttggccccaacagcccgcccctctggtggccccttcccaaagacagaaacaccctaggtcttcaccaggggcagtgggggagccattggtgccttggctttctcctgcctgaatgaggaggggtttggggcacagaagacctcatcacgagcccctactatccaacccctagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacaggtgggcaccggagtggtcccaggtctcccgtgggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggcacgcgcgcagttccacgccatggccacgcgcacccgccagcagtacctgcaagacctgccaccaacgaggtgaccactacgtcgctggactcggcttcacgcttcggcctgcctccctgggtgggaacgccgggccgctcggggcccaggcgccgactgcaggcagcgggctcactggtgtggggagtgcgcgcggcgcccggggcgcgggtcgccgccggggctcaggcgagcggccccgaagcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcaggtgagctggagtggtaaactggggcccctgcgcgcggcggggcggagcctgctttggacccctccctcccgccgcctttgtcccctactcctgcggaagggaaagtcgaggagggcagagccagccccggggcttggcaaggccggaactggtgccctcgggtaagcgacttctggtcttcatccctcgggcggtggcacacgcggccctcggggactgtggaaagttccgtgtggcctgggacgcagtccagggggcgggcgctggcggccccacctcccggcagccccgcccactcgtcccgccccgtccgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggctgcggcggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggtcagggtgccggggacgcggggaggtgggagggccggcagttggccaccgcgcagtctgcgcctcccgggtcgccatcagcagtttcaggaacccagtgtggatacctttccttctggaaagaatctcccgtctcttagcccgtctgagcctgtctcttcctgtctctgtctctctctctttctctgtccttccttcctctctctctcctctctcttttttttttttttgagacgaagtatccctcttgttgcccgggctggagtgcaatggcgtgatttcggcttactgcaacatccgcctcccaggttcaagcagttctcctgcctcagcctcccttgtagctgggattacaggcatgcaccaccacggccggttaattttttctatttttagtagagatggggtttcaccaagttggccaggctggtctcgaactcctgacctcaggtgatccacctgcctcgccctcccaaagttctgggattacaggcgtgagtcaccgcgccctgaacctctatcttcatatgtagaatgggaccagttaagcgcgttgctcccactgcttaaaagatcaaatagcagcccccactatctttttttttaagtattggcacccgcccacccaacacacacactacacactattgataacttcctgtgctaagccaggggtaggcaaacattttctgtaaatggccaaataataaatattttaggctttctggaccatctggtctctgccgcagctactctgtcgtaggtaaatgaataaataaatgtgcctgtgtctcgctaaaactttatagacactgaaatttggattttacatgattttaacttatcatgaaatattcttttgatttttccactagttaaaaatgtaaaatccggaccgggcgcggtggctcatgcttgtaatcccagcactttgggaggctgaggcgggtagctcacctgaggtcaggagttcgagaccagcctggccaacatgctgaaacccgtctctagtaaaaatacaaaaattagccaggtgtgatggcaggcatctgtaatcccagctacttgggaggctgaggcaggaaaatcacttgaacccaggaggtggaggaggttgccatgagctgtgatcgcgccattgcactccagcctgggcaacaagagcaaaactccatctcaaaaaaaaaaaaaagtaaaatccatgcttagctcgcagtacagaaactggcacatctgctttagaaaagaaaaggaaaaggcacaggctggatttggctacagacagtagttttgggatttaagcaatttacacgtgttatttaaatcctcacagcacactatgaggttcgtactattatccccatttcacagatggagaaattgatgttcagagtgatttgcttgggatatacaggggcagcactggaatttgaaccatggtctggaaaaatggccagtaaccaggcagacatttttcactgttgtcaggatgccggggagctctcctgctcctggaagtgagcctggcgggctgggggtggggctagtgatgcaggacgctggggactggagaagtcctgcctgaccctgtcccaccccacaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcaggtgcacactcttggccttccctctcctccaggcctctgggaaagcggcttccctttctgagccacccctgctctccccagctctctgtcggatgaggccccagtcctgcccaacaccaccccggacctcctcctggccaccacagccaagccatcagtacccagtgctgacagtgagacacccctgacccaggtgagcagaaaccaggctctggagcccaacagcacagtggtgacagtgggcatcactgaatctgtatccacttctgtggcacaggacaggccaggcagtcccagtggctctgaggacaagggcaacccggcgccggagctgagggcctcctttctgccacgtaccttgtctctgcggaactccatcagcaggagtgagtctggacccaggagagcaggggaggggttggggggtgctcctgggcttccctagctcagcctgctccttgtgcccacagtcatgtcggaggcgggcagtgggaccctggaggacgagtggcaggccatctcggagattgcctctacttgcaacaccattctggagtcgctgtcccgagagggtgaggccaccagggtgctgcggtaagcctgggcagtgctcttgccccctttctgacctgcccacctgatccctttgtccccacaggacagcccatcccagagagtggagaccctaagggaactccaaaatctgatgctgagtaagctccccaactccccacagccgctttacctgcccacatgacccccccttcgtgcctgtctgctggggtggagctctgtcctgggctctgctgccacatatgcctagaagaccagcggggcccctctcattagctggggctgggagtcagctggtgcactgccccctgccttggtcctgctgagtcttgacccccatgtcttcaggccagagcctgggaacctctcagagaaggtctctcacttggagtccatgctcaggaagctgcaggaggacctgcagaaggtgaggggtgggctgagcttggggggagtcacagggctgccccaggaaaggggctggcggctctgactcctgtctccccggcaccccaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaacatgtgtccaagacagggcagggcaaggggttttgcctccagaggccccagccaaactcctcggaccagtcaggacaggccctgggaacactggctcagagatgggctggcactcactgaggggtccctgaggccaggccactgcttggcttctctcccataacgtttatttggttctgcagggaagcaggtggccacaccccacagctaccctggccgtgcatcacaaggccctgtgcctcagtgcaggcctcactcttctctctgaagccactgagcccccaggccttgtcctctctctacccacctggccacttcttgcagggcccaattccagaggcggtggcatctccgcctcagttgactggggctgtttctatgtcctggaggaaacgggcccttgacccacttccctcctcaccagcctatggtcctctctgttcctcgcgaggccaggcctttccccgaagtggcatcatcaagtccaaacttgggactttgtctaaatcctttggtttctggacctgaggcccagatagggcagacttgcccagcatctcatgcctattccagtcccttccctaggctggctgaagctccatggtgagacctaggccctgggtctgttaacttaggtgctggcaggatgagctaggctcggagaaacagagcatctgaggatcaggaaggcttcatggaggaggtaatatgagggctgagttttgaaggctgggtaggagttcaccaggcagagacgtcagaggtatcctggtaggaccagtctggctgaggcctgctggactagagccaaggcacacccaggaacccagcgtcaaagaagccagatcagaaagggttgtgaaggtgcactagggatcctgggttagcagttcccaagactgccactttttcctggttgtggactagtgtggaaggctgtggtcactgagggtgtgtctgcagaaaactcggatctggtcttgtggttgatgtttgaagggagattgatggggtgagatctggatgtcagagctctttggctgcagggaggcggctgtagccgcagtccagtgggaggtctagtggtgacttaaactcagtgatagcagtgacagtggggagaagtgggcagattttccaggacctcgtggaaggactggacgcaagttactaagggaagaggcggcatctacggtagtggccaggtttccggctggagcccttggaaggtggcagggccagggctgacagggaaaaggagaggcaggctggggatggctgaggtcatttggaacaggatgagtttgagaggcccgaggacgtcagagtggagatgtccaggggctggtgcgcaggggagagagatctgggttggatacgaggacttggagctgctgagccatgagcatgatggggtcattcacgaatgagagaagaaccaggagaggtcttcgtgggtcacgggaggtcgcgggaccgagaaagccaagaggagggaggcgcagcctgggctgcagggccttggctccctggtttccctctgggcctcgggtcgcggacctccggtcggggtccctgcgcagctcagccgtcggcttcctcagcgttaggagccttctcaccccgcccgcttcctccccgaccccgcctcccaggcgctccccggcagcttcgcccgggtcctgacctggccaccgcgagcccgggctccgcccctcgcgtgggagttccgccgaggcccgccctcgctccaagccccgcccctggccgcccccccggagccggagccccgtggaaaacgccacttcctcgacggaattggcctgccgtctcgccggcgccgcccgtcggagcctgcacccagggccttttctgttcctaggagactcgctgaattttgggacgcgtcccgctgacgataactccttttcccctgctattgtcctcccgcgacggtgcgaagcccaaacgaagacgccatcggcctcggcggggatt

SEQ ID NO: 12623 - DNA, 15671 bp, Human
tctgtggcaccacgttctcctggttctgctcgtagctctctgactaagctttccccttcacctactgaccctcgatgctgtgcacagagttagtctacttccactggactcaaagactggaactactccagaccagaaaataacaaatcaggtaaagtgtgaatttgatttaaaatgctctgtatgtcttgtcacttttaaagtcattctcagatttgttagtagactggaaataattttcccaaaaaaattttgaaaataagtacgttgtcttcagttttgccttttacattttcttgaacattctctctgaatgaatcatgtttagacaattgagggattgaagaaaatgacaatgtaatatagtcatgagagcattcaacaaagagtcaggaggcctagaatgaatgtaatagacctcttatcatgacatagtagacagggagccacttggaaagtaaaaatcaaaggtgtaacttctcaagttataataagatatacctcctcttaactgtaagttttatcctcatgacaattgtcccctaacagttttctgtttaaacagaatgtgggtgtttcttattcctccttacaaaatatagttctgtctgtgatggaacttgcagctgtgattatgtcaagctggggatttccaggaccctgtccaccagtaccgtggtgcatctttctaggccacctagttcttctgctccagctgtggtctctttctcctggatatcccagcaataactcagctaatacatctccccatgcctaccccaccctacactagtggacaggtgctttctatgatgtggtctctgactatctctccagcctcattccttagctgtaggattgtgcacaggtctctaaacagttgtgtgttcttaggtatctgcacatggctgattttgtgttttgtttttttaaaataaaaagatgaagtttctgtttctcgcccacgtggagtgctggagacagtggtgtaatcatggctccctgcagtcttgaactcctgggctcaagtgatcctcctgccttggcctcccaaagtactgggactataagccacttttttttaaccgagatcacccagtctttgcctttctttgcataatcaagccctatttactgttaaggctcagttcaagtagtgttaccacttttgggaaagttcacgtaatctgaatttttctgtgttcatcatagcactccttccacagtattagaatttttttaaaatttcctttatttttctttacactgtgagaacacctgaaggctgggaataccttttatgtttttatctcactgcctaaaatagtggcatataggaaatgctaagatgtctgagaaagacgacaatgattgcttgctctccagcaaagttaataatcactataatctcatgatgatatttgcaatggcttctacatttttgcgttttgattttgtttttttttagtttcgcaagagggaagtcctgaaagaaatagatgtgaactatgttccttcgcctcctcctcccacgtagattgacttatacctggaacagctagcagtactaggtgtcattgggaactgatttcttttttcctgcttacaatatgaaggttttttggatccttttgtcttaaagagaaaaatatataggccccaaattctgccttttaaccccttaagtgatttggaagtattcactttaacattggttttaatcctacttttacttttttgaagtaccctatgatgagaggacctgatcctgctgctgctccatatagtactcagaaatcatctgttctacctctttatgaagtaagttctttcttacatctttgtgttccaaaataatttgtagaatttagaagtgtaattttgttatattgcattctagaatacttttcaggagctccaggtaatgaggcggagcctgaatttgtttagaacacaaatgatggatttagaattggcaatgctgcgtcagcaaaccatggtttatcatcatatgactgaggaggagaggtaaaagttcattttgtcttagcacacctcaaaaagcttttcattcaaagtcttctcaacttatattttttaaaattaggttttgattctactgctgtgtaccttgtatctgttttgtgaaccagtgtagataagattagtcatagatagtgttttactaagtaaacttgtatgccttcaatatcctaagggtagtggtaacctgctttcccgtgtttgagatatttgtgagaggataggggaagaaagactaatgtccttgtggatacacctattgtagttgatattgtactaatttctagaacctgagatttccatgccttctgttagcatatagtagttgttgaaagatttgtgattaggaatctccaaactgcatttttccaattttgtgcccttcaccataccaataggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtacgctacctggagggtggtcggagttttcaccaaaggtttatttataatgttccaataatttaggacgtgtgccttcatttcaagtcatttattttaatggtattaaaagcatgcatactgtttaaggagctttcccacaaatcagttgaatgtacaatttgtaataattgtcataaatagtatatttagaaatatgttgaaaatttttaatgataaattttaataacaggaaagaataagggcttatacgaaagttgagggtttttaaaggaaaaatgctagtgaattaacatatgactaatgtaaattttaattgttgcatgtaactgcagagaacacagatgcatattttgctgtttttttttctttcatgcctttaaataaaaaagtgttccttttaaactttttctttattttggattcttttccatttgtttttaaaggaatcaaatgatacctgtatattttcatacatatatatacatacacatacatatatgtattttcctaaatatatagatatatatccaagagaataaaaagaaacatgtttttgtaccacttttcatacttctaatgtttctttccataacatttgaacttcaacagttgtattatttttgcaaatatctttgaagttgtagaatatgttgctttgaaatgctgaaatagtgaattattctttgttaccttaacaatgtatttgattttgttaaaaagaaatggatgaatatacacacatacaattatgtgtgtatatactataaatgaagtagaataaacaatggtgtataaacacatatatgtatagcatagactaaggatgttctgtattgctaatgaatgtacttttcaacatggttttgatttatcattctgagaagtgtatgttggtgacgggagaactagaacatcctttttgcatattgtatcagttttaactcacaataatgcattttatgggatctgtgacacttgagagtaacctttgtgacataaagggatgcttccaggcactaattagccaattaattttattataaaagtcttgtgatttgaaaaaatatatatgtacattataattatatatgcatgtatgtatatatacacacacatatacatatatatattgttcttaccttttcagggaatgtgtggcagtagaagcgctgataacttgtcatgcccttctccattgaatgtaatggaaccagtaagcttctttcctcttaaatcactggggaagggaatgatacaacatttcagacacatagtttccctagtttagatgaaatatatgtttattttaaatacataatttgataaattattgttgattggaagtgactttcacctttgaaagtccattgctgtctgaagccactagaaagccacctgaattgcaatagtgatttatctttctgactaaaggaggtaatgcaccataaaaacatgtacagtggctcatgcctgtaatcccagcactttatttaaatggttgaggtggaaggattgcttcaagccaggagtttgagaccagcctagtcaacaaaatgagaccctttctctacagaaaatttaaaaatcagccaggcatggtgatatgtgcctgtagtcccagttactcaggaggctgaggcgggaggattgcttgaggccaggagctcaaggctacagtgagctatgattgtgccactgcactccagcctgggtgacagagcaagaccctgtctttaaaaaataataagccaggtgtggtggctcatgcctgtaatcccagcattttgggaggctgaggcaagtggatcacctgaggtcaggagttgaagaccagcctgaccaacatggtgaaaccgcatctctactaaaaatacaaaaattagctgggcatggtggcaggcatctgtaatcccagctacttgggaggctgaggcaggagacttgcttgaacccgggaggcggaggttgcagtgagccgagatcaagccattgcactccagcctgggtgacagagtgagactccatctcaaaaaaaaaaagaaaattgatttttaatttacatttcaggagacatgtgctttcacagtttgatcctggttctttaggtagttagagctgtaacatgaccacgtttttaacagaaatctgtctttattgtgttagacagattggttcatttgggggcaaaagcactatgagtaactatttttcactagttactcttccttacaagtgatttggacactttggtggtaacaagtaaaatttcatcctactatgtattctgtttacctgttttgttgcttcatctcaataggaatttaaattttacttaccatttttgcaaataaaattgagtagttattaaattaatggaatagatttatgtctttacaaattacatgattttaggcaataatgacaaccaggactttaacctttttagctaccaatcttaattccaagagagaagaataacatttttttatgatctccaggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggtgggtaaaatctgtgtttcattcatttatttggaggtatatgttagaggagattttgtctgaatattaattatttacagaatgttcttttgattcactgtattcaataattttcacagagcttttaaattagctttcctgttgatcaagtttgtgtcaattaagatatatttgtaatggcatttctgcaaatttcatactctaatgtgaaataattacaattctctgtgttcagtatggtgaaaaagatatgtgaaggactcaaaataaacatgacgtactctttggacctcttgtttccacatctacaaaatgaggatttacagtttagatctcttcgaggattaaaaactgcattttatagctggacgtggtggcatgtgcctgtagtcccagctactcgggaggctggggtaggagaattgcttgaacctgggaggcggaggttgcagtgagccaagatcatgccattgcactccagcctgggcagcagagcaagactccatctcaaaaaaaaaagaaactgcattttataattacaattgataggagaaaatgattttgtgattttaataagtataaatagattgatttggtttggtgttttttattcaaaaatcaaaatatacgaagaaaagagggtttgccctaggtgatagcagcataagaacttgaagaattaccatagttatggatgaccaaaagaactgcaaaaggaaattacatatgattagtagtgaaagttcaaaagttgagaaaattagtaaaataaatgttttttgcactgagatcaggtaataggaaggaatagaatatatcgtttaaacagctcaatgcaattatctctgtttacctagtagtattctgtggattaaattgtacataagcaaatgtgaaatttgctgtatatgcagttctctagtatttcaatcatgttgaatcaaatcacattttcaaaacaagcattatagcagaagacttcatatctgtaatttattttcatgatatgactctaccaactaaatgtttaaaaggtcttaattctataaatttatttttcctacaaatgtaattatttttgtaaattggttttggctgcctaatgtttagcaaactcagcattcaccctactcggtcaggtgtgtctatgattaataatccattcctgtttacatgttttatatcaaagattagtttttgagtgaaattatgtaattattcttctccacactatatttgctaactgaggaagcgggttttaaggtaatttttttttttctagaaatgtgatggttttgttccccttagcttgctttggtatgaaagttttctttgaaaactttatattgctcttttaaaacaaatactccattcaatgcacacttgaatcctcatttttagaattttaatggcctgatatgtcctgtaggtgatttcctaagaataaagtgttcatttcagactagaacattgattctttggcttataagacacagcatatagaaaatttagttattcccattaggctgccttggtcctagagaattaatcatttaaaagaacctctcattaaatatgaaagattttataatttgcaaacacttaagctggtatgcaaggcaaatgttcaaagaatttttcagaatttgttatttaaaccattaattagaaactacttagttctgaatttggcataggcttgaggaaattgggtttaacatttattcttttactgtctacaaagggcctacccagcaaaatatgtatagatcaaacaaggcataagaggagtattgttgtacttaagaaaacaaattattttgaagtactttaaaagcatatttaatagtttaatgccagttataatttaaaaaattatgttaatattctcttagttacaatagttttctgtttataaagtatttaaaatttagtttggtttttattccagtcattcaaattggtaacctttttacctaaatacatactgtactaaattccaattttttaaaatcttggtgtacagctaccaagaaaattaaattagattctgtcttcctagcagatctgagcccctaatcccattaacaaagccaccattcaggaaggcaagatttaatcttgggttgaacagttttgcaggtgaggattaagcatgtttggcaggcactttcaggaaagttttcttactgcgttcatggatgcatgaaaacaatggtatctgtcaggcctttgtttctttcgttgtaccattaagtgaggtttttaaaaagagggttttcatcatttataatgtgttaatacagtagaattctttttttgaaggacaacattgaaagtcttttcagacaaatatttaatacactaattacatagctaaacttttgtcatattaaagatacctcttttctgcatgtgcattgtactaggaaaaaagtacacactgtcttaaaatttgcccaagtcatctgtgatgtatgtgatcagtggcctgaaactgtttgcagttactttaaaaatgtataaatgtgtgtaaataaaaagattacttaataggatgaatgaatacatgcccacagaagccaattcagcaaaattaaatgtcaaggagtaaacatagattgctttgtgtttagagagttatttgttaattagagttcatagacttgattcatgccttttgggatctttattagagcacgtctgacatgttttacccatgtattttggtaaatacacagcttgctcatgtgttcttatggaaatttcttttagtgatcacttgtaatagctgccacttagtaggcactcagtaagtgcataataagtggatgtgttcccacatacttcagacttgtagtcagtctttttgtattgtcgatcagcatgactttctcaatctcaggtagtctgtatttagcctacatttttttggaaattatgctcataaaggtaattttaccatccatcccagggtagtttcctcacttctaatccttccaacctctccatagcatgggagactttagaactaaattatttgtccatgcatttattcattcaataaattaataaagacattgtatcattttcagggccattttatctgtagtctgctttcgtttttctgctttctcttcctttttgtgtctgatattgtctctcacccttgtgctttctcactctctcattgattcattcattcagacgcttactgagttcttactgtatgctgagatacactgataaatgagacctgacctgctcgctgaaggagctcacagtacaccttccatctgacctcacccttcctattctgattcccttctgctctctagagggaactgtcttggcagtcaggctccattatactcccctcttatttgagaccgtcttgctacagagttttctatctccactgtcatctgaaattgttctttctttgttgtgacataccatgtaaaagctgccattctctgagaattttgtcccacactagtctctcatttatcaaaattttttgttcttatgtcattaatgaatcaataaattatttttcctttagtattttatgaaaccgacgaggtgtggtggctcacgcctgtaatcacagcactttgggaggccgaggtgggcggatcacctgaggtcaggagttcgagaccagcctggccaacatggtgaaaccccatctctactaaaaatacaaaaattagccaggtgtggtggtaatcccagctatgcaggaggctgaggcaggagaattacttgaacgtgggaggcagaggttgcagtgagccgagattgcgcccctacactccactctggatgacacagcaagactctgtcacaaaaataaataaataagaaatatattttatgaaacagtattcattttgtgtccattgagattatatcatgcttgatggtagggattcttttatactttattccaataatgcctgtactcccaaaaaagattggcacacattcctggtttgtcaagaatacattttggcgactgggcgcggtggctcacgcctgtaatcccagcactttgggaggccaaggcgggtggatcacaaggtcaggagatcgagaccatcttggctaacatggtgaaaccccgtctctactaaaaatacaaaaaattagccgggcgtggtggcgggtgcctgtagtcccagctactcaggaggctgaagcaggagaatggcgtgaacccaggaggcggagcttgcagtgagccgatattgtaccgctgcactccaacctgggtgacagagtgagaatccatctcaaaaaaaaaaaaaaaaaagagaatacattttggctagtttgttttttgagtgatgaagaataatgagatataataaaatggccatattgcattggtagcaggactggaaagactatactcattgttgtgaatatagatttgcagtggtcctaattcagtatgttgtatttctgtttatatactgtgactaagagattctggtttttaaaatatttgtatccaacacatacttgtttgaaaagtaaatctgaagtgctgtgtgcttcagaatcttctgatgttgtttaaagtttagaaatattgataaaaggtaaagtgaaaagcttatagtatttaaatatattccagtacagatggttggtagctaaggagtgttttgtttctttaaataactatgtataaatctatgtattgtgtaccaattttgcatgatagactaatacaggaccatttttggaaagattatagttaagatgtgtttgagatgtacttaggaacattgtaggaaataaatcaatttggctgacaggaaactggaaatgtagaatttttaaaagcttgttgagagtatcttgagtgcttatttgggaacacattatcactttatttcaggaaatacacatttatagctttcacaaagggctatttaaaagtgatgctgtatcattagagagaaaaggtggagataggcatatgtaagtgtttggacacctgtagaagaaaatcctgatggaattgtcatttcctcaggtctgtttgccttttccaacaataaaatgagatgtatatcctcatatcctatatgcatattggaaacaaaagcttagatggctggcagtgataccatgcaactaaagaaaaagttatttctttagagtttatggttgttttgaggatgttttttatattataaaataaattgtactaaatgataatttcttcttcccattttaaatgtgttaggttgaacaatatgtctttagataccttgctgtcagttggcataaacaggcagtatacctgtatactattttgcctctaaaagattttctcagcaatgagagcacttgtgtctctgctgattaccttacaaagttagacaatactaaaaacatttaagaagtccttccagattatttttttgacatgaggtaaagtatttactagaagttttttaacttatgaaataacattttctaatgtcctcaccttatgaattgtgatatttgtaatctagttagctgaacaattctagaccagtccttgggagtctgatctgggttggatgatagatggactcgattccccactccctctctgtattgcagggagattcacatgaaggtgaaattaagaaattgaatgctatttgtattttttccaaaaacaggaaaaaatgaattccattcatattggtaaatttttgttttattgtttttccaatctagattaaagagtctattgttggggaaatcagacgggaaattgtaagtggacttttggcagcagtatcttcaagtaaagcgtctaattctaagcaagattatcattaaacagaaattataggtaaatttttctgagtttctttgttgagctaaatgtaaatagtaactggcattttattctttgttttgttagtatacaggtttggttctctagttaaattttgagttttagaatgtatgtaatatgttattttacaatgtgaaaatttcacacaagcctatttgaagtgtaagtcaaatcccataatacaaatctccaaggaattacttatattgggtcattctactgaaatttcattatagtaataaatcctggaattggaccttcaaacctgaatcttattttgattataatggtatttcagatgtatagttttaaagaacaagattttgtgaattaatcacaacttccttttttttttttttgagacagagtctcgctctgtcgcccaggctggagtgcagtggcgggatctcggctcactgcaagctccgcctcccgggttcacgccattctcctgcctcagcctcccaagtagctgggactacaggcgccagccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaattaatcacaacttctaagtatctttcctaattatttttatcttttaaagaaacatatcccatagattcatttctaataataatttatttcaaaaaactcttttatatgtctgtcttagtaaaacgaattactttcattttatctcgtagctctaattacattaaaaaatttttttgtagagatggggtcttgctatgttgcccacgctagtcttaaactcctagcctcaagcgatcctcctgctttagctctaacttcattttatataatatatattaataataattcttggtgaatgcaaaaagaaagaataagttgagtagaatagaactaaaaatattcattgaataagacatgagaaacaaatgtaatttgaaaagtataatatacaatttcagatataggaaattggaaagtattttaataaattatgtcacaaagcaattaataggaattattttttttaaagccagggatataagaattaactctcaggaagatgtatagagattacaggataatcatgtttctgtgtatatatatttgcataaaattctcatcttcctttaaagaagcttttaataacagtatttgaaagaggtttaaaactgacttctcttttcttttttaaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaagtgttttagtggtttcttaaactgcaacatgaagattttgaattagatttgataggtaacaaatgaggtccaaaagaattgcagcatataacccaatagagtgatactctcttttcctagggaagtgttatgatactttaaaaaaacaatgctttaaaaaatgctgtttaagactagaccaccctggagagagggcatgattgaggcctctttggcttatctagttctgtggtcatgataattaccatcagaggtcaaataaaacttctctttaaaaataagctattaaactacaaacaatagatattaaaatactatttaactctttgttcaataacagcagtaataacacctatcaaccaaatgccccaattttttttttatactttaagttttagggtacatgtgcacaacatgcaggtttgttacgtatgtatacatgtgccatgttggtgtgctgcatgcagtaactcgtcatttaacattaggtatgtctcctaatgctatccctccccccttcccccaccccacaacaggccctggtgtgtgatgttccccttcctgtgtccatgtgttctcattgttcaattcccatctatgagtgagaacatgcagtgtttggttttttgtccttgcagtagtttgctgagaatgatggtttccagcttcattcatgtccccacaaaggacatgaactcatcattttttatggctgcatagtattccatggtgtatatgtgccacattttcttaatccagtctatcattgttggacatttgggttggttccaagtctttgctattgtgaatagtgctacaataaacatacgtgtgcatgtgtctttatagcagcatgatttataatcctttgggtatatacccagtaatgggatggctgggtcaaatggtatttctagttctagatccttgaggaatcgccacactgacttccacaatggttgaactagtttacaatcccacccctaaatgccccatattaatagaaatatagtaatcaacgattttaactatttagttttgaagtcacttttagttaatttttgacaacacaagatacccagattttgataatcaaaattagaaatataacagttgcaataataggctgagacaatcagcaaattacctacatagtatatgaatcaaataagaggagtctcaacaactatcagagttttatgttccttctccccactttattgtgtacttaacatttgaaagctatcaagttcaagccaccgtgctagctgctatgtggaaatgaaaaatgaaagggtcaaaaaaaagacaaagtcaaggcatcttttaatttatggatacgtttagaagtgtcaatgaataactaaaataatttgagagactatagcctggggtggtcagagaagcctaccaaggagatgagatttgagtaaagtcttaaaagtagtcaagaacattagcaaaagttatcaagaatacatagagtttgaattaccatgtacatgatcaaagcaatactttttaaatgccaggttcattgtgtgtattgtgctaagagcttgcacaaagcatagaagagaaagaaacttgaaatggtgattttgatgtttggagttgctatgaatgatataccatgagaaaaacaggcagattttgaagtacatttcagatttgaagtacatttgaaaaattctcagatttgaagtacatttctttcctctaaatatattcagttgaatttcatacatttaaaagtaccgaatatttgctcagctggccatcttcaa

SEQ ID NO: 12624 - DNA, 11186 bp, Human
  misc_feature (1)...(11186): n = A,T,C or G
actgcaacagcccgcccccagtgttcaccctaaggtggggcctactcacctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctggaaaaacactcttcagtttaggcttggagtcaaggttctaatccttgtcacttaacacttaataacaaatgctggactgcggtcctgctatatgactataatttaatgacaactgcagttcaagaagcctaagaccatccccctcatgttctggatgaaataaggaatccttgcctgagaaactcctttccacgccacagaacctcacctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtcctgagaagtaaagggtgacaccgagtgaggctcaaattccatgtcaagttcatgtctggggccactaggaagggtgttggtgcatcagcgatcttggtggtttaaaatgtcatcaccatctctcagatagcaaatattcttttacatcatctgcacacaaacacctgagaacaaagagcacgatgcttttcctcatctaacaagaagccaaggtgccacgaagtacagcagaattgcagtcctagtacctcgctgcgacactgctactgtacttgtttccagatggctaagctgaattcaaggccactaccatattgagctgaatgctcgctcagcaactcccaatgaaagcaagaagcatgtatcattgcccccgtctctaagagacacaaattaaggactgcgaccactttacacccactaaaacctacaagatacaacacaacccaattaccaccttcccttgagaaaaacatagaccgttttcattctgccgtttgttacttaccaatgccaaaattcttaggccttttctcaaacaggggattcaccactttcttagcctcctgcttcttcacgacagctggggccggagccaccttctttcccttggccttctttcctttcggctgggcagaaagaaaacgtcagttaaaccgccgcctccactcgcttcgtcgggggtagggctcaggctggctcctccaaaacaagggacgctgacagcacctgcctgaactaagctggcgagcagctttctgcaaccccccagcaccacccctcgacaggagcatctcacattcagccgcacaagcatgcagccccgggaaccccgagtggccagagcaaggctaagcccgagaccacgctctcttcgcgtcgcccacccaggagacaccccggactcatgactcctctgagtcgcggccccacaggctctagaagcaacaggggcgggctcagaactcgtcgctcacaaggcctctggagcggcccccagcaagcccgagagacgctagggctccgagccccgcactgcggtgctccaggcctgcgacacccagccctgcgacaccgggaacaacgcattccgctctcggccgcccggggctctagtccatctcaatgtctccgtgccacaccaagtggggctctaatccacctcggtgtctccgtgccacaccgagtggggctctcctagcgccaggaggagcaggaggccctccgaggccgcgcctggaggaggatggcagcggatacagccggaacctggctatagtgccacggaactacagctcactcaccatcttgggcggcgggaggagagagaaaggaaagggaattgtgggtaatatgtatgcggcctcggagatcgcgagagttgataccggcacgggatttcggatttaaagcaacagcattcctataaagctaaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtatgagggtgtggtggggggtggggatggagggggggtgggtgtgtgggcgggagtgggggtgggtgggtgcgtaggcgctggggtcggagatcccctttcctgcgtgtgacttatttcccacaccccgccaaaaatgggcacaaacaatgcgagtgcgtccaggagtccgctcggtcgtgcgccagactccgaacctagggggccccgggccctccctgagcaccgcgcgcaaaggcccggccccagggccaggcaactccagcgccgaggccgtccagtgcggctggagggcagaggccgagaggcgcggcgcggaacttgagccccttgtcccggcgcaccggggaaccatgagggatgttaagcgagggagtggaattaccccccttttttttttcttttggagacgtagtctccccctgtcgcccaggctggagtgcagtggcgcgatctcggctcactgcgacctgtgcttcccgggttcaagcgattctcctgcctcagcctcccgagtagctgggattacaggcgcctgccatcacgcccggctaatttttgtatttttagtagagttggggtttcaccatgttggtcaggctagtctcaaactcctgacctcaggtgatccctgcctcggcctcccaaagtgctgggattacaggcgtgagccaccgcgcccggttggaatgaccactttttaggacctcttccctgccgcgcagagactggagggagcggggcccgcagtgcagggatgaggtctggagcggggcagcctgagtgggagtggaaggaaagcgtggatgtaggcggtgcagaggggtcgaattggaaggactcttcggatgggagggcgtggcgaaggtggcggcgggctaagaagttaagccaagggctggggacggggagctggtgttgagtttgcagggctccctgggacacgctgtgggcctggacgtgaagtctggactggagccctggacagggcttggagggctggccaggagttccaggatgagcttgctctggcaaaggcggggccagtcctggcaccccctgcggtgtctgctgatggaatgagttcatctgtgtttcagtgattgactttatttggcagaaagggaatccccagaaatctgcgtgttctgctaaggttggggcatagagggtggctggggtagactctgcctgcactcagaggtctgtgctgcactctaggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaaggtgggggtggggtggcccaccaaggggagcagagtctgagaaggggtggagacaggagaggccaggggctgagcagcgcgagtgaatagtgttctaggcaggaagcacccagtgcacagggagctggtcagtagataagcaaaccaaataatggcacgtccagcccttactaacagtatggatttggatggagatttcactttttagtgcctcagtttctcctgcatggtggggtccttgtgatgactggtgagtttatctgtgtaaaacagttacctcggggcctggcacacagccaatgagcaggagaaaagcagactgaggggagaagtggggggtggcctccaggcaggtggagcggtcagcactggggcctgcaagcctgctgaccactgcagctacagctgcatcagattgggctggatccctcctggctgctgcagacctggcaggctccataagcgatgatgatgaggatggaagctagcatgtacttagtgcttgccatgtatcaagccacgttgtgaggttatctgtgcctgttctgctgaatcttcatgaggactctgtgaggtgggcactgttgtcctcttcatttcaggaggaaacccaggcccaggagacttagtgacttgcccaaggtcactcagctcacaactggctgagccaggatttgaacccacgaagtctgggtcttaaccactgagggtacctgacacccaccccgaactgagcctttgcaaggcctgccgggaagccccatccagcctcgcttggccacctatacaccaggggtggcaggccaggcttctgtgaaactggcatgggttaatggtggtcaagtgcatgacacagcctggcacctgggaagtgatcaggaaatggtcgcgaaaaaaaacttaaatcatcccttcactcatccaacagtttaccaaatgccaagcaagtgacaacggttcctaccaaacagggctcccacagcccaaaaagaccgggccaagataagcccccatccctgcacctagcacagcaagcagcgtgggttgcctctatttgtcttgagcaaaggtgcatgttgtctcccatggccagaacaagagagggtggaattgaaccttgtcagaggtctggctgacagcgcttaggtctgtagatggcaccacagacaggttgtggccagtgtggacatcctgggtagatgacagttaccgtaagctgggctgggccgggccaggggtggggatgccttggctgggttgatttctaggttttcttgttttcccccagattgaggacgagacgcaggtgtcacgggccactcagggtgaacaggacaattacgagatgcatgtgcgagccgccaacatcgtgagtggccagggtggagggcacggcctgggctccaagagcatcagtcccctcaggtttcctgggtggagtggagggggctctggggctggtctggtcttcttcccccgagaaggagcagaaggaggcaaatgtagagatgctttggtttcaccactcggcagctttaaagaatgaggtgggggcaaatcatttctcaggagactgtcctcacgtggggcacttggaggagggctgggcagagagccacccatgcccgtcctgtagccgtgcagtggccagaaagagggtagcccttcctgctaactcaggagttcctaaggtcagttgtgagtgaaaagacaaacagccgaatggaactgtaggcgccattggattccttcggatcacaggagaaacacagcaagcagataattccgcaggtgcacgtccagggctcaaaatgcatggaaaaaggtcccacaggagctctgcccagctggcagccatgttaatcctaccccggggcaggaggcaaaatgggatcgcagttttatctgtggggtttgagtttttcatgagcagaatgtacacctgcataattggactggaggccagtcctgcaggagtggaagccagaggctgacgagaggggagggcctgccctgcagaactgacatcccagttttctcacttaattctcacacatgaacctgtggaggtcaggggtagagtcccactttgcagatgaggaagctgaggctcctagagaggccatcccttgcccagcatcagctacttgtaggcaaggccgctgtcccccctcaccctgtgcccgccctggttctgatggccacaggtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccgtgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgctctttcttcctcattccttgtcagtccaggaccatccttggtctcccagcagttgtccgagcagcagctcctcagctctgcctggacagcctggcccaaggtcactctctcctcattggcacctggtaggtccccagtattcagtgaatggacctgctgccatcattgcacatccaggcacctgtgcctctgctggcatctcatcctcactgctaccagagccggtgctcctagtgccggtattttagagaggagaggatgtggacttagaaggggtgaggtgtaccacggccacagagctaggaagtgaagtggcaggaatcagaacttgaacctgatggaagtctagacccagtgtcttttggtgccaggctcaccttagaaatgcagaagtcacaacactgggcaggaagtgtggggggagcacagttcgtccacaggaagtgtgggggagcaccccaccccagttcctccagcaccatccatgtgcttcatcttctcatgggggaggccatcatctttcccgatgtatgaatgaggtgacagcccaggatccagccttggggacaggtaagaacacagctgacccatcaccacctgaaccagagaaccccacagccaagcagaaggcaccagacagacaggagcttgaggcccagtcctggctctggacctggcttctggggtggcctagggaagttgcttcccctctgagggagaatttccccattgatacgtgtggtgatctgttcccgcactattttagctgtggaaatgccttgtacttaaccactgaggaagaaaaagattacaaccagatggaagcatatatgaagcgagagcccggaaggaactggccagactttgtggtgggatcccacttaccctgttcctaaaatcctgagcgataagacctgccatcagcttcattttctgcttggccaggaccatcattcccatgtgaaaatcaagttatttctccttcttaaagccaagccgctctgctgaccttttttcctctccagctcatggccttggcagcagagctccacggggaagcagctgataaccatttgcagttctctcttgggcctacgtcagacaggttttgtctccatgactctagcaaaactacacctattaaggtcaccagtggcctccacattgctaagccccggcccattctcagtccatgtaactcttttatcccaagnnnnnnnnnnnnnnnnnnnngaaatacagaagtcacaacactgggcaggaagtgtggggggagcacagttcgtccacaggaagtgtgggggagcaccccaccccagttcctccagcaccatccatgtgcttcatcttctcatgggggaggccatcatctttcccgatgtatgaatgaggtgacagcccacgtgtggtgatctgttcccgcactattttagctgtggaaatgccttgtacttaaccactgaggaagaaaaagattacaaccagatggaagcatatatgaagcgagagcccggaaggaactggccagactttgtggtgggatcccacttaccctgttcctaaaatcctgagcgataagacctgccatcagcttcattttctgcttggccaggaccatcattcccatgtgaaaatcaagttatttctccttcttaaagccaagccgctctgctgaccttttttcctctccagctcatggccttggcagcagagctccacggggaagcagctgataaccatttgcagttctctcttgggcctacgtcagacaggttttgtctccatgactctagcaaaactacacctattaaggtcaccagtggcctccacattgctaagccccggcccattctcagtccatgtaactcttttatcccaagctttttattttgagggcagtggaactcatggaagtacttgtcagtttgcctctctgagcacattctccttcgtccatcaccacaaccagaatggatgatgat

SEQ ID NO: 12625 - DNA, 29763 bp, Human
  misc_feature (1)...(29763): n = A,T,C or G
ttcccaaacggatgccacctactccacctccagggctgtctgccacatctgcgtcctcctaggctgtggcttccttaatatgttctttaaattgacttactgccttttttatttaaatgcatttcttttaaaatgagactttatattactcctataaatggaaaatcacaggattcatggactagttatgtatatttttataatgcacattaaaatgaatttatcaccataaaaaatgagaaatgtttacccatagaccatgtacaattattccacatgctgtcagtgtgtttcatccctctctttgggagttggctttgcacctgtcctggtttcaccaaatcacaatgttatgaatggctatcatttattatggtaggaaatcgtcaaatggcttctgtgcacaatcaaatgcagactccccagcatggcctcagggccctcctggcccctggtttcctgatctccagttcctctggtcttgctactcttagacaaaggaggacttctcttggttttctgcctacccagccagaagatcccaggccatgggcctgtggagccaaagttcttaaccactgcactgtgtcacctttctatgatgtcaggcctcagcaaggcttatgaaggaacaggaacagccttgaaaatgaagttgggaagggataggccaggcctcccaggagcccaaagcttgcagagtccccttggtctcattggcacatggagaatggattgatcaagtccaccaatcaagttttgtgggtctaacagagcaactcctgccaagtgggaggagcttagggactttctataacctctcctggggcagaaatgatgggctgcagcagtgtccaatcctaactccatgatctcctgggagggcagggcttcatggcagttcctgtctgctctgcactagaagcttggcattgcaaaggggctcagctgtggaatgaagcagggcttcttccagaaatgttgcatgtacttcctattccctttctttattgcaatatggataatttatcatctgaggagggagtagagattccagggtagcttgcctaagagttgtggcttattaattccaactttttgcaagatcaagggggaaaagcaatccctgattttgtgtgagtatggggattgggtcttgaggccctgaaagtgaggttcgggtctcacagattgctgtgaagagttattgacccacctagaagagaagcctagcccagggcctggcgcacagttgatgggtttgcttcctggttattcttccgtccttgtctggagccctgcacgcctcttcgtagcttaggaagaacaagcttttccctgcggctcagggtgaggaagtgggagagaacaccagctccagggaggcttctagcaccagtcagcctcagttaacatccttgcaccttcattgactagctgtgtgaccttgcacgaatcattccccctctctgtgcctcagtttcttcatctgtaaaatggggatcataatagtacctctctcaaaggattgaggtgaggatcaaaggagtgaatccaggagcatgcctggaagaggcaggaaatgcctcctagacaatagctatttttgcagccagacagatctgggtttgaattctgccaccagtgctaactactgtgtgatttggggcaagtgccttgacctctctggacagctgtttcctcatctggaaatgggcttggtaacagtcctggcttccaaagttggtagtgttcttctagtaagcaagctgtgtgaaacggtggaaccctggccctggtgcagagaagggcatgatgaccgtgttagggtctgtcctctctggaaccccctcctgggaatggcagagggcagtggggtgctctgaggcaggctgctgccctgtccccactccccctccccagctgccccgccccagctgtgacgaccttgtccctgcctgtctaaggggcaggaaggaagtgaggagggcagccagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtggtgagtgtgcgggccccgggtgtgtgtgcgtgcgtgcttgtgtgagtgtgaatgtctgcggtgacccgtcatctacggagccccacaaatgaaagaactcctgctctccacctctctgggggaccctgggcaaatccctgtcctgctctgggcctcagtttccttctctgtcaaatggctgggggtaccctggggagatgccgcaagagtgaggagtaagggagctggaatccactttccaggcaaatgtaactgacgttcactccgaggctggctccgtttctgcctctgtgagatggggcacagcagcggccggaaggttatttgtgtgcaaagccaacagcagatgtgaaagtgctttggaaggcagggatcttggaaggaacgtgggctgggattgtttgaccgggatgtgaggtcggccgcagacacagccccgattcttcccctggggcctggagggagcctgggccactcgaggggatgagaagtgggaatctcccctttgtgcctccagtggggaggcaggggccgtgtcctctcagcttccagctcagtcaaaccacggccttctgcccaccaaagagaacttgagacctgtgctaatcattagggtaacttgcccggcccaagctcttgttgggcaacttgtgaagtcacggctgtcactggttcctcctttcctggtgactcacagtgtggtcttgggcaagtcacagtgcccgggggccaaggctgcccctctgcctggggtggctgagggtcagtgtccttgtactgtcctgcctagacccaccctactcccaaactcctggccacactcatctcccctagacccaagcgacttcctcctggggtgactcagggcctgtggttaacagttttctcatgagtctggaagggcttcctcaaaattagcctagatccacatgctgcggtgggttgctgcaaactcagacctgcctgcgtctgcttcctgtcacaggcagggcaggcagagctgtggcaagagcccagccttcaggggggcgatgctgttcagtggttagcccacggcctctggatgcagactcctgcatgcaaatcctggcttccctgcttcccagctctgcagccttgggcaatttacttaacctctctgagcctcagttttctcatttaaaaaaatggggatgtgaattatcatacccatctgatagggtttgttgtgaggctcagggagttgatacatacaaagcatgcagaaccacgcctgacgcacaggtgagtgctttattattcgttgtgcatcagacatggcacctgctgtcagcatccttggagtcaagttgtcagattcaaggactctagttttgggaggaggaactcagaggttgtccttccgagctcctgccaatgcaagagctgagagaagcaaatcactctttgagcgtccctgtaccctgtattttaggccttcaagctctgagactatgcacattcttagaaggacagtgtggcatgcaggggcgcctcacaggtagcaagtccctgggtcctcaccccagccctgccactaactggctgtatgggctcagacaagcctctctctgggcctcagtttcccttttataaagtcaggggtaaggtgatgttgactggctcagaggtctccaactctgatgcctctagggtctgggcaggccatgtgagtgacagcagggggcagatggggcctgcggtgaccccgggagcccttgcttggcccaccctgcagctgttctctgtttttgcttgttgttgccacgaaggattgtgggccctggtggccgctcttctgatgtttagagaatagggagcaggcttttgtgtcacatcttctgatgtttcaatgctagtgattgatgcatggtagaaaaaaatctcagtgcaggccaagtcaaatccatttgcaggttgtgtgggcccagaggctgccctgcaaacccgggactgtggggctgttaaggtttcttgttgatcgtgccatccgatgtcctcacctgtaaatggtggtgtgatatacggtccctgctcacagagctgaagaatgtgtgggccctagcaatcatggaagacttcttggaggtggtgccattggcaggagggagagtttggttgtgggcagtatggaaggtgaggagaaacaggtgagcaatggcgtatgtgttcggcttctacagggacacaatagagacaaacctggagtttggggaggaggtgataaaggttttgagtgacaagctaagaagttggatcttctctgcagtgcaccattgatattttgggctggataattcttcatcttgggggagtgaattgtgcgttagaggaagttcagcagcatccatggtctctacctactagatactagcagcactgcccatctccctaccctgccacttgtgataaccaaaaatgtctctagttatggggcccaatctctcccagttgagaaccaatgcctatgagtgatgagacgttctagagcaggagcaagcaaaagagcagaggggtgtcctggaagctgtgcgctcggcccaggttgtctccaggctgtggtcctcagttgactccagtggggggttatcttcctgcaccccgaaagagtcctctctccttcccagaaagggcagggcctgggggctttcccataggctagctggcaacaggtgtgctgataggaccttgagcatctggatggaaaaagagaagctgtggtccagatgtgtcaatagcccatgctggctgtcatctggacccagccatgggtgacgactctgcacatcatgagctatttgtggacttggcccctctagggagggttaaattgagaccttgccatcctgagacagtgccacgctctattgagtcatgagggcgttattacatgagggaagcctggtccgtagctttgggctcgggcatcttcctcaggatgtcagtgggtttgtgtagaggattctctgggtcacccaaacttgcacactttgggaacccagcaaactttctttctttttttaaaaaatctattctttttttcaaaattcagtaacttgcccatcttttgtggtttgatttgttttgttttgtttttgtttttaagagatggggtcttgctctgtcacccaggctggaatgcagtggtgccatcacagctcactgcagccttgaactcctgggttcaagagatcctcccacctcagcttcctgagtagctaggatcacaggcgcatgccaccatggccagctaattttaaatatttttttttgtagagacagggtcccactatgttgcccaggctggtctcaaacccttggcctcaagtgattctcctgccttggcctcccaacgcgctgggattacaggcatgagccaccgagcccagtctagagaaatttcttaaattgggtctcttgggtcctggctttttgtcaacctgaagcacgttctaagtcgatggtagaaagtggacacccccagaagacacttttgcccagaaatctctttcttcctgacccctcttccccagagtgcccggaattccactgtcagaaatgcattgtctgggttaaaaaacttaacacctgctatgatttcaacagtgtcaaaacaggatacgtcaaaactgggcgaggaggaaatgtatttgggttctaggatagtgaaagctctattttttctacttttctgtattttccatatttggtacaatgagcacgtacttagaacggttttagatttacgaaaatattgcaaacacagtacagatagttcttgcgtcccccatgcctagttcctctattgctaacgtctcaacgttagtgtggtgcgtttgttgcaatgggtgaatgaatattcgtgggctgttattaaagtcagtgcttcacccctatttccccagctttcctcttacatcctttttctgttccaagattgcatccaggatgccgcgttacatttagtcttcacacttccttaggttcctcttggtatgatggtttctcagatttttcttgtttttgataatcttgacagttcgaggagtatttgtcaggcattttgtcaaatgttcttcaactggggtctctggtggttttctcatgattagactgggaatgtgcttttgggaggaagaccacagaggtgatgtgccagtctcagaacatcgtactaagaaaaggttctgccaacttgacttaccactgttgctggtgactttgagcccccggctgaggttactcctttgtaaagttactctttttttctcctttccatgctgtatgttttagaaggaagtcactatgctgctccaagcaactcaagtttgatgaatggggagttccgccccacctccttgagggcagagtagctacataaattacttggaatttctcaaggagatttgtctgtactcccagtttattatataaataaatgatttatttatattacagggacccagggatctttactgtatgctttgggttataatccaatggtactttactttgtggctcaagtatactacttttaaattggaaaaaaaaaaaaagtacggccaggtgcggtggctcatgcctgtaatcccagcattttgggaggttgaggcgggtggatcacttgaggtcaggacaaaaccctgtctttactaaaaatacaaaaaattagctgggcatgatggcgggagcctgtagtccaagctacgcgggaggctgaggcaggagaattgcttgaacctgggaggtggaggttgcagtgagccaagatcgcgccactgcgctctagcctgacagagtgagactctttaaaaaaaaaaaaaggtaaagcattcaaatcatagtatttgaagaaggagtctctattgccctgacctcgtgcaggtaagttcacccatgtgcccagccccaggccgggatacagccctgactcattcacggcctctgcccttgaggggccagtctgccaaggaaaaaccgacgaggacaatggatgacattgctggctatgatgggggcacagatgtagggctggaggttgggattctggaatagcttcttggaggaggtctgagtcttaaggatgagtagggctttgcttgggcaccttggaaaagaggtcacgctgggcggggggagtagcatgacacaggcttggaggggaaggaccctgcagtgcttcagagacctagcaggtttgtcaagctgggttaggaggggtggccacgaggtgtgtcggggaggagggtggagaggtccccaggggtgggacctgcccgagtcctttgcttttacaagcttcagagctaagaagatggatctctcttcggcctatcagctcattttgcagatgggaaaacaggtccagcagggccccttacttgctccaggacacatggagagatggggcaggagcttgcttcaggtccccctgctggcacacaggtgtgtggaatgatccagaaagtgggcaaatgagttccttccctgccccatggctggggtggtgtgtctgtctgggaggccctgccctcatccagcctcccaccattcatttcttctttatggtccagtttacgggaagcttcctcctccaggaagctctcctgatttgtcctccttagaactcctggggctcttttctctgctccactttgggggcagtgatttgtgattgaaaggaacacaggcccatctccattacttaccagcagtgtgacttgagcaggcgggcacctttgttatctgagccttgccttcctcatctgtaaatggggccagtggtccctgcctcaaaagtgatcatttggaggagaccctagcgaagccgggtggagggctagcaggtgagtgcctgaagtgggctgtggaagaagaacacaaggccccccgccccttttttttgagactgagtcttgctctatcacccaggctggagtgcagtggcgtgatcctggctcactgcaacctctgcctcccgggttcaagtgattcttgtgcctcagcctcccaagtagctggaatcacaggtgtgtgccatcatgcccggctaagttttgtatcgttaggagagatggggtttcaccatgttggccaggctggtcttgaactcctgacctcaagtgatccaccagcctcagcctcccaaagtgctgggattataggcgtgggccatagtgcctggccccactcctctgttgaaagttcatctgtttggggttgaaaaatgggtccaaactgccaggtggggaaaaccctgggtgagaatctgttagaacttgccacctttatgtccagtgcccctgggctggacagagaggccacgttctctgccactgcagctctgtgcgcttcacggaggggtgaggaggccggtgggggcagggtgggagttgtagcccctcctcagtgtcagaactgagttgttctcctcacctcaggggtgtgaaccccagcttctaaaagcaggaggcccccatggcccatcccacccagagagtggctgaagggcctagcctggcctggccgagacttctctgttgccaacctggccccgaggcctccaggaagtgaggcttttattttgagcctagagcatcagcctggaaccaggacttcgctctgagctcactgtgaggcgagcgttggtttcccaggggaccccaccctgccaagggaagtggcacaaagcaccccctaatgaggcaggaagcaaagccatgagctgcactgcctcagccctgcacaggggctgcttgggacaaggcacccgtcccccagcctcaatttcctccctggtcaagtgggattcagtaactaccatttgtggcaccggaaaaatggcagctgccacgggggcctccattttacagatgaggaaacaggctcaggagggcaagtgactctgcagcctgtgttagataaagaacccgagcccaggtgtctgctccaggtggaggcagggaaggcagccttcctggcagccatgggatgggggagggggtcagctctgccatccccagagccttgttctgagaagcacagagcccatgtgtaaagagctgatttcaattttacctgcaaaatcagaaaaatatgggactcatgttagaacctgtctctcaagactggcgcgaggttgacacgagagagtgtatggtcagtcggccctccctatccgcaggttccacatcgtggattgcagattgaaaatactcagatgcagagcccgtgatacagagggccgactgtataagttcagaagaggacctggcgtctaataaatgcacaacaataatagtatcaatacttattatcactattgtgggtctttgctctgaagataaagggagaagtgatggttttagggaatcgtttggggagtggagggtgcttccccagatatctaggaagtggagaatgacagggccttgtgtcatacctggaggccaactctgagccccccactggctgctcctaaagggagatttgataagctaccaccagccagaatatctctgctgctgggattcactggtactgtttgcctttggggcaaagttagctgctagcgcccagtcacagcacttcctgtgctgcaggtgacaacctcctccagcgccatctgagccgtccgagtctaggttctctaggttttgcatgagccgtcacatctcctgcatgctctttcccctttctctctaaccccagaggccccacccctgccaaaccggtggatccgtgtgttcccccagccaactgctgccatttactgaggcctgctgcgtattcagcacatggatgacgccaaatcacagtttactaagaggaacgtcttgccgtttcctgaatgcgtctcatgcacactggcctctgctcatgccctttcctctgcctggaacactttttccattgctctttcggggaatcttcttcaagatccacctcctctgagaagcccgccctgacccctacggttggaccctgagctctgggtgttgacccagagccctgtgtgctgggtccctgggagtcgtgccctctggcctggatgctcgtttgggtcttgacccagcctgattcatcttcatgatcccgtggaacctggcacaggaggtgccagccaatctctatttgatttttgcaaaccttttcttgatgtataatttacctacagaaaagcacagctatcttaagtgcacaccttggtgggcttctacaaggtgaacacacccatgtgacctccacccaaactaagaaatcagaccagcacccagaggcccctagagcccccgcctcgccactgccccgcccccactgacttctgcctgtctatgtagttctataatacatacatctgtagaattacgtagaaatgaaattctgcagcgcgtgttcttttgtgagcacttctttctcccaacgttatgtttgggagcttcgtctgtgtggttgcgggtagctaactcattttttccattgctgtgtatactccattgtatgaatctaccacaatgcatttgcctgttttcctgcaaaataacatttggattgattccagcttggggctgtcacaaataaggcagccatggccaccaggctccgtgctgggtgtccacacacaggcacctgtgctgctcagttgatctttctgaatcactgtcttcaatgatttacttctcacacccactccaggaggtggatggattcttctctcccttctacagatgaggaaatgttacagatgaagtaacatggccaggccaggatcccacaggggatcagcggctgcactggggttctcactgaggtctgtgagccccagagcccagtggagggaggaggggatgaggtggaggcggcgggtgaggacgagaactgcggaagagtgaagaggagagagaagccaggctctggggagctgcaggcagccaggccgggctgctgcggagtgcgtggccccaggaatgggggcgtctggtggtatctgggctggctggagaggtggttggggagatagtgctcttggggggctggcccccactgagccctcataagctctgaccagaagcacagggtggggaaggggagcttcctcttgatggtgacacatctgactcccttctcacatcctcctcccaggcaacccagggaaatcagggtgggcaggtgaggttgaggggactgagcttcagggaggggccataataataatgatgatggcagaagtgtgaggctgtaggacacagggtcagggtggagcagccctgagggggaggggcaagggagggctctggcacttgggacccatatggcaaactgcattgtctgttgggaagggttgaagacaagcccgggcctgtcttcttgtgcagcctctgtcctgggctcgcacatttggtaggaggagccaatgaagtaaacggataggaaagtgtccacactctggctggcacgggtgtgtgctcactgacggctgggtcctttctctataacctttacctccctgaaaatctcagatggtgggtctccgcctgcctgcttctgagacggtgggtcctgggcctcagggagtgagagagagtgggcctgctctcctgcagaagggactggtctttgaaccccagaatcgggggttcttgtgtcatcaccaccatccacatgatattccttatcaccatcctatcctgatgtccccattgccgtcacccccatcactgtcaccaacatcaccaacagcatctctgatcatcactgtcatcaccacgccaactccaacaacatcccaacagccactccccgcctcacatggtcaccatggccagtgcctcccaggtgacacctggtgcactgttttcaccgcatcccctctggtaccgccatccttattgcccagccatgttcaatactgaccccattgtccccatcttccctgatttccatcctccagcccctgcccccattcttttagctcaacctgttgcttgctcctcagagccaccaggaaaagaaacaaatccccctgcccctggccacttccccaactggccagcttggggaagctgtgtttgtcattaagaaagaaaggctgcgtgcagacgggaataagaactgaaaccaaagatgggcagaagaagaggtgaaaagcgggaaaggagagtgggggtgggaagggtggctgagcatggctgggaccgcagcctgagcctggcttggaggcaggaggacagagctgattttgaccctgcgacagttttggtgtgtgaccttgggctggtcgctgtctctctctgggccatatttccccgctggtaacatcctcctctcagggaagagacactcccgtgccttctgagtttccctgaagggactgaaacacacctgcaccaccaggcctgtggcttttgcacatgatgtctgctcttttggaatgctttcttctcttctgtgttggaaaactcctacttgcccctcaaagccacgctcatgggtttcctgttggtgaaattctccctaagttttttagacagcaatgcgctctccctcatcaaggaccccaagccccatgcgtgtcctctgtcatggctctgagcacaccattcatgtatcgagttccctggagactgtgacaccggcacgccagggtcagtggcttttctagacagagtttggaggcggtaggtgctcagagagtgtttactgagagtcagtgaatgcccagaggtagcaaaaaccaccacccaattgtgcttgtttatggtgcacctgctgtgtgcccggctccgcgcaccacacgattccatttgacctcagcaatcctgtgaggcaggtcagtgattatccccattcctcagatgaggagccgaggcccagagaggttagtggctggctcaagggtgcagagctcggctggggcctggggccatctgaccccagcacccgagctcttatcttcatgatctcaccagcatagaatgaagggacagtgggtgaaaagatgctgtaattggggagcaagtgggtgagggcatgctgtctgcctgcgcattgttgggggagagaagccttgtacctgtcatgggatggctcgggtcccaaggtcacagcccagctgggctctcagagcttggggagaaggcagcgctgtgtccaggtggaaaccggggacatgaggggaaggcaagggcttggaggcttggaaatgttgactgtctgcatactctgtaggtcggccaggtactttccaggaactaccaacagctgttggttagggacatgggtggggcagtgagggccttctgaggggcagggtgctggccctggggtggctgggggtggaggactgtgggcagcctgggtgagatgtcctacagtgtgtaggagctccaccccactgaccctcctgcgttctgtcatcccaatggccccaggggaaaatgagggtctcttctcattgaccagaatcgaaagctgaggccagggagaagccagaacctggccagggccacacagcagtgaggcagtggaggaggcctcctgctccccagctcttgtctcctgagctctgagtggctggggctggggcttggttgccagggaagggtgggcagatggctagagagatcctggagcctcaggggagcaagttcaaccttgtggggagccctgaccccaggagagaggcaacagggttcacaccccagccgggccacgtgacacaggacatgtgagttctctctcagcctccatttcctcatctgtaaaacgggaaaatgttgcctgtcttgtaaagttttgggagattgcagtgcaagcctgtgcgtgcaggtctgagcacacagtaggtgctgaataaatgtgagttcctctccatcctatgtcctagagagccacatgggtgcctggagagccgagcttcctccctttctcctgggtcagggcctggcatcttcgtggaaggtcggggcccctcagagtctaagtcaggctctgaggttgcctcgctctgtgactgtgggctggtcccctgccctctatgagtctcgtgagccatccggcaatggggacaaagtcctccctcgtcccctgccgcagggttgttgagaaaaggtgaaatgggggagggtgagcctgggttttaaatgcaggtggttttcacaaaagtagaaatacctctggtgcctggtgctggggctgaggggagggaggggggactgcagagggagaggggatgggggcgcctctctgcctccactgaggcactgaggggaagggttaggccttaggcagagcccgggtggctggaagatgccgggcagcggagggaattggccaagatttgaaccctagccctgcatatgaccagctgggaggccttgggcaaggccctggacctctctgagctgcactttcttcgtctgtgaaatgggaaggaaagtattaagaatagtcccttttctgggtagtggggaagatcatgtggcatggagttaggctgtacaaatgtccccttcttcccctggggtgattggaggggttacagggcagtaagggatgcttggaggagaacagaggagttgtagggggagttgaggattagtagaggtctctaaagtcgggtaatgtccaaggtgacctcatggcctcaggaggacaatattaaaatttctaaatttttccatcatataattttttaatttctggaaattttttagtagctgttttatgatgttcatgataaactaggacagcaacacatgcgtgtaatttagaaagaaagaaaaatagaggcgtgtgtgcaaaaggttttactgacatagatgcatgatcaaaatatctaagtcctctccggggttcaggctagcagggctctgaggcattttgggggtcaggggaatgggaaggcatcagaacagcactgggagacttgggctcctccctcaacttgctgtgtgtccttgggcaagccacctaatctctctgagtttataaaacaagcagaggaagcttataaaacaagtacatgcaggctccttctagcaaggggaggttgagatgatctgattctaggctttgttccagatctcagataatcctggaatcttgagactttgaaagtcttctcatttcacagctggcagatgctcatggtccttctctaagcccagctgtgactcatctgtgatctgcttacatactcccaggaacagggagctcaccacttcacaggacaccccgttctgtgctggacggagctgtcatctgcctccctttctctttctctcgttcaaggtgaaactgagaggagaggggctgcggcctggcctttaggggctgaggaaggagtttttttctctcagggctgtttcctgtgagtgtcagccacagccctcaccacacctgccttctttttggggtgttctcaactttcctgatgagacaaagcctttccagctcactctttagcaggtagagggggcagttagagcatgcaccgtgctcctggtactactgccgaaccacgtaagcttgccccagccaaaagcagattctgtttgctgggcaccccctgccagtccctgagctcagtgctttgcaaatataatgcaatttaatcttcactaaatccagtgattgcaattttccagatgaggaaactcagagaggttaagagacttgcccaaggtcacacagtgacctggattcaaaatcctcttgatctgattctggagcccagctcttcatcactcttccgttcagtccctttccacgcccctaaacaggatgtaatgtggcaggaagacaagttgagacctgtgtctgagctaaaaaaaaaaaaaaaaaaaaaaaaaacccacacagtcagcaagggggaaacagatggtgggtggctggttgcctgtcagctgagcatgagttaccagtgcagggctgcctagaaagccgatgtaaacttagggccatattaatagagatagggcaccgactagaggggaggggacagttttcttgttctttatatgggcagaggttacctggagaactgtatgtatgtcataggggaagggtggagggcttgctgtgaggacatggacacacataaggttgtgagttccccatggctggaagcacttaagtagaggctgcatggcacaggtttatgggaggcatggataaggtgacctccaaggttctttaaaactgcagttttgtggctgaacttcagttgtttctagggccaccccaacactcaggcctatcagattcgccccttccacatcattcttagcaagggtcatctgagagtgtggggttcatttgttcattcattcattcattcattcattcaacaaatacaacagctaggggaatgaacaaagagacatacaggctttccctgcctggaacctacagtcgaatggggataatggataacagcacagattgagtgcttactatctgccaggtactttaagtgaattatcccatctggccccaccacaatcctatgaggaagatgttattgttccctgaggggccatgggagacagagattcagggttagatgctctccagggccctcctgggcctgtgttgatgattccgggaacctgaagctctatggtgctctctgatccccagagcttgttgttacagaaggggatgcagtggaggggccttcagcttctaccccccaccccacctctttaagcctgaccttcagtagtaacagttaccactcttcctgagaactgggcctaagggctctcctgggatagtctcatttactcctcacagtagcctcctaaggaagttactagtattatccccatcttgcagatgggaaaaccgaggcacatagaagtcaagtagcttgcccagggtcacatagctggagagaggaagacccaggattctgaacatgggctctctgtgtgtaaaggccactcttttgtctgagatgccctactgacctggcatgccatctgctccaggatccccactactggcttccctgctgtacaccactaaggtgggaggggctggtcggggggccgtgatgcaggctcagctgactgatgctttgctttgcctccagatcatgagcgtcttgttgttcatcgagcactcggtagaggtggcccatggcaaggcgtcctgcaagctctcccagatgggctacctcaggatcggtaggtccaggggacgccggtggagtggcggggggaggaggacagggagggccctggccagggatagccaggctagtgttggaggcactgccacctctccatggacgatggatgacctctggcaagtgtcttcctttcttggggcctcagctgtttcatccgcaaatggggatgttccacctgaccccacccacatctgcaggtggtgagagcagatggaatggcactttgcaaatccccaccagctggtaaaggtgatagcctcactcttctgcttaaagccgtcagtggctgctcatcacactagaataaaatggaaactcctcaccataggatccagcctctgcccacctctctgacagcatctccctgcgattctccaccccacaccttgctccagccacactgacctcaccaaccctgtccctgtctcaggccgattcctcattgctctcaggccactccccagggatgccttcctcagcctcaccctggctgaagtggaccccagcctgcacctccagcccagcaccctctgtcgcatcctcctgtgctatgtgtgatgttctgcttttgtctttgtactcactccagactcaggactgcaagagggcagggcctgggctttcctgtgcatcctcatgtccccaaaccagtggttccccaagtgtggtcctgggagcctggctggggtcccaggggcacccctgagcacctccctgctctccttgcctttcagctgacctgatctccagcttcctgctcatcaccatgctcttcatcatcagcctgagcctactgatcggcgtagtcaaggtgagggctcaggagccccgctgccccctgccccttcctgttattcacacccactggtggtgggcagtgctgggtgctgagagggtgggaggcgggtatgttaggcggtcccacctgcgttctggagatcttcacacataccttttggagaaccatgtttctccctgagattccctgggcaggtgacctcagttccctggtaacatgagcctccacggggccgggcatggtgggctatgctggtcaccgacactttggtgagaactagctgatgactcacatccttttaaacggcaggtggaagcagggaattttgagagtgaaaagaggaagtgttgtttctgggggtgagagacgggagaaagcactggattttgtaatggatgagaggagccgaagaagggggaaagtaggatgcatgcagctctatccatgcagtgacaggagccagcaccctgagggggacctacgccctggaaggcccccagagagctcatgatctgattggggaagatgggccttcagagagacagggacagtctagtgtgacaacgaggggctcctgggcccgaggcaaatctggtgggagagttgagatgggctgtagctcaatcccctgcagaagaggaacccgcggtccctgggtccccagaaaggcaggaagccagggcctcaccacatagccatgggagtaggatccagaaagagggtccttcctgtgcagacaggggcctggcccttgcagggccggaggagtggggcgatgatttggtgctggtttggaatgcgtccaccctgcctcaaatgccagcacccactccccttgctaacactcactctgtcttggaacccatgctgcctggggaggccgtttgccttgtgcagggtggctgtgggtgcttgtgcagaaactcaaagggttcagctagagaaatggagaaatggagcaggtggtccctgaagactctgagatcagtcaagattgttctggttgcctcctgagtgattttagacgaccacatgagacaccaggaaaccactgttgcagtgattttgtccccagctgtgagagcatatgaatgaatactggtcatggtggtcacttgctttcaattgaagaagagggacttcagcctcttcctggcagggcctcttactgtgactttggacccctgggagtggctggtggaggaaggtccaattgnnnnnnnnnnnnnnnnnnnnggggtgggggaggaaggtgtaaaggggtgtttgggtgtaaaacgaagagggacgaaatggtacgccgggtggtggccccgtgaaggtttttttgggtcacaggtaaaagggtgggttgtggggtgcccctccgggaaggggtgtttaagtgtgggccgccatgtaggcccccgagggaacccccgctggttcgcaggtgtgttttgttccccccacccttttagagggccatatgaagttgaaatagtggtcaatgggggggccacttggctttcgaaattagaagaagaagggactttcaggccttgtttcttggcaggggccttttttattgtgacttgggggcccctgggaaggggattggtgaaggaaaggtcccaattgtatgccggggggtgttgggaagtggtgggtggggggtaggggctctctgctgcctccgggccttcactcatgttggtctttctgcctccagtgccccgcccctccctcctgttcactcctagtctccttccccgatctagccctggtgtccccacctccagcaagtcctctctggtcccctctcctctgtaaaaagtgcacaaagcccttccttgctgggttcttgtgagcaaattgagtcaaatcctgctctttgagccctgatagatggggatggttcccttacgtctcctgggacaccaagactcctctcattcagggcctgggtcttatccactccctgtccccagagtgtcactcagagggaggtgacctcaactgaggagggcagggaaggtttgggagagggtgggaaggggatgcatgaggatatcaggctgggtggcggagtgttggctgcatgcaggggacacttgacggtgctgggcctacctttcagaaccgggagaagtacctgctgcccttcctgtccctgcaaatcatggactatctcctgtgcctgctcaccctgctgggctcctacattgagctgcccgcctacctcaagttggcctcccggagccgtgctgtgagtacccagcccccacctctcaccggacagcagagcccaggtctggcatgggagatgggaggggaccagacacgggccctgtgctcaggctggggagggtaggagccctcttcctggctggtgtcttgacccagtctctgagtccctccacattgccccaagtttcttcctctgtggaatgtacctgcaatcacatctcatcagcctgccttatgagggttacatgaggaacacacacattgggggtgcagcccatggtcagcactcagtcagtgccgctgggagtgaattgacacctgaggaaaggacatgtgcgctttttagcccccagcccccagtattatttcttctttggaaccaagttgaagaaaggaagagaaggatgattcatgccagtgagcgcccactgtggggtggcttgagggctgctgccagtcaaggacacagtctcccaaacctgcttttctcactctccccaactgttgtccttgaagagaccggggggctacatcatggaagggccctggcccgggagtctggagaccttggttctagtcttgggtctgccaccagctcttggtatgaacatctgtgtgttcatgtctctctgtgcacaggggacgagagtcactgatgtctgtagctgagacggtctctcaagtgagggcctactatgtgccgctcagtaactgggactttaattgctgctcctcattcctcctccttgtatttgtcctccccagagctcctccaagttccccctgatgacgctgcagctgctggacttctgcctgagcatcctgaccctctgcagctcctacatggaagtgcccacctatctcaacttcaagtccatgaaccacatggtgagtctggggcagggaaccatgcccatttgctggctgtgtggccttgaacaggttacttcacgtctctgtgtgtctgtggtttaggccaggttccctggagttggagcttgggaggaagattcttgtgctggtgatttattgagggagccctctcaggaagaaacttgtcaggagtgaggaaggcaggttcgagaaaaggaggaagccaagcaaagaagcaaagatgtggctgtaggagcagccctgcatgatcccagagagggctttggcatgtgaattgcaacacagacataatatcagtttttattgttgtctaatgaattatctctaagcatcatggcttaaagcaataaacatttattatttcacacagcttctgaggatcaggagcttgggagtggcttagctgggttcttctgactcagggactctggtggggctgcaccagagatggtacctggggctgtggacaactgagggcttgattagatctgaaggatgcactcctggtggctcactcacagggcgtgggctctttgcctaattcctcatcctgtggacttgtagtagtgctgcttgagtgctctcctgacatggctgctggcttcccctgcgggagtgatgtaagagataagcaaggaggaaaggcagtgtcttttaagacttctatcacttctgccacattctgttagttagaagtgagttgctaagtccagcccacactcaaggggagaggaaataaacaccacctttagaagggaggcgtctcaaagaatgtgtggtaatatttgcaaatgaccacagaggcagtctcacctagggcgagttcccctgcatcagtcattggtttcaagctgcccctaggggagggaatgtaacctcccaggtattagtggattaggtggtccctgtcagccaaaatgatcttctagagaagagcataggtgtggcccatgggcagctgacacctgccagctggggatgggccggtgcgccagcctgggaagcagatctggagatagtagccacttggcttttcttggtttgcccgtcagtgggatggggctgaaggtagcacctgcttcctaaggctgctgtggcggtcgaccaaggtgacggctgtgccacgctgtgctcgtgtgtgtgtggagggtgggatcattattcccggatgtgtgggtgctgttggaattccttatgtccagagacattgatgtggcccccaaatctgttgcagaattacctccccagccaggaggatatgcctcataaccagttcatcaagatgatgatcatcttttccatcgccttcatcactgtccttatcttcaaggtgagtggatccctgccctgcggctctgggaggggtggtgaggctgtgctgggcccaggcctgcccatgccaagctgttagaaggcagggacatgtgtcctccatgcctcctctcctgcttttagctcctttctcttgctttcccatgccagctcctctgactttacttgggatcctccgagacagcccatttagggcatgtgaatccgtaaaggccacctgcgttcagatgtctaattccagctgtctggaattagatttggactggcctgcgtttgaatccaagccccactgtcactagctgcgtggttggtcttcagcaagtcacttctctctgggcctcaggggcaggagtcttgttttgcctgtgttacagttttatgtaattcaggcatcaaaatgtacctgagattatgttaatagaggtttggtgatgagaaggcaggaggggaatggtctcattcttctctggggtggtcaggcccagaggatagggtccagcttcaggtcccaggtctgagtgatggtgaagcactggagtgtgttcacagcagtacaaccagcaacgtgaagagacaagaaaacgctgccatcttaggaagtcaaaaaacccccacaaaacccaacaaagacctgagcgtttattcagcatggaaaatagaggactcaagggggacctgactgctgtttcttaatacctgaagaactcttgtggggaattttgtgggatcctagaggccacaatgggggcctgtggcctgaagccacagggatgctgatgaccacagaaggaagggcttttaaaaagtgttcttttctgattataaaagtaacataggtcatagtagaaatttaaaaactacagatgagctggatgtggtggctcacatctgtaatcccagtgctttgggaggctgaattgggaggattgcttgaggccaggagttcaaaaccaacctgggcaacatagcaagattctgtctctacaaaacataaaaaaaaaaaagttggatgtggtggcgtgtgcctgtagtcccagctactagggaggctgaagcgggaggatcgcttgagcctgggaggttgaggctgcagtgggccataatcatgccactgcactccagcctaggcgacagagtgagaatctctctctaaaacaaaaaacaaaaaccaaaaaactacagataagtagaaagaagacaagcactccaccatccacaccccacacagagagcatcactgctgacaactgggtgcatttccccccagcctttctgtggtggtgggtgggcatctgcagaccccagctcctgcttccatctgaggccctgggcagtctctgctgtcacctaatgccaacctagaaacagaaccttgccccttttagcatcttctccaaggactgacctagcacaaacgcactagtgagtgtacagtgagaacacccctgaaggcctcatgggggaagccagtgtgggctttccatggcactctctactgcaggacccctccgcagaccccagcacacagctccgtcccccagctccccttctgttttttatcctccagaatgaggggcttccctctttgaccctcattctgcctctctggccccctccaccgacttgattttccctgggccttcatgcttcattctttgtcactccgtacctccatatgtctccttgccccacctatgtgcccatcagggaatccatcaaacaagaccttccagtacaggaccctctcctcttactcagggggcatcctgggggttttctgttgtttcttgagcttgccccttgggattgtatgccccactctggaaagcttctgcccaattcttacattaacttgcatcagctgatggacatgtactaactgttcctcctttataaacatggaccaatactgcacatgctgttttgtaatctgcttcagaaaacaacatatcggaagcaattttgaagaaaacatgtcccaccatcagctctgtttcgagatgggcagggctgtctcaggaggtagtgagcttccaggcagtgtgggcagtcaagcaggagctgtgggactattgccagggaaattggagggtgggctagaagccccccaaatccccttgctatgtggtatctgtggggcaatgaaaagggcaatacctggaatattctggactggctggtgaggaacccccaaccagaatgagaggtccgagcaggagcagctggatgctggcttctggagagagtggtggctcctgcctggcatatgtcctaggcctgctggagcgtgagaaggacgctcagcaaagcacagcctgacctgggcctttttccaggtctacatgttcaagtgcgtgtggcggtgctacagattgatcaagtgcatgaactcggtggaggagaagagaaactccaagatgctccagaaggtgagtgtggctgcaggtgggtgccagccctgtcactaactccctgtgccatttgggtcaagtttccttccctctctggaccttggtttctctatttgtaagatgagggttggaacagaagaaatgtgttctctttcagttctggtagtctaagattcattcactcactcattcatttattcagtatttactgcctctcactctttgctagtctcatatcgattccaggaggcgcagagaaaactaagatgccacctctgccttagaggagtgtacagttcagacacatagatacaattacaacttggtgtgaagcacagggacaataagcacagaggaaggacctggcctcttctcaggtatcagggaagccttcctggaggaggtgacagttaactggtcttggagggtcaatggatatgagatagctgggaaagcagaaggaggctttccgggaagagaggatgaggtgtgcttagaagcagcttattggaaagtgacggtttaaattcctggtaacttactttcctcacctgtaaggtggagattgtattagctaagacacttttggttgcaagtggcagaaacccaactcaatctgacttcaggaatttactagctcacagaacttagcagccaaatgtaggtctggcttgggcctggctgagtcctgacatcaggatatgatctcgtcctctccaactcttgactctactttccttgatgttggcttcattttccggaagcccatcccttgtggtggcaaaaaggctgccaaaacccctaggcagatatcccaccctctcagaaatcccaacagaaaaagaaggtcccaggagtatgtctgattggaccaacttgggccacgtgcctatccccaaaccaaggactatagccagggggatggaattctactttgagtggccaagtccagccacctcgctggatctgagggatgggaccagttcttctgaaggtatatggactgagaatgttttcccaaggaaaatggtgcactgttttcaaaataagggggacttgatgctgaataggcaaaggcaaatatgtccactacagggctgggaactgcacctatctcatgcaggcaatgtctagcacatagcaaatatccaagacctgccagtcattatcatcatcattttgccagaggtgggggtttgggtcccatgaccccaggttggaattgcaggtcattcttgaccatactcagccctcatctctctgtctctcccaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttctgtctggctgatgtgtttctggaaatacagtgtagggagggtggagaccagccttctacctccatcaccccaggactcacccacaccccctacacccacatacacacccctcacactcacactcacatgccccacaaccacgcccaccaacatacacacccacacccccaacgcccaccccctcacccccacgcccacacacccacacatgtacagctacatacacacccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12626 - DNA, 8445 bp, Human
  misc_feature (1)...(8445): n = A,T,C or G
acactgtaccttcagtagtgtgagagattgaggcaggggtggggcgtggtatagacaatgatgtatgcaggagataaggacatgagccacggagcagcagggtcacgcatgttcaggcatgcatggaatggggaccacgttacagggcagagatggggatcatgggcaagctgttgagggatccaggctgtagatttgctgatacttagagggcagtgagaagagtgaccctggagcacaaagtagcagcaacctaaaaaggcagatggggctaaattatgaagggtcttaaacattaggcaaaggagtctggacttgatttagtagacgaatgggggaggggatgtttcagaatgacctgagcaagagaagagctagggaatgaagtcttttaggaagggaactccactaacagtgggaagggtggtctggggatgggactggatagaatccactgcaaccatctagatagtaagaagcagccgatttggggactggatttagggagcaaagtacaaggaggggctgacctttctggacggagtgactgggaaatgatggtatcgctgacagaaatggagatcaagagctttggagagacactgggcttcggctgacattgaggtggtggctggacatctgagggagaggacagagccggtgggaacaggagcaggatggaaagacaggaggacagactgtgcagatgagaaaagccactgtaaaacagtaaacatcaagacaggctacatgcataggacctctccaaggaaaggcagcctagagaaaagggaggaggactgaggagacatagtgcggggaacggggcacgaagggatccaggggcagcacagccagacaggggggtggagaagcctggggcacaaggaaaaaagacagggacacggcttccagaaggtggtcagagggctcagagtccaaggaaaataggaatttacagaggccactgggttttagtcaccttacaaacacggcatctgtatgccagaccctgggccaggcttcacggtgttgggtagaagttatcctcattcagcagacatctaccgagtgcctgtgatggtggcggtccctgagtgtggaagagggagactgaggccagattctttctcgagaaggtccaaaccacaatgaggaaggaagacggctgggggaaggagggagtggacggaaaaatacgtacagttgagagcagaccactaattcaaaaaaattagcacttaaggaaagtgagaactagaaaaataagttgagaagacaaaagtcttgcaacacaccccctacccctacccaccagaaaacttagacttgaatggttctcagcaagagaaaagacattgctgtagaatggaacttgttgtgggaggtgggattaccacggaaataaatagaagacagcctccctttccaaagagccaaaaggaacccatttcgtctagttaagagacgaggcaaagcggtaaaatggtgacaacacgtcctggtgagtggttctgaccgtgaatggttggaaaatgctgtgggaatcagaaaggggaaccgtctgggagaggtggtgtcaccgaaggcttctcggaggaggtggcctctaactcgagccttaaaaatgggcgaagaggcgaggccggggcctgcccggcgcggagtactcgggagccgcctccctcctttcagagctctcagtcccgtccccgggcctcgctttctcctctcgcctcgctcagctcagccgggcgcaggttcctagcactgacgacagcgagcgatgacctcagcgccgccaaggctgcgagggcgggggctggggtggcgggggcggggaaaagcgccggagcgcggggccgagcggagaggctccgggccccgcccccatcctctggccgcgaccaatgagcgccgccgccggctgcccccctacctccctggacctcctgaaaaacgctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacaggtgagcgcatgccgaggggcctggcgccaccgggggtcggccccatccctgccagggccgtctttcttctactcctgcggcagggtgacccacgggagcagctttgggactcggtggccctcctccgacccccggggcggcccgcagtccccagtttcctgggtcctcctccccagccctgtgctcgggtctcggccgtggcggttctgatggggcgcgcccctctacgctctcggaggcgcagaccctggtcctggagtgccagcccgagtccccagcttatgcccctgtctcattacgggctcgtctccctcgctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaacaatttggagtcccagtgcggttcttcctgccggtcggggtgcgctgtgcctggggtagtccactggttgctgactggcttcaagttggaatttgggccccctttgtgttatctttggttccccttagccatctgccacctattgtggtagggaggagagcctcgtagctcgtgaccctgccgtgcgggccttcaagttgggaggtgaagagataagcagcccgctcgctggctggggagagacctctctcccagctgtttctagctggttactgtcagttttgggaagcgatagccatctcggaacgcacccacacagaccctgccttctgaggaaaacagatgtttcatcaaaacaacccagttttcactcccttaggcactgctaaggaaggttctccgactcttctgaaggaagcagagggaacacagggtgggaggtccagtgacttgctgtggacccaacaatgttggcagccttcctggccctgaaacttcagctcacaggtctccagaggccctgcctggacatgccagtcccagtcacacccttcccttgctttgggggtgtgccaaaagcaatacactggccactagagagtaccctagagctctagaatcccctcccaacacgcacacacacacacacacacacacactctctctctcacacacacacactcagtacacacacacacacacacacacacactctctcacatacacttgtcctggaagcaggaaagtggatctttccagcttccataaaattttctctgctaagtggaaagagggtcctagaactcagaggaatccacctcccttacttaaagggcccctttctctcctcctgtcccttgaccctccaccccgccctatggtagtatccatggcctagctgctctaaccagggcatctgcccctggtcctgtctccacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaacttgtgtggtgtagagaagttaaaatcctcacgttgtacatttgtgtttccctttcagatccaaatcctttctttgtgtttaatagtatttctcctcacttgcactcagacaatctatagcatgtgggtggtataaaagaaaaatctggttgtatggctgggccatttccaagcatcccctctttcctggaaagtagctccttacttccctccgttttgtttgtttgtttgtttgttttgagacagttttgtcactcaggctggagtgcagtggtgcaatctcagctcattgcaacctctgcctcctgggctcaaataattctcccacctctgcctcttgagtagctgagattgcaggcatgtgccatcaggcccagctgatttttgtattttttgtagggacggggttttgccatgttgtccaggctggtctcaaactcctaagttcaagtgatccccctgcctctgcctccgaaagtgctgggattacaggcgtgagccaccgcgcccaacctacttccacctttaatgaggattctaatttccctgtgaagatgctagaagtaacagggttctagtctgaacattccctagtctagccagatctccatcttatgcatcttgtttttgatagtcgttcatttcattcattcattcattcagtcagttattcatttagcaagcatgtattgtcagtaagtgctaggcactgaacttattaaaaatccttgagacacagcctgtctcacagaccagggtttggtaagcagcgggtaatgaactccttcccaggctaaggcaggattgttggcaattcccagaaaaggtgctcttgtcatctctggggctgtcatttgctatccaccatacttgtcttgttagacaagagcagctaggcctcaggatctatgcactggagctgaatgccaatgctacaggttagctagagagcagctacttctgacagcaaacactggagtgagagccaaaagtttgttaccaatttgtaactccctttggttacatgcaaggaaataacagtttttatcttccctgacttttgagttctttccatgagatttttgacacaagcccagagtttcccactgagggcaagtacattcccagcctggtctagttttttcttggctgtaggtgagctgtatttatttgtttatttatttctttcttttcttttcttttttgagacgtagtctcactcgctcttgtcgtccaggctggagtgcagtagtacgatcttggctcactgcaacctccgccttccgggttcaagtgattctcctgcctcagcctctggagtagctgggattacagatgcctgccaccatgcctggctaatttttgtacttttagtagagacggggtttcaccatgttagccaggatggtctcgaactcctgacctgaggtgatccaccctcctcggcctcccaaagtgctgggattacaggtgtgagccaccgcagctggcggtgacctgtatttaaactaaactttacacatgttgcttcatatacagtgacaactcccccaacttcatttcatacctccatgacctttatcaacaaacatacagttttccctagatgtgctatgttggaagtagcccagggaggctgtgtgtgctatgcctgtgttgagtgaggagggtaggggagccagggatggggttagggaaggccaggtcatctgtatcataaatagaatttggttaagactcattgtatcaaggggttgttactgaaaggagtagtcccatttttatttgtagcttctgaaataaatgtcctagacacttgtttaaaaagacctacttttttggatgtaaggacagggttagttagggttgaggaatttttgcccaccctcttttgagtgtatggtacaaagtcagcatctatcttcctgattcctaaaaggcctagctcatgaaggatatttcccttgtttagtggaaagcctgaaatcggggaaggt

SEQ ID NO: 12627 - DNA, 117080 bp, Human
  misc_feature (1)...(117080): n = A,T,C or G
aggaagataacgctttgcagtttcttaacttagaatttaaattcagcaaatatggatattgtcatttttgatgtcacttctgattaagaaatagaagattgttagagtatcttaatagatgattgatttcttatctgaatttccaataatctacatacatagtaaaagtggaaattgaagtttatcattactgatccaattatatcattaactttcaccagtaatcttattgatgtctaattgtagaagtcattgaatgaactcatcataataaaaatgaattcaatttagcatccctattaaagttttgtaatggctaatgggttatgttggaattgattaaaattatagaaagttatatactataagtaatggaaattataggtcttttcccaggccattcattttttttttaattattataaatcttttgcaggtgtgtacttttgagaacagcttatccttaaaaatgtttaataagcagccatagagtacttgatagtatatgggatgctgaagaatttaaagagattaaagtccacccagatatagtttccttgaagatatagaatctaggaggaaaggctctgagtaagtaatgataaatggagctaagcatggtttcattgcattttaatttcaacaaacgcttacttagtatatactaagtgcaaggcataggtgaattaagtggtgatatctgctcacctaggatatcagtttggaaaaggtggctaaaaatggaattcaaaactgtcagaaaggatttggtcagagcatgagttcatcaaaggctattattagtgaaagaatgaaaaacttggtaaaattgacatgaagagcttgcctgagtggaagagaaccatacgttttagaacattcagctttctcaaagtatgaacactttccaacaaaggatgagtttcctaaagggaatatgtgtgcagtttgttactcttatgatattggaaataacgaattttgcagagattcttccagaaggcttacttttttggtgtgtgagtgaaaatatgaatggtacttaattggtttctaattgttttgtgtggattttgtctttgaattgactgacatttataagtgctttgaaaatgtgagtacaaccttttctttgattgattcaaatttttatgttatgttaaaatgcccaccaaggagtaacatttactagacttcttactgtgtattgggttatattttgacaacctagcaatactcgttttcctcatgcccagtcattgagcatcattttggtttccttcactataccatgcctgaaaatagtccaattttccacccttctaagcttaagacttaactcctcttaatccttcaggtatttgtatagtagagtgcttgtcagtagatgtttatcagcttatagataatgtctctgctgaaaattatttgtttcaagttctgtgaaacaaatacccaccgaagaaagttaatttcaagttaaatttactttacttgattatagaagaagggagtaggatgaagtacctgggagccactagaggactggagaggcagtctaggttgtagttgtagagggatggatttgagagaagcttatggtggtttatgctcagagtaacctggatggataagatatatggtggtcagaaagaattttttgtttgagactgaaaagtgtttgatctatagatttaattcttaaaaatttttcttaagacaaagtgagttgtttttatgcaattggattaaaagataactaacttccatgtaggtacagtgaaaataaaatggctaacatttaaattcagtagccaaatataattgttattagtaacttttttttccatttttgatgggctacaattatatttctaattctgtttactgcataccagatttaacatattcctagggttccacaggaatggttaaaaatacaggtttcaagatgagaacaaattatagtagttgcttttcattgcatgggttttgacctattacttaaatcatctgatttgtgagaatatgaaaaatctatactaattggttttgttcatttttatattgtaaaatttatataaaaatttaccattttaactatttaagtgtataattcagtggcattaagtacattcacactgtcgtgataccatcaatttcttttccatccattcagaacgtttccatcatctcaaacagactctgtatccattaaacaataacttcccattctccacttcccatggcctttggtaacctgttttattttctgtctctatgaatttgtctattctaggtacctcatataaatggaatcatataatatataatatatgtccttttgtggtacactactagattttaaagaaacgagttgcaataattatagttgaacataagttttgtgtatgccttagtctgttttctgctgttgtaacagaatgctacacactgggtaatttataaagaaaatatgtttatttggttcatagttttggagactgagaagtctaagatcaaggggcctcatctctctgtgagggccttcttgcagtgctataacatggcataagggcagaagacagaagcgagcacgcaagacagagaggaaaagggggccaaattccaacgataactagcccactcccctgataacagcattaatctagtcatgagggcggagccctcatggcccaattaccttccgaaagcccccacctcttaacaacaccagacttggaggggacattgaaaccatagatactttatagatgttttgtatttaaatctatggtaggatgtgctcattatccttttttgttgcttagtgcatgtttgagtgttatagggagtattacatgaattatatgtgtacttcttccatactcttttaattggatatgccagtgtgtctcagtaatttccagtggctgtaaaacttgagaaattttgtagcttttagaaaccacatacctgtattgcctgattgcttattaagtgatctcttagaggtttccaaagttatgagtttgagtttacaagtgcagtttttttccatgaaaatttcagtggtgacaaattatagaatttatcattcaattcagtcttaactagaaataattgcatataataaaacaggttcttgactgttctttttgtcagtgtttaagaatagagacaaaataaagttagatttgagtgcctcagaagatattagaaaatagagataaggtttatggcctttaaaaaattaaagacagtattgggggaaagaaatgaaaattgggaccgggcgtggtggctcactcctgtaatcccagcagtctgggaggccaaggtgggtgaatcacctgtggttaagagttcgagaccagcctgaccaacctagtgaaacccccgtctcaactaaagatacaaaattagctgggtgtggtggcacatgcctgtaatcccagctactcgagaggctgaggcaagagaatcacttgaaccaggagatggaggttgcagtgagctgagatcacctcattgcactcccgcctgggcaacaagagcaaaactccatctcaaaaaaaaaaaaaaaaaagaaatgaaaattggactttttagatgggaatatctcagatgatatatctgtgtatctagaaaatgtcattatttaagatattctaaatggttatgattaaaaattatttcatggtataaacttcaacagagagcattgggcaaaatttttactgttcctgtttttaaaagttcaagtcagaatgcctgcttgttaccgaatcatccaccctgtgtttgcctcaatactgccatctggtgattattatagagatctcaacagggtgcttaaaggagatgtagggcaaccgacgacacaaggtacacaatattggtgccctctgcctcaaatctccctctgcttttgagttgctatggcagaaatcttacttagttatggccatgaaatcactttgtgagattgctttgtaaacaatagagcatttctgtactgctgtgattattactgcactacacatggctttttatcaggctcatacccaactcattgttctttctatgtaaggtactcttattatatctagttctacaaggtaattcaattaattattcagtaatacttattgagtgacttctatatactaggcattgtttttatttttatttttatttttattttttttttgagatggagtctcgctcttgttgcccaggctggagtgcagtagcacgttcttggctcactgcaacctctgcctcctgggtccaagcgattctcctgcgtcagccttttgagtagctgggattacaggtgcctgccaccatgcctggctaatttttgtatttttaatagagacggggtttcaccacgttggccaggctgctcttgaactcctgacctcgtgatccacctgcctcagcctcccaaagtgctgggattacaggtgtgagccaccgtgcccagcctaggcattgcttttagtagtaagaatatggtcctaaaaaacaggtgaaaatcagagtcttcatagaagttacatttagttaagaataaataataagatatacatacacacatgttaattagtgaaaagggttaaggggaaaaaacaaagcagggaaggaacttgtgaattattggggttggtgggttgctttgaaatgctagatggggtgttcaaaaaaagccttactgagaaggtgacttcctgagtagagatctgaaagatcttgggacgaacattctagatatagaaggaaagcaaatgcaaaggccctgtgcctgtaaccactgccttgaaaacctaagcaaggaagctggagtggagtgtagagggagagagcaatagaagatgaggtcaggcaggtaactgagggggaaagcaggggagtacagatcacacagtaccttgtagttcatgtggcatttaatctgagatggaagcaattggactggagagttgggggcagctgaatgacatgctttgatttaccttttaacagattcactgtggctgctgtgtttaatggtgtgtaaagtcatttgctacaaccttttttcttttattagttgtaggaacaggtttactttatatagatcatgggaacaataaggtataagaaagaagcttggataggtctgagagaaatatatggcatattttctgtctctgcacagatttttgcactgattatcagtagtttttgtctttgtgatacagagcaattgaaatcagcttgtagagtttttcttggaaaatgctttgaatatctcttctatttttcctataaccaccttagtgcatttcagattcaaatcttatggtgaacccaatatagttttagccctacctcactggttttcatgctcattaatagtttgggaatgagagtgacctggagttataatttttaaatgcttttaacaatatagtttggcatattgtaaaacaaatcatggtgtactgattagcagtgctatttgaccaataaattaaagaaaactgatagactgtgtcttaacctagatgatttatttaaaccatttgttgctgtagctcatcagctgaaatgacttaaacccccaaggtactgttactctttcccaaattgcacttaaaaaacaaactgaaattatcacttagttaaaatgtcatgatcattgtcagtaatagtatatctctgtggattcactttggtttggtagctgaaaagtttattatttttatgcttggccaaagaatatgcatcttcagtggggagcatgccatgtgtgactgaaaactgtttttatacagcttgactctgtttggaataacgcctttatttggcttaacaaattgcttttcagctttattttcacactgtaaatatcaatattgtataaacttgtcattattgggactaatcagcaaattgttttgtgtcatgagtaagcacggtctaagactgggattatttgataagtgctagaataatttggttaaactgtctatccagctctaagtaacaacacagccagttggtctgaatcactgtgcctcaacccttcactttgatgaataggtttgaatggctgaagctaatttggtttggggtagacaaagtctagtaatgtgaaactgatcatatataaaagaagtgttaacagtagtaatattacagggaatatacagggacatagagggacaattttgctagcggtttcttagttatgattttgaataccatttttttttgcagttagaaactttactgtcttgttctggatgataaagacacatgtttgaagacaggtttcctatgctgaagaataacaataatttgttttccagactttctcctttttttcccttttatgtttgcttcgttaagtagtaataaagtgatctaatctgtccctgagaagtatagtagattggccaagtactttgctatacttaaatatgttaattttggtaatttagtttgagttgcgatactgttctcagtcttccctctagcttccctgtcctaaagtaggcttctcttcagtgattcctctaaacccaactttgttcctttttttaatccagactgctaaagtgatacaatgagctttatatgtgaacctggtactgtgacctgccattcataggtcattacattgaattgtgtacatatccctcgaggagaatgacttttccatgctctcacccctgttttataaaagatggtgtagtggagagaggcccaggaagaagagttgacacatcatttgatcttcactgcctctaataggtccaatctcttttattacatttgtcttctcttctacatttaaataggtttagtctttcccatcttgaacacttagaatacattaaaacctattgcaatttctttttagctaccttttgtctgctctctgtccgttcatggcagtttgttggtcctgtgactttagttcttattctgtcactgacaagggctctctcacagtgatgccttcaactatttctcagttgcagaatctagtaaatacctttttttttcttttttttttaaagacagtctcgctctgttgctaggctggggtgcagtggcatgatcatggctcaccgcagccttgacttcctgggctcaagcgatcctcccacctcaccctctcaagtagctgggactacaggtgctcaccaccgtacccggataatttttgtattttttgtagagatggggttttgcttgttgcccaggctccagtagatactttatctttccaaaattgattattgattactttctacttgttgaagttcttgtgtcattacttcttttgtttctgttttctcttagattggtcctttgtggtctccttttttttctcaggtgctcctgaatgttggtatgcttctctcagtctttatcccatttctgtactcccctctccttactttctacccttttctgccccctccacgttctgagtgctgtcagttatcacctgtatgttgatatcttttcagtccatcttcagcctgtttcctaagttccaaactttaatgtccaaatcactattgatgtttcttgaagaatattccaaaggtaccatggtcctatactatattttttgattaatttaaatttaactctaattaaaatatacatacagaaaatgcacagattataagtgtacaccttaactacacataattaacatccatgaaaccaccatccaggtcctgaaagagaacattaccagcacctcagtagtctgtttacaattcactactgtttccttcctttccaaaggtgaccactttcctgacataacaatgtagaactatatttgaacattacattaaaaaaatgtacaggatgtattcttttttctgttctttcaatatagtttgtgatattcatccatgttgttggcagcatttgtttatttttattactgtttaacattctactgtatgaatacagcacagtttatctgtttaaccacctaattatttgggtaaattttgtttgaataaaatgtattattatgaataatgctgctctgaacattttggtgtatgttttattaatatgtacttcaattgtgtatatagctaggagtggaagtgctggatcatgtggtatggacatgttcaattttagtagataacgtcaacattttcaaattggtcttgtcaatttatatttatattcctgtcagcagtgcatgtgttgttccacctttttttttttttttttttttgagacggagtctcgccctgtcacccaggctggagtgcaatggcacaatcttggctcactgcaacctctgcctcccaggttcaaatgattcttctgcctcagcctcctgactagctgggattacagatgcccgccaccatgcccagctaattttttgtgtgtttttagtagagacggggttttaccatgttggccaggctggtcttgaactcctgaccttgtgatccgcccgccttggcctgccaaagtgctgggattacaggtgtgagccactgcacttggctgttgttccactttttaatcaacccttaatatcagtggtcttcataattttagccattctcgaaagtctattttcttggtgactaatgaggttgaacatctttccttatgtttgttggcctttcatgtgttattcatgtattttctgtgggaaagtacctgtggaagtctttgccatctctgttgaactgtccgcctcttccttactgcaatgtaaaaagttctttatgctggatatgggccatttgttggttaaatttgttgttaatgtcttacattctgtggcttgccttttcattttcttagtgctgtcttcccagtctcttgtcttccttactatgcttctctccccaaagcaattagccatcaagtcctgacaattttatcttttaatatcttttatcttcttttctccatttctttgctcagcgccttaatacagtccttctttgctcatggcctggattatagatcacatcccttgcaatcagtttttaactgcttacagaatgacttttctaaaatttaaatcttggccgtactattcctctgcctaaaatctcccagttgtaccttagaggctacagaataaagctcaaatctcatgactggcttctaccttcttcctaggccttctttagagttgttgggtttttttttttccccagatttttactgctggataaagtctttcctgacttacttccccagttcttttttcatactcctttttgaggaaaggatgtggtagtcttaattatgattaagccataattattaagacaactagccgttcatctctcagtctcttggctgagcactactgttagcttatttgtgttggatgttttgatattggtgttccacccaactctctcattaatctgtttgcttttctggcttattctctgccagccacttaattattggtattctcaccttagctctcttcttcatacctttctccgtgagaaaactcatcaattctgatggctttaatgccattttgtatgtatatgacttctagatttttaaatccagaccagtctctgtcttaaatttcagatctctctgtattatattgtcagtgggtattgctacatgaatgttacataagtattttttattttttattttagttatgttatgttacgtcacgtcacgtcacgtcacgtcacgtcacgtcacgttacgttatgttatttttccgagatggactcttgctcttgtcacccaggctggagtgcaatggtgcgatctcggctcactacaacctctacctcccgggttcaagcgattcttctgcttcagtctcccgagtagctgggattacagatgcatgtcaccacgcctggctaatttttgtatttttaatagagacagggtttcaccatgttggccatgctggtctcaaactcctgacctcaggtgatccgcccgcctcggcctcccaaagtgctgggattacaagcgtgagccactgtgcccggctacataagcatttttaagctcagtaagccccaaactaagctcaccttcccttcccaaatctgattgtgtattttctacctttttgaacacctttttgaacctggtggggctgcctgttaaatacttctggaaaaacttaagtcaaagggtacttttgtgaaagtacctccttccccactttcctcctgttttctattactatagttctatcatggtacctacaaacattttattgtactttatctgttctccccagtagactaaaagcatctcgatactttgtccttggggaagcaagcaaatcaatgaaccaatgaatgaatgcatcttgagggttttccattgccatcctgcacagtgcctagcataaacagttgagaggtgactgagggtacctccaactaaacacatttaaaatggaactcaccagtttcctccaaattgctttcctccaaactttctgctttaaaatgacttgctgtgcacagttgatagcgtcaccatcttttcagttcacttagtcatatttaactcactttgtttttctgctactctcaaaactggttttaagcccattgctatttcttctatttcatttccttagctttggttcaagttctcatcttgtcttcaccagatcattgtaaccactgtttaaatgttttacctatctttggagttttccccgtttgtctttgatattgctacaataattatttttctccaagtgattatctcctggttctgtaaacttgcctataggataaagtccaattttaaaaaaatttattttcgttttaaagctgtatttaggtataattgatatataaaaagcaaatatttaatgtatacattttaatgagtttgagagtccaacttctttaccttcggtggcagtcttcacgaacttatctagcttctttcttttattttttttcccctcccttatagcagaagctatgtgctttaagcattggccttaccagactgcacacctaagtctatgctacttatactacctctattgccttctctccatcactcttaggaggaacatagattaaacaaaccactcttaacatttgttagctactgtccttggacaagtttctaaagatcccaaaacataatactgatgcttagtacatgttgttttcccctttcaacctttcccttcctccacaccacagttggaatttctttttcgtactgctagaaaacacttactgtttctctcacttaatgtcttctgccgaggagtcactgtgtctgtttacttgtatatatcttactgctcttgtactagatcacatgctttttcagcgcttacactgtgtcttcttgaacttattccagttgaatttttcaatcttaagggtttgctttttaaaatccacactgtatcatttaggttctaagtgatgaacatgactgggataggattttttggagtaaagtttctaaatggtcataacaaggaccagttgtaaaggcccagccagagcaggctttgtaaaaactcacctacttagctggaatttaggagagtaatacaattgtcctaaacttactctggtaggaatttaaaactataattttgatgtctttgtagtaatactaaataaaagtattagtactggaatgaattgtgtttttcttcacagccggttgctgaaccaatccccatctgtagtttctgtcttggtacaaaagaacaaaaccgagaaaagaagccagaggaactcatctcctgtgccgactgtggcaacagtggtatgtgatttccttctgtttttcttctaaaatgtgttacgaaggcaagcggaaagtatgttgacttgagtttgtatccttgatccttatgagattaatacagtcatacatcttttaattatgggggataagttctgagaaacatgtctttagaaggtttcatcatcgtgtgaacatcatcgagtgttctgacacaaaccaagagggatggcctactacacatctgggttatgtggtgtagtctgttgctcataggctcaaacccgtacagtactgaatattgtaggcagttgtaacactggtgaatatttgtgtatctaaacatatctaaatgtagaaaaggtacagtaaaaatacagtagtatgaccttacggggctacagtcatatgtggtctggttttttgttgtttgtttttgagacagagtcttcctctgtcacccaggctggagtgtagtggcgtgatcttggttcactgcaacctctgcctcctgagttcaagcaattttccagcctcagcctcccgagtaggtgggattacaggtgcctgccaccacacctggctaatttttatatttttagtagagacaaggtttcaccatattggccaggctggtctcaaactcccgacctcaggtgatctgcctgccttggcctcccaaagtgctgatattacagatgtgagccaccacacccggccatatgtgggctgtatttgattgaaacgtcattgtgtggtgcatgactgtattttaatttgattatggttttaggtgactgagatgagcttctgtactagggagggatttgaatatatagctgaaatgtgtaattcagttaatttaaatcaggtcttagtttttttttatatatataaaacactttctgtgggtttattttttcctcttggtctttacatttcagtatttaacatctgcttaaatcacagcaatcagtttgaagttattgctggtttctttaataatcgctacttcgtctttcttgatttatgcctcaggcttgatgaatagaaccaggatgataacagatttgtttttcttgatggaaacttacatatgtcacattgggaaatagtgttgatactgcagtctagcgagcaatgtgaaattctaggccctaagaaagattttgcagaatctcctaatttgccagttccagagatattcttgctctacatttcaagaactcacaagatcggccaggcgcagtggcttacgcctgtaatcccagcattttgggaggccgaggcgggcagatcacaaggtcaagagatcgagaccatcctggccaacatggtgaaaccccatcactactaaaaatacaaaaattagctgggcgtggtggttcgcacctgtagtcccagctactcaggagactgaggcaggataattgcttgaatccaggaggcagaggttgtggtgagctgagatggcgtcactgcactccagcctggcaacagagcgagactctgtcttaaattaaaacaaacaaacaaacaaaaaaaaaacttacaagaccttacaggaaggccttagcaaaccagcattatctttgaccattggcttaattttcagtgttttatagtgataacaaccatgatttagttcagaaaacagaaaccacactacatacttcaagaggaaggaagttaagtataagaattaggtatttgtgaaatcattgtcagggctgaagaagcaagctggaggttgggctttaaggactgactctggggtcactgcagaactgacccatctgaggagttactgtgtctgcctctatctggaagaggtgcaagcaggggggagtccactgcacaacagttgcgctctgtagttggtgctgaagtgctaagtttggccatcattacaatagctctagatacctacgagggagaagcatggatacggttgttaccatgactttgcttatcattagaaaatagtactaggaggaggatgatctttgctttgtttttacctttcgaatatccctggagaacacatccacttgtcagaacttagagcctagctgcaaaggagtcttaagaagtatgattttttagcttttcagtttttatgcatagtagaaggtgagaacagatcttgagtgctaggtagtcatatccagcgtgttgtcacaaaccagaatgaactctggatggatttcatagttaaatataaaccgtaaatcatgaaagattagatgaaaatataatggcatgccatacaatgcagttatttccaaattccctaattaaaacccaaatatataaaacatagaatgagttgttctaggtggggtgggaatgaaaccgaggagaggaagtgttgtgtctgcagccctgccgtctaagtagcattatatttgaggtggtctgtgcgtctctctaagctaaggatgagcataatttgaaaactattactgtagcggtaactttttttttttttttttgagacagtctcactctgttgcccaggctggagtgcagtggcgtgatctcggctcactgcaagctctgcctcccgggttcacgccattctcctgcctcagcctccggagtagctgggattacaggtgcctgccaccacgcccggctaatttttggtatttttagtagaggtggggtttcaccatctctacttcaccaggatggtctcgatctcctgacctcgtgatcctcccgccttggcctcccaaagtgttgggattacaggcgtgaaccactgtgcccagcccctgtagcggtaacttttaaagaaattgtagaacaattaactactagttatctgttgctgcagaaataaattactctaaatcttagcagcttaaagcaacaaaacattttttacttcatactgtttctgtaggtcaggaatttgggagttgcttatctgggtggttttgacttggtatctttcatgaggttgctgccaagattttaactggtgctgcagtcatctgaaggcttccacgatggctcatttacctggctggcaagttgctgctgccacgggcttgtcgacaagaagcttcagttccgtgccatgtggacatcttcacaggactgcatgcatgcctgcagcatggcagctggcctcccccgatgagtgtctgagagagagtgaggtggaatctgcagtgtgttttataacctggccttagagtcacactgtgttatttcagcaatatcttcttggttatgcagatcaacccagttcattatgagagggagttgtaagagtatgactagcaggaggcaagaatgcctagggagcagcctggagactggctgtcacaatagccaaagaagaacagcatgggcatagctggatacatgaacgttgatattttctaaattaaaaagtaacatgcttaaagtagagcaagaataatttgggggaaaataactgctttaaatatggcaaagggccaaaagctatataagtataaagaacatgtttacatttctaagcatgaagtccaaagagcagagcctgtgaactggcaatttatatgaaagaaaactaatagttgagcctatgaaaagtgttttactcaagtagtaataggaacacataccacagtagcagtgaagtatcattgtatagcgtttataataatcacaattgaaatataacagacctagagctcatgtagttgtgctaaaacacttgttcttttgctggtggcactgcatattatatcatagtttttggaaaatgttttggcagtgcatatcaagctataaaaatgtttaatacatttgactcaccaatcccactttcaggaattcattctaagggattaaaagaagtaaagaatctgtaaacatgaaataattcattttagtgttccgtagtctcagtatttaacaatagggaaatgttcatgcaggttatagtatatcagtcagtggaatatgatcagtttaaggaatataaagtttacttaaaatttaaaataaaacaaaaactgtatgtttgctaaaattacagtcatgcagagctttcagctagtttaaacaggaaagtctaacataaaaatggctattattctaggatgataggattgtgggtgaaattttcacacctcttggattttccttcagtgttagtgatgttttgataataaacttgctatctcataaaagagaaaatcctttaggaatagaaaagagaggagaagatttaacaagccctttctctcaccaaagaaaaataagcacgaccaacttttagaggagagggacagctcttttcagttgaggggaaattggctacccttaatttttgagaatcagactgataactgactcttggaagaggaagcatttttttctcttgctattcattctgagcacagtagaaatactgcttttggttttagttttagcttgcatgccttaaattgtgagcagataactcactttaagtgatggtatttttattatatacaggagtcccccttattcttggaggtttcaagacccccagtggatgcttgaaaccttggataaaaccgaactctgtatatggtgctatgtttttccctgtgcatgtgcatacatacatataataaagtttaatttataaattaggcacagtaagaggttaagaataatagataacaaaatagaacaattataacaacatgccaccatcactagttttgtgctttgggaccattatgaagtaaaataagggtgactccaacacaagcatgataataacactagcatggtgataccagcaacagtctgataacccagacaaccactaagtgactaacaaatgggtagtgtatgcagtgtgggtgatcgcagcccagctgggacagcagatctcattatgctactcagaacagtgtgcggcttaaaacttaggagttgcttgtttaatattttcacactgcagtagactgtgggtaactaaagcctcagaaagcaaaactgcggataaggggactaactgtattttttaaattacaaaagtaaaacattgtcatttaaaaaatgacagcacaaaagggtataaactgagacataaaatccttcttgatatatatagctcagttttctaggatgttatcagtgtaaacagcttttttgtatattcagtaatgcatatatgagcatttctcatatatgaacatatatgtattcatatatatacatatataccggatatgtacacacataatgctttgatgtaggcttaataaaagtttggagtttgtcaagttttttttaataatcaaattgtggggaggggtcctaacttctctttaacattaataaaactgaattgtggtgccaagtcctgatgagaaatgtgtggcaggcttcctggtgcatcttgctttatttgatatatattttgtatttaagatgattgcctttttctacatcatttctttagtactataatagcaaaatagttcttgattgtttcattcatgaatgttctccctcgtattaggccatccatcctgtttaaagttttcccctgaactaacggttcgagtgaaggccttacggtggcagtgcatcgagtgtaaaacatgcagctcctgtcgagatcaaggcaaaaatgcggtgagtatctctgccttctaatatgggtgtttcatttagtagtagaatgtacgaccagcattttcatctaagtatgactggttatttttcagacacttggtccagtagcatttagaatagccggtagtctctttaaactacatgtcattagtttagaatgcttgctaatttagacttcagttatgtctaggtaatttgtaaagcacttaattatatatttgcagagagactaagccacattaaagaaatactccccaaatttctttgagcagtacagaggcattcatttaggatggtcagttgatatattaattacaagtcgcccttttctcattattaaagcagaccagggttagcttatttctggttattggatatacttgaaactaatgaaactttagttctttatcaaagattggctggaacataactttttgctaactctatttacatagttaatacaaattaaggaaacttttaatattatggtcactcatctcttttatttatttatttattttgagaaggagtctcactctgtcgcccaggctggagtgcagtggcacgatcttggctcactgcaacctctgcctctctggttcaagcagttctcctgcctcagccttctgagtagctgggattacaggcacatgccaccatgcccgtctaatttttgtatttttagtagggacagggtttcaccatgttggtcaggctagtctcgaactcctgacctcatgatccacccgcctcgacctcccagagtgttgggattacaggcgtgagccattgcgcctggcttatctctttttttaagatccctgaagctttctaggttttatgcagtcatgatcgtaacatgtttctgcttcataaggttaagcaaaactgtcctttcttttttctaataggataacatgctcttttgtgattcatgtgaccgaggttttcacatggagtgttgtgatccgccactcacccgtatgccaaaaggtgagaaatactttctgaaataaaactgggaatataaaggaggatgttagtgaaagcacattttatctactttgttaaatgaaataataattggatctttctttttgaggttgtataagtaggaagagaactgtcaccttaaaaggtggggggatagtctttctgagtgggcatcttaacattcttacatgatacggatttattgttattttcaatatctaggcatccatcaatggtgaagtggttcatttatacatatttgccagtctctagctagaagataaaatacttgccttaaatatatcttgaaatatctctttattgaaaggaggaaataaaatagtattaggtcgtgttgattatatcactgcttagcacttttgagggccctagagctatagagatatggtttattcaaaacttaaaaaaaaaacctttttatgaaatactttatgaaataaaaaggttttttgttgttgttgttgttgttttaatgaaatacattctgaacaaataagtgtccagattgtaagggcgcagcttaatgttactcttttcttttgattcctgttcattgagaggtatttagtttgggcatagttgcctcatggttggacttccatattcatatgcttataggttctttaaaaaaaacttcagccagacccctctttttgtcctatcacaaattccattttaactctgattttataatttataggcttcttaagtaaaatgcctataggatatttcataatatttgtttggaaaaaaatttcctgttgatagaaaatgacttaaccgtactttgtagtcatgttaacactttaggtttttacttgaattcacttattccaccccctcacccatggagtctcactctgtcgcccaggatcttggctcactgcagcctccacctatcaggttcaaagcgattctctgcctcagcctcccatgtagctgggactacaggcgtaccacgacacctggctaatttttgtatttttagtagagatggggttttgccatgttggccaggctcgtcttgaactcctggcctcaagtgatctgttcgcctcggcctcccaaagtgctgggattacaggcatgagccaccgcgcccagcctgaattcacttactgattgttactttttgaaacgtcttcaatttataaatactaaagaataaatacccactttttccatttatgtgaagtctgagcaaggggccttctaagagtcctaagaaaggttttttttttggagttggaatctcactctgttgcccaggctggagcccaccttggcctcccaaagtgttgggattacaggcgtgagccaccatgcctggcttgcagctaatgttttttgtagagatgcagtttcaccatgttggccaggcttgtctcaaactcctgacctcaggtaatccgcccacctcagccccccaaagtgatgggattacaggcatgagccactgtgcccagtcaagaaacatttccttaggactcctttcttgtgtgtttaacttctacaaaagagattatatagcagctttaggcaggaaactttttttttgagacggagtctcactctgtcgcccaggctggaatgcagtggtgcaatctcggctcactgcaacctccgcctcctgggttcaaacgattctcctgccttagcctcccgagtagctgggactacaggcacgtaccaccatgcccagctaatttttgtatttttagtagagacagggtttcaccatgttggccaggctggtcttaaactcctgacctcaggtgatccacccgcctcagcctcagtggacttcaagtgcagtcagtggacttccagtgcaggcttgaaggtgtatgtgagtctcttccaattatttgtagaattttgtgtgtatatgttttaatgtttattttggattggagggggtattcatcagattttctaatgacagtcttttacctgaaaaagttaagatcctgacttaagactatctgaaacctttcagtgtatttatgtctgtcacacttctatgtggaattttatttttttataggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtgtaagttgtacttgtggcaaggtgaggggagaaaaggatagggtcttctctatagtgtaggattcacttgttttctctatgaaaaaaattccattgtcatatctggcacttttatataataataatggctaacacttattcagcccttaataagtgccagacactattctaagtgctttatatgcattgaattgtttaattctgccaacaacccagtgaaatatagctgctgctgttactttcatttttcaaaggaagaaactaaggcatagtaaatgttgaactgggatgaaaatccgagtagtctggcaccaaagtctgactcttaaccattgctttatgttgcttctcttatataaaaacaggaaagaaaaagttgttactgtgacatttcacatgtcactctcctgatcttgtctcagttgttaatatctattaggtgtacaaatcactggataggttcttcctattgaggtgatggctaagtcccatttttgtgttctttggatgtaaaataatttgaatgttttcatctattagcagaaatcagaaattgtggactagaaagctgggctatgtctggaggaggtggggcaagattcagtagctagttttgtctttttaaaaatgtctgtagtaactcacctttgatgatatgtaaacgtcttcaggcttgtcaacctccctttattatcaaaagttttacttactttttttacacgtaagactatcttgaaggtgatataactgaaatgaatgggcattagcagcctgaaatgtacagaaccaatattgtagtctatattcaaaatcttaaatcaagctttgattttcctataaaatgatcttttgattcctggccttcgaagaataacccatccttgtgttttagagataaaagtataactttcagttggtgcagagatcacagtgtagtagaactttatacctggaaggatcttagttgttcttagtccagttctcattttacagatgaaggcactgacatatgtttagaaaaaatgtgatttgtccaagtcgtacagctagtaagagagaattatgactagaacaagtcttctgactcctggcctgtcattctttgcactataagtaggcttcctggcaatagatgtttctaataataatattaattttcattcacagagtactatttatagtttgcagaatattcttaataatatagattttaataaagctgtaggttacttactaattatatgttatgtattaaaaaggaaccttacaagtatcttttttaatacttaccctttcccctgtttaattgtttagatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacaggtaagagtttagaacagacttagaaacaaatagtattctgtacatgtattattcgggataacactaattatctataatggatttatatttgattattaacaattggttatagaatataagaacacattgaaaaaacatgtagatgatactgaggtgataactgtggcaggaatttagaggatggaaataaagttgcagaatgggacagtaggaactcttaggcaaaaggaagctgcttttttgtagaaccacaaagaatctgcctagagaaacttggggtgtaaccttgaggattactttacatttcacaaattactaaagaaatcatatggtgaatgttatgatgcctgcttattccaggaaggaaactggaaagaatagaactgggtgaaatgctgttgatctaagcataaaaaaaagaccaaaatatttgcagatgtgatgaggtcattgacttttctacttcagatcttgacaaatatagttgtaagtcatggattgcacttaaaaagggagagacagaaccacagctccaggctgcttatgtatcaggctaagttccctaattttcaaagtagaaaacatctgtggagaggacttaataatgtggcaaatcattcaagtcagaggagaagaatttgattaactgtccaataaattaaagcttaaaatagtcttattgctgagccttgaatttagagatactaaccctgtgaaggaagtagaaagggcttgaagaaagtagaatgagaatgaactcttttggaccacaagggccagaggtgtagtgtctcatctactacaagagaattccctgaccttggtttcctccctgaatgtctccttggtgagggagagtgtattcactgctctcattcgtggttgattgtccagtgcaggagagaaagtccttgtaattgtcagagtcccctttgtatgctttattgattggtcttttaccatagtgatgatcaactaattactctttaagcattcaagactcttcatgtctttatcaacctgtagataagttcctgatctgagcatgtttatctaagaaaatatgcaatccgtttagattaaactaggaaagaatctcagagcaaatcctaatgaaagacatttttgaattaaccatttgtactggagacggtttattagaagaatctactagaaagcttttgaaatagaaattgttagagcaagtgtatcaagtatatggagaaccaatattgaatttttgacagtggtgtgagcgtttgctttaataggctctgtcattttctttatgaattataaagtttaagtaccgaatgctgtattagagaggtgcatgcatcatgcactagggggcattaaagtcacatagtacctttagattgtacttttttcttccagtttgagaatgttgtcaacagtgagtccttgacttttttcttcttgtgttaagttaataacagatggcccatatgtgcagttgacttgagaactgtcaccaattggtcttttcagccatacttataaagagagcaaatgagcccaacagcagtgtcatcttcaaatgcaaaggataatgatcttcataagtcccaaatactctcttcactagttttttgccaacttgaggaagttccatcatttagtagataattatcatacgttttcatatttacccagatgattatcatctgggtaaatagagtttgtgctttaaaaggacagtgttttaaagtttgtgctttaactttaaaagggcacccagaatgtgatgggagttagtactgctgacatcagttaaggtagctactcaagaggtttttttgaacgttgatgcattaaacctatactaaaagtgtcaaatttatactatttcaaaatgaaatttatattccttatatcatttttctgtctgcctttctgtgtattaaaatgtaatctttaatgaagtttaaatttagttatataatatttttaggaagctttaagacaattcaggatttccactataaggcagatttaatacataaatattatttattgagtagcattcttctaagagtcagtttaatgctatattcttcgttatatattaagttcttcaaattgaaataaagacctgaaattttttctagttcatgtattaatctggggacagttaacatgtgagctctttttttatatgtagacaatcaggatggctgggatggcaaacaagaaaatgaggagcgactttttgggagccaggaaatcatgactgagaaagatatggaattatttcgtgatatccaagaacaagcactgcaggtaaagttggatattcaggttagacaatcaagcaacttgttcatggctgagaaacagcagattaattacattgtgggttaagcagtaacagcagtttgcctaatctcagaatagttgtggtttgtgtgtatatgtagttctgctgtttataatattcctttcaaacccatgataactgctttggttttgcagataagcacatggctttgactatcaatattaaataagcttggtttattttttgtcttactgtatgaagaagaatttgggatttgaccaaaaacaaacaaaaaacaagcttctcatgagtgataaaacacctatatttattaattcaagaagtatttcatgcctgtaatcctagcactttgccaaggtgggtggattgcttgagtctgggagtttgagaccagctggggcaaaatggcaaaaccccatctcaaaaaaaaaatagaaaaattagccaggtatgttggtgcacacctgtagtcacagctatttaggaggctgaggcaggagaattgcttgagctggggaaatggaggttgcagtgacctgagatcatgccactgtactccagcctgggtgacagagtgagaccctgtcttccaaaaaaaaaaaaattgcaattctttgtgacacatggcaagatcgtaaatatatagacagagtctatgtgccacatgctggagatgccagtgaatgactgaattctttccctgaactataggagagatttgtgaataagtaatgtcattaatatgaaaagttcaattatagaatacttgatgttttgggagaatagggaagccagcttctacttctgcctggggaggtcagaggaggattcattgaggggccttaaaggatatgtaggagttgtacatatcccttaaagggatatgtagggagttggttcttatataatcagaaggaacagaagtgaaggtggaatagacttgaagataggggaaaacatgcttaattgtgggaattaaaatggctcaggataaagaatatagggtgtggagaatggcaggaggtgaggttggaaaagtgcaggggctagatcataaaggctcttccagattatgttcatttattttttgtcttttccttctttgccaccaacaaatgtaccatgtaagccaagttctcttttatcttgaaaagaagaatttctaggctgggcacggtggctcacccctgtaatcccagcacattgggaggccgaggcgggtggatcacttgaggtcaggaattcgagaccagcctggccagcatggtgaaaccccgtctctactaaaaatacaaaaattagccggtggcacacgcctgtggtcccagctactcgggaggctgaggcagaagaatcacttgaatccgggaggtggaggttgcagtgagccgagatcgtgccacaccactccagcctgggcaacagagtgagactccatctcaaaaaaaaaaaaaaattctaaggctgatgccgagggttctagggaaaactcttcatattaagagacccagtggtggtgaatagactgttgatgtcggtcattatgtgagtacttttggaaaaataaaacagcagtacaaatactcagcacgcatttactcagcattctgctgtattatgatttaacaaaatattggctttgattcaggtggatctgggttcaagtcttgatctgtcatttactaacttctcctttgggcaggttgccctcaaagcttgtttcctttcatgctagtgagttattataggtactctagtagaaatctacatggacttcagtgggaactgaaaggaggcagtagttatgttcttcctgactgaaagaatttttttttctcctcccgagtaagttgcagacataatgtgttaatatccctttactcctaattttttgtgtgtatttcctaaaaacagaaatgttctcatacatgaccatggtccaatcatcaaatcaggaatttaacacaaattaagtactattatctaatttagttgtcacgtctctctagtctccttccaattgggaacagttcctcagtctttatctttcatgaccttgacagttttgaagtgcacaggtcatttatagaatgtcatcactttgagcttgttttatttttcatgattagaaaattccacaggtgtgctgtgtcctcctcagtgtgtcacatcagaaggcatgtaatatccaagttctcatcacaagtgctgctaacagtgaccacctggtttaggtggtatccatgtttcttctctaacattgctttctacctataattaagtatcttggggggacatactttgagacagaaatgcagataacctgtttttcatcaaacttttatctaccacatttagcatccagagatgatttttgcctgaatcatttactttgttggtggccaaacattattttctaattctatcatttctttgccatttattaattggcattctattgtaaggagaagctttttcttcttcctatttgtttattcattttgtttaaactcatagattattttatggttataatccattgctattagtatttattttgatgcttaaattgttccaaatttaggcagaggggaactcctttctagaagctcctctgtccttttaacacatcatcatcatttttatttacttctggccacagcaagatgttctaggctcttactgttgtagccatagattctggcttttagtggtgaacaagagtaaatggtagctctatcctgtacttgcttaggcccacagagatgtcatcttgattttttttttctctgtcatacttcacattcagtccatcagcaaatcctaatggttctgccttcagaatatgtctgtatttgctactgccaacccactgtcatctctggcttaggctgctataattgcctccagactaaacttgcttctgcttttgccaccaccccactctctagtctattttcttcatacagcggccagggtaattatttttgaacgtaggttggattataccacttccttgcttagaaaacctttcatgtcttacagtcttctttagaattaaaaaaaaaaaaaagagtctgttctctcatctccaaggctgtatatgattttgtgcctgcctccctctttggctgctctttttgctctcaggctactccagccacagccgcctcctcttcctcagacacaccaagcatgcctgccttgggcctttgcagtcgctgcaccttgcctcgatggcccttcctctagagtcgatgatttagtaggttcactgcccattccatttaggtcttgctcatatccacacgaaaatagcttacagcccattgtgtcactctatcccctgacctgcctgctttttctgcatagtacctaccacctcttgaatttaaattttttatttctagaatgtaagtgccttgagaacgaggcctttctttttttttttttttttaaattataccttaagttttagggtacatgtgcacaacgtgcaggtttgttacgtatatgtatacatgtgccatgttggtgtgctgcacccattaactcgtcatttacattagatatatctcctaatgctatccctcccccctcctcccaccccacaacaggccccggtgtgtgatgttccccttcctgtgtccatgtgttctcattgttcagttcccacctatgagtgagaacatgcggtgtttggtttttttgtccttacaataatttgctgagaatgatgatttccagcttcatccatgtccctacaaagaacataaactcatccttttttatggctgcatagtattccctggtgtatatgtgccacattttcttaatccagtctatcatttctggacatttgggttggttccaagtctttgctattgtgaatagtgccgcaataaacatacatgtgcatgtgtctttatagcagcatgatttataatcctttgggtatacacccagtaatgggatgactgggtcaaatggtatttctagttctagatccttgcggattcgccacactgtcttccatgattcttgaactagtttgcagtcccaccaacagtgtaaaagtgagaacgaggcctttctttttggtcactgctatctactgagtacttggaatatagtaaagactcagtaaatatttgtttaatgaatggatattgaatgaaattttcttctgggagaaatggggcaggagttgaaataatagaaaggtgcaagaaggatgaccaaagagagttaaacgggttgctgagccctgctgaggctcggggagacagtgtaaatgcttattgacagtaatcgggctaatcctatgtttctttccagcatttgattaaactcagcattgtctgtgtgtgtattggcaccaaggaaataaacagctagatcttggaagtctagttcatgcttatttttgttggcagtgcactgaaattctgatgatggtgctatttctccatgaggcttattcatttagcatcatgcacctgccttggtaccagaactatagggcaaacaaaaagacacagactctgccttcatgaagcttttagtttcacaaacagacagataataaacactcataaaaataaaactgtacttacaaactgatagtcggaaggaaatgagaatgcagtgaggggttctgacgggctgggctaccttgctgagggttggggttggagtgtttatgagaagggaagacttttgaagaagtaacaatttatacatagttccaaaagagtattcaaaagtcagcagagtaaagagctagagaagaacatttcagagacaagtggattgcctatgtaaacgtctaagggtgtgaaagaggttgataaacttaaggaactgaagttcagtgtaactcaaatacagtgaacagaagagttgcataaggtgaagctggggaaatagactgaggccagaagttagaattggggtttttatcataattgcagtgggaagacattgaatggtttttagcaaggaaacagcaagatctgtttcattaaaaaatggtttttcttggctactacataaagagtggtttagaattaagcaagagtggaagctgggaaaccactttgcaggcttttccagtgatcaggatgagagaagatgttagctaggactagaggggtggtggtagaaatgggagagaagtggatggatttagatatattttggagttggaatcagcagaacttagtgatgagttttatgtgtagcttgaggaagcaagagatgatcaaagatgacttccaggttctctgacttaatttaataaagaaagtggtttgaagccacttgggaaagttcatgttgactagataagaggacattttgaataatgaaaggattcataaatatagtgcagaaagtcatttttgagagcatagatatagcttagatgatgcttgaacctgtgtttcaaaaattttgcaggtagattttattacagtgtctttggtagtcttacagcagcatcagcaaaagacatgataaaggaattaatattagaatccatccaactaataacacattgtttattgagtgcctgctatgttctagaaactatggtacggggaggggctatcagaaggacatagtttctgttctcttagagcttatagtctggaagggactatcttgaataatcaaactttgcatggaacattatctaagtcaaagataattgaaatatttagcaagatttttttcaaaaggagtcagccacttattggttttaatttttttaaaaaattattgcaggcagtagggtaagtatggatgtagtttgcctagtactgtgttccatcattagctatacaacatacacttccatgaaaaagagccacctctgaatacaaaagtggaagcataaaaaaattagtagtataggtttttgttctagaattttatttcaactatgatcttacgagcttggagaaactatttttcttaaaagactctgtcagtagaaagaagcatttgtgtgcatgtgtctttatagcagcatgatttatagtcctttgggtatatacccagtaatgggatggctgggtcaaatggtatttctagctctagatccctgaggaatcgccacactgacttccacagtggttgaactagtttacagtcccaccaacagtgtaaaagtgttcctatttctccacatcctctccagcacctgttgtttcctgactttttaatgattgccattctaactggtgtgagatgatatctcactgtggttttgatttgcatttctctgatggccagtgatggtgagcattttttcatgtgttttttggctgcataaatgtcttcttttgagaagtgtctgttcatgtcctttgcccactttttcatggggttgtttgtttttttcttgtaaatttgtttgagttcattgtagattctgtatattagccctttgtcagaagagtaggttgcaaaaattttgtcccattttgtgggttgcctgttcactctgatggtagtttcttttgctgtgcagaagctctttagtttaattagatcccatttgtcaattttggcttttgttgccgttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgggtagccagttttcccagcaccatttattaaatagggaatcctttccccattgcttgtttttctcaggtttgtcaaagatcagatagttgtagatatgcgacgttatttctgagggctctgttctgttccattgatctatatctctgtcacatgcacacgtatgtttattgtggcactattcacaatagcaaagacttggaaccaacccaaatgtccaacaatgatagaccgggttaagaaaatgcggcacatatacaccatggaatactatgtagccataaaaaatgatgagttcatgtcctttgtagggacatggatgaaattggaaatcatcattctcagtaaactatcgcaagaacaaaaaaccaaacactgcatattctcactcataggtgggaattgaacagtgagaacacatggacacaggaaggggaacatcacactctgaggactgttgtggggtggggggagggaggagggatagcattgggagatatacctaatgctagatgacgagttagtgggtgcagcgcaccagcatgtcacatgtatacatatgtaactaacctgcacattgtgcacatgtaccctaaaacttaaagtataataaaaataaataaataaataaataaataaataaataaataaataaatttttttttttaaaaaaaagaaagacgcgtttgtattcagttcattccagtggagcatgaccaccttcttgaaatatatagaatgatttttacataaaatatcaaagagcacattgtattttcatacagattttaatgctttctgattctgaaggattcctttggtttttgtatggttctggaaagttacagagcatttttgaaatctgtgcgggttattaaaatttctttgcgtgaagagttaaatcattattaaaaatacagtaagctagtttcaacaactttattaaccccatgatgtagaggtgttaccccattttacatatgaggaaaccaacactattagttcagtgacttcctgtaagtttttatgttagtggagccgaaattaaaacttaggccatgtgacttctaattctgtacccttaatcacaataacatcctgcattattctgtatacgggatgtcatgggggtagcaaaatcattaggcatgtgctaagtgcaggcaggtaaaggtgcataggaagatacacagcagacaatagcttagagtaccaatgaaacatagtgcattgctgtattaaatgattcagacttgtctcagatgttcacagtatactaagatgtgtgagaattggcgcaacctgagatgatcacagaagcagcagtcctaaggaatgatgaggatttaggtagatggagagaactagggcttatcagatggagtaaacaacattaacttcagctttgaggaagcaatgactactatacaggagtccccgcgtatccaccagtgatacgctccaagatccccagtagatgcctgaaaccgtggactgtactgaaccctgtatgtactgtattgtgttacatgaatgtagtctgtctctctctaaatctcttattgtactattgtactgtactaactcttctgacggtgtgagatgataaaatttgcaccgaggctgacgacaggtaactagaacctcgaaaagcaaagctggggataaggggagactactataaataattccagctggagggcaaagacgtattatctgtgtattccaagaacctgccactgagatagcaagcagaagctcacatttatttggcactcactgcatgaatggcatagtgctgtaagttctgtgcaaatatcaactcgtttaagcttttcaacaaatctgatagtgacttgcccaactaaggtgattcagccgagataggatttgaactgtgctagccttttctggttcccaggctcttaactactattttaataagttgtgctaaattatccaatgaactaaaaatacatctatgcggcctttaatatgtgacttatatttaatgggtaaatgccttaacacagtaaacatcgccccacctaccattcctactttcagcagcatcaaggagacatcacttaacagcaaaaagatgtcatgggggtaccttaaaatcccgtcatgccgaaactgacatcttgttactagctttcaaaatgctccaaaatgcagcttaatactagtaattcagtgtattaccattgcccaacagatgttccaccctgtcttatctcaaactaaactccagctattcctcactttgcatggtgcaatgttaactgaaacccatgcttatcaaactaaagtagattgaaggaacaggagatgatcaaagatgacttccaggttctctgacgctgtaataaaaaaagtggtttgaagccagttgggaaagttcatcttggctagataagaggatgttttgaataataaaaagactcataaaggtaatgcagaaagtcatttttgagggcatagatacagcttagaaactgcttcacctgtgttagggttggcaaaatatggcctgtggcccagtcccatccacagcctgttttgtatgacctgcaagctgaggatggttttaatatttttaaacagttggacaaaaataaaaagaataatatttatggacatgtgaaaattatgtgaaaaatgttagcgttcgtaaataaagttttattacaacatacaaaaaacccatgcatatcagaactaaggtcaaatctgtcacctcagaagcacggacacaattctgatgtgtacctgtttccattaacacagtgccatcaaaaacaaggactgcctgtcttacaacacctttatgggcagatactgtgttttctatatcatctccacagtgtgacttgcatgtagtaggtcctcaaatatttgttgatctgatgggccaataatcaccctatctcctgtatttacagtaatcccccttttatctgtggttttgctttccatggtttcagttacccttggcttgccaaggtctgaattttattatcatcgtctcctcctcctcatcatcatcagaagggtgcataccatgcaataggatattttgagagagaccacattcacgtaactgttattacagtacatcgttttaattgttctgtttttagttattgttgttaatctcttactgtgcctaatttataaattaaatatcatgggtatggatgaataggaaaaaacatagtatatacaggttgactatcccttatccaaaatgcttgggaccagaagtgttttggattttgattttttttttttttttttcagattttggaatatttgcatcatatgcttagccgtcgagcatcctgaattcaaaatctgcagtgttcttacgagcatttcgtttgagtatcattagtgctcaaaacgtttcagattttggagcatttcaggtttcagattttcagattagggatactcaacttgtataacatttaatactatctgcagttttcaggtattcactgtaggttttggaaaggtgtattcccagtgggtggataagggggactattgaataaacaagtaattaaagccatgtggttagtaatagataccctcttattatatgtaaaatactatattcagcattatatattaatttgtttcatttaatacaactttattattaattacttggcctcatcttacaaatgaagaaatggaaacattagaaggattgttttacctagagttataaattgttaagtttcagagtcaatatttgaaccctggtattctgactccatggccttaactgcttaatttatgatatagtattactgtggagatatgcataaattgcagtgagaatgaacaggaagacatctagggatgttattgttctatttttagttattgtggttaactaaaattttaagtctttgtagaggaggtgacatttgtgtagggtgctgaagggatgagtaagtttactattggagaagagtgagaaggcatttctagtagcaagtttgggtgtgagaaatcgtgtattctcggagctgtgtgcagttggttggagttcaaacaagagatgatattggaggggtactagatcatgaagattttgtgtttcatattaaggagtttgtacttaatcttgcaggtaaagtagctctttaaagtagttaagtagtagctaaatagctcttgaggaactgctaaagaatttctaaaaagtggatgacatcatatttgtattttagaaactcaagtctggtgatattgtcagcaatggattgaggaacacctgagcaagggaccagtcagatgattacagtagtcaaaatgaaaagtgactggggcctaaatgaaggtagaagagatagataggagacagagatagataatcgttttgagaaagacttaagatagaatggaaaagactgctgttggattgggagttaggattgaaggagagggcagaaccaagtaggtcttctagtgttctatttggagtagatgatggtattacatgtaggaatataggaaaagaagcttatttagatggaagaagagaccatgcttacacagttgtgggattgtgtgaaatctaaagtggagaactttggtagatggttgtgtacatgtatatacaggagaccttgggtgggagatttgctgtgttaccagcacatgtgattgtttaaaatttttatcaaagataatatttatctaataataaatattactaaatactggctaccatgttccaagcactagagatttagcagtgaacaaaacattaaataaaaaatgtcttcctcttgggagcttacagtttagtttgggttggaatgggttaaaataaatggtatgccatgtggtagtgttatggagaaaaaagcaggggaggaagagggagaattcagagggagaggattaatgtatgcagtattaaattggtcaggtggggactgtctctctgacatttagcaaaaacttgaaggaggtgaggggatgaaacatgtaggtaacgggggaatagcattccaggcataggaacaggaaatgcaaagacccgagtcacaatttgtgcttggcatgatcaaggaagtacaaggaggccagtgtgactagagccaaatacataaggctcaaaatagcagatgacaaggacagaagggtaatggaaggctggcttttgtagggtcttcttggccattgtaaggactttgacttttactctgaatgagatgggaaccctgggagggttttgagcagaagaatgactttggttttaacaggatttctctggctcctgtgtagattgagggggcggggggcagtatacaagcagggagaactttgggaaactcttgaaattattgaagtaagagacatggtgtttggatcatggtggtagtggtggaattggaattctgagtatgttttgaaggtagacccattgggatatgttgatgcattgtgaaagcagggagtccgagacgatgccagaacacagttggaagacggagttgccatctactgagatggggaaataggaagagcacatttggggaaaagatttaggagtttgattttggatgtgttaaacctgatgtgagaggggatatcaagtagatagtgggatatgtgtctctggagttcaaagaacaggtctgggctgaaattttcaattcaggactcaccagcaagtaggttgtttttttgaaaaatgagactagatgagatcaccaagggagaagagaagaactttgagtctaggttattccaacttttagagattggagaaactgagaaggaatggccagtgaagtaggaaaaaaaacatgaaggtgtagttccttagaagctaagtgaagaatgtgttgtaagaaggaaggatcagtttttaaattctgcaaataggccaagtaagaagagaactgaaaattgactgtccagcttagcaacaaggaagtaatcttgagaaactgtttccatgatggggacaggggagggtgaagagataattggagtggtttcaagaaagaatggaaggagaaattggttatagtagtaatatgtggccattgttttgaggttttttacagtaattaggagcagagaaagggagagttggatagagctgtgagggctaaagaagatacttttttttttttttttttttttgagatggagtctcgctctgtcaccaggctggagtgcagtggcccatctcggctcattgcaaccgccacgtcccgggttcaagggattctcctgcctcagcctcccgagtagctggtactacaggtgtgcgccaccactcccaactaatttttctatttttagtagggacagggtttcaccatgttggccaggatggtctcgatctcttgaccttgtgacccgcccaccttggcctcccaaagtgttaggattacaggggtgagccaccatgcccacacacccctctccccctttttaaaatatggaatgaataacagctgtttgtatgctgatggaatgctctggtagagggaaagctgatgatgcagaagataggaggggaactgctgggtgatgttctttggctagggagcaggaagatgttatctcatgcacaaacggaagccgtgggcttaggagctcaatctttagccatagtattggtgaaaggcaggatgtgtggcacaaaggtggaggcagacagatgtgggtgggaaaaattgcagaagttttcttttgattttgtccagtttagtgcagtaggaagcaaaagcattggctgaaagtgaaggtggagtaagcagtgttggaggcttgagcagaggagaaagggtgcagttgtctttcagaacgggagagtgaatggagtaggaagcatcaggacctgcttgaggtttgtgggtaggtgtataatgtgagactgggtagcatgattctctgtttttctccacccatattcacattaaggtaataacttcgattatgtgaagagttgaatttaacaggggttaggattttgttgtgaaattagaagagaaactagagagttaaaggtctatgcaaagggtggaattacagggaaaaagaccttagaatctaagctgcgtagagagaaaggagggtgtggggagagtggaaagctgatggaagcactggattatgggtcctccggatggaaaaggtaagatggccgaggacagaattctagattttgtcaatatttaatggtaaaagaattagcaaaggagatggataaagagaagtctgagtgtagagcaaaaaggcttaggaaaagggaaagataggtcacaatatccagaatcctgaaatttaaggagtcctgaaaatttgaaaaaaaataattgtggtaaaatatacataatgtaaaagttattttaaccagacttttttttttttttttttttgagacggagtcttactctgtcacccaggctggagtacagcggcgtcatcttggctcactgcaagctccgcctcccgggttctcgccattctttgtatttttagtagagacggggtttcaccttgctagccaggatggtctcgatcgtgatccgccggccttggcctcccaaagtgctgggattacaggcatgagccactgcgcccggcctaaccagaccatttttaagtgtacaattcagtggcattaaagacattcaccttgttgtgcaatcatcaccatcatctatttccagaactttttcatcttgcaaaactggaactctgtacccattaaacaactcccaaccccccacccctacccccacccctggtaagcatcattctgtcttctgcctttattaatttgtctactctaggtaccataagtagaattatacaatatttgtccttttgtgtctggctgtttcacttagcataatgtccccaaggttcatatgtattttagcctgtgtcagaattgccttccttgtattttttttttttttctttaaagacagagtcttgcactgttgcccaggctggagtgcagttgcgcgatcttggctcactgcaacctctgcctcccgggttcaagtgtttcttctgcctcagcctcccgagtagctgggactacaggcatgtgccatacacccagctaattattgtatttttagtagagacggggtttcaccacgttggccaggatggtctcaatctcttgacctcatgatctgcccaccttggcctcccagagtgctgggattacaggcgtgagccaccagcgcccaaccattgccttcctttttaaggctggagaatattccattgtacgtatgtaccacatttggtttatccattcatctgtcagtggatacttgggttgtaaatagtgctgctatgaacatgagtatgcaaatagatacccatatacaaagaactgctttcagttctgtggggtctataatcagcagtggaattgctagattatgtggtaattctgtttacttttttgaggaaccatcatactgttttccacagcagctgtgccattttgtattcccgccagcaatgggacaagggttctgatttttccacatcttcaccaacatctgttattttctggtgttttgcatttaaaaataataaccatcctaatgggtgtgaagtagtatctgattgtggtttgatttacattttcctaattattagtgatgttgagcatcttttcatgagcttattggccatctgtatatcttctttggagaatggaaagaaacttttccaacttttttttttttttttttttcgagacagagtctggctctgtcacccaggctggagtgcagtggcgcgatctgggctcattgcaagctctgcctcctgggttcaccccattctcctgcctcagcctctgagtagctgggactacaggtgcccgccaccaagctcctcagctaattttttgtatttttagtagagatggggtttcaccttgttagccaggatggtctcgatctcctgacctcgtgatccgcccacctcagcctcccagagtgctgggattacaggcgtgagccaccacgcccggccttttctaactcattttgcaataaagtcccacttgacctgaactgagttactgacaaaaacatgatctgagctgatgtgagactatttgtattccttacttatgccagttaatgtgaatattcatatgctttgctaaagaaattttagtgtgtctgattatggagtgctgctccaaatcctactagggctatacacatgcatgtactatacacatatatgtactaatacttttctaaaatcagaaaaattcagaattccaaaacacattctactccagtccaagggttttgggttaaaagtttgtggacttgtagcttcatttctttggaaaaccaagttcccgtttttaaaaacttacccataaactttgggaatttagggaggaattagttgagggctgtcgttacttccgtcacatctcaacccatgtcattcttttctgtctttatgcttcactcgctgttcctgcccggtgcttttgcctcttaacctgaggcttatctgaggcttattttttcatctgcagagtgggtatattgttttctactttgaaggatggattgtggggaccaaaggaggtaacgacataaggctcaggtcagagtctagcacaataggtgctccacgaacatgattttctctagtccttaaattcatgctctctctgttgtggagcatgtgaattcattctttcatacctctttcatcatgtaacttttaatccctaatgaatggaattacttactgtagtgtttctgtgggaaaatgttcaaatgccagaaagccatctcttctccccacattcccagcctcacactgataataaaggggtacctccctctctcctcaaaacattgcacccccttggggaatggagagggaagggcaagtgagagcgctccagtggacagatgggggaaggcagcagctctgtgtttacagaaattgttaaattatttacacaattttggtgtccctaccagatccagagttggggatactgcaagaatggccttttttatgttacaaactggaattagatgagtcatttaattgaagcttaagtttttgtagaagagtaatactcttttcatataaactggtggtaataaaagctttattatctagcagtaggcataaagttttcttttggtttagcccaattattagtgtatttaatccacccccttgctaccccctgttagttatcttagattaaaaggtcaattctagcctggaacatacgtcttcttttaaataatttggcatatttaaattaggaggacatgaagtggcagaatttgagttaaacatttaaatatattttgtgcccttgattatattagacacctgctgctttggaaagtcacatgtttagcgaaaacgtactttggttgaaatgttaaaataaaaagacctagcaaaggtaaccttgtagttcagatatgacagtttgattttggctaggactggaatgagtggtttctgtgtagccatttcttcctccctgtgtagagagccttgctgatttctaaatcttcgtaaaaggaaacacccttgctgtggaggcttgctcaggggagctgggagtggaggcgggctcacacatgagcgcatgtgcaggaacgtttcacggtgcaaaggttaaaggcgggtgtgggcagaggggaacctaccacaggtcccattctggacagacgtgcgcagttgtggtgatgtgcaaacagctgtactggaactggatatccactttcacatcgggcatccgcctagaagagcagcgggcagctgatgggaagaccctcaaacaacagacagtgccgcagcaggtgcatgacttcagcttttgggctttctatctgatccttgcctcaggaagttagatctggtttctggtatttagttattttgaaagtttcctatactgttgttattactttgagttgtgaagatagatgaaaagatagtactttatgagttagagtagttgattctagaatgtagtttaaaaacagcctttaaaaaatctttttacaaagttctgtttgggttttgagaaatgaaagaaatcttattttaaccctgtattatgtattcttcattgtttttggttttgtatttggaggagccccagtacttggtggtgttataacacaattcatcccacaaacagatctttgtcttttgttttgaggtgtctaaggaagagcttgaggtttcatttggctacattccagtatgaaacctgagataagtcccttggccttttataaaagagaatggttagaaagaccagaaggtctctaatgagttatggtgaagaggcttctttaaacggatttatataaaaccaatgaataaaaatttcttttagttttgttataaaatatgtatgtgtgtctgcatgctccaacaagggatttttactagtctcttagtggtctttaaagcataaaattgaaggataatttcagttatccttttggggaagagttattaatgcttgtttttggttaggctaaactcttttgtctttttcttgtcagttagtatttgtagagcatccatgatatatctgcactcacacacatggacatgagtgtgtatatgcatctgttgctagactgggtgcagagcaagtcatgttgcccttgagttaacatgttaagacccttaacagcctttattttcttgagctacgtacttatgtttgaatttctgatctggaaagtcagggaagtcataaaggctttaaaaattattctctgtttagataatgtagttcagactattgcagggatgaggggtatagagattgttttcattgtaaagagaaggcagaaaaaagagaaggtctgtatataacagagtgtctttctttggttaaatctatgcagagctactaatgaagggaattttaggcatagtatgaaatgaagactctcttgatacttgttttgtcagattctttttgtatttctcttaaatatctactttcccaaactaaaaaatcatcctttgtgtgcttacatattcagtagggcatctccattgttgtcagcggaggcagtgtggtaggacttcagcaaatatgcagtgtccccctccctcacttgtaaattattctttatcttatatcaccaagtatcagcagtttctctttaatattaagtcattaagagtgagtttaattgaggaaaatatttttactgttattaaatgtagaaatgcagcaacacccaatgcatttggttctaagagatttattagcatttttatttttcatctgggtgctctgtttaaggaataatataacttatttcaaaatatgttagcttgttctggcttttgtttttgttttactcctttggagtcctgagaagacaacatttagattcagaactttctttgttatctcagtgtgtctaatttagctaacttttgaatgtatttcttgactgcacagaaagttggagtgactggtccccctgatccacaagtccgctgtccctctgtcattgagtttgggaagtatgaaattcacacctggtactcctccccatatcctcaagaatactcaaggtatgttttgagagacccttgaccttctgttttgagatccatagaagtctggaactggaagggatcttgaagatgtttgagtccaccttatcctttacatttgaggaaactgggggcttttaaatgtccataatagcagcggctttggcagccacttcatcccagtttgctttagatgttctcttctgtaacctctcagacgctgatgtttaaaatgagaaacccgaatgcatggtcacaataaaaggggaatgcttttttattttttttttaagagaaatttgtcttcactcctatcactaagaattttgaaaaagagaagaactcatatataaattaatataaagtttcagttgattagtctttgatgtaaataaatatttataatttgacaaacttaataaatggtttgttttcccagaaataattggacaattggtgtaaaaattatatataaatagtttgggcttccagatatattaataaacattgatcactcaccagcttggtggagctaaagtggtttcatgactcagctctgaaattggtaagttgtgtaaccttaaaagctgcccaactgctctgtgcctcagtttcctcatctgtaaagcagagatagtaatagtacttacttcgtggggatattgaggacattaaatgagctacaacatgtaaatcacttagaaaatggtaagtgctcaataatgtcagttattatattttttctttatggttaaaattaaaagatgaaatgagatcaaaaaattaaatactagttaattgtagtgacattaatgctctctaatctataaactacttatgcctcagtttcccatttagtagggtgttacaagaaataatacatcatggtgctttgtgggttaaatacatgttcagaatattctcatcatgtaagttttcacccatgtagtaacattgcctggccaaaatattagcaaaatttatttagtaccttacaatatgttgagtgccttaacatgggttgttgccaagaaactaggaataggccagtatagttgttaaaagggccatccagtaaaacttatttatctttttactttttctttccatataataacttgcttctctagtctacagtcgaagtagaaaaataggggtaagaatgccatttcagacactgacctcaaagtgacagctaacaaaaacagaagaaaaagcaaaaccccaggaaactaacacacaagctcatgaaacacagcaattgagggccatttactgtgggatcagttagccccaaacactgtggtgtatctttaaggaagcacactgtttcatgagctgacaacaattaatgtgactttaagataaggttacattgtatttgcatttccatattatacatatatattatacatgtatgtattgtatatgtatatatgttaaaggaaggcaggaacttcctcaactacctacagaactcagcgttcaagttaactcattcctcaggaattctgaatagccaagatcttttatgaccgagaagaaatacgccaaggacacgcctgtaatcccagcactttgggaggccgagataggcagatcgcctgaggtcaggagttcaagaccagcctggccaacatggcgaaaccctgtctctactaaaaatataaaaattagccaggcgtggtggtgggtgcctgtaatcccagctactcaggaggctgaggtaggagaatcgcttgaacctgggaggcggaggttgcagtgaactgagatcgcgccattgcactctcgcctgggcaacaggagcgaaactccatctcaaaagaaaagaaaataaatatgccaaggaattaattttttcatcaggtttaaaataagttgttatgatcattttttaagtgagctctttgcaagctgcccaaatcacaagagcactcaacttagaaaagaaagcttttccacatgtctgtcaactgttccggagactatagtacagatagatggaaaccacaggccccttgtctactcaaggtggggagaggaaatagattcaggaatggaaatagagggctagcatttacttttgttcaagagaatgatgagaatggaatcataaactgttttcttttaagatagatatttaaaggatttattgaaaatgtagcttttgttctgatgagattttcattagaaacaggtgtgaggagactagttatcagtgaaagaataaataatgccatcaaaaaataaccaaaaaaagtataataggaaccagtagaaagcagaaacaggataggaacttgtaaaattcatcaacttccttaagcagttttagacattttctgtatattttttcatccattggatagggttctttgagttttcaattagaaaatatcctgtaatttttaataggttcttgagtaattatgactttttttctatctttatattcgtagttctcttggttacattttttaaaaaaattatatttacttaaatgagcttgaaacttgaggtgactaaaatgtttggagatcttacattttccaaataataaacctctattcttaattttgttaatgcctatttattatttcgtgctaaactgcttataaattattttcttattaaaggtttcaaacactgtaacgtacaaaaacagggcaataggagcaaacaaaaatgcaaagatcacaagaaaaacgtcttttgggaagtgggattatactttacggaatgttctttcatatccagatatttgtgtatgcattgcctattaagtaatcttgtatccctgtctttaaaaatcaaaaacaatgaagcaataatactgtttcatttggtttatcagtaggttcattgcgaaacctactctgccattaagagcatgacatagatgggcttaaggcaaaagaaattatgatcattggatgccctctgctcctgtgctgctttgagcttagctttgagatcctaaagaggtagattcctaggtgatagagtagcctaggaagattcctctgccttttgattctcctctggactttatttgatgcttagattatgagattgtcactagaaccagtttgattattctcgtcatcccagttactgaagaagaaaccaaatagaatccctaatgcctttggctattaaattattgagtaaaattgatggaagaagaatacaaataataatcgttaagtaatagcagctgtaattaccatccattgagcttggtactggactaagcatctctggtgtaattctgtgagatgaatattactgtattcattttgcagacctggtcccagacagtacagtgtataagtggcagaacttgaagctcacttctctcttactgcatagccataaccattaatcactgggcctacgctgctccatgtagcatgtgtatctaggttgatctcacttgacttgtaccataatcttagatttaagtaatatttggtataatttttattgttacattaaaaatttgctacaagttgactgcacaaactgctactatgttgggccatgttcagaagccagaaggtactgtagaaattcctgagaataataattgcatcattctagaagttagagaagcatgcccagctgcagcacagccctgattccatgggctgggttatcagcattgtggcagactttagaatcaacttccagtgtggaggtgacacttcatgtgcagttgatcaaagccaccgtacagctacctgtttgatagctgagacctaggtcctgccaggaagatcactaaaagcagcccccaacaagattctctagggctaggagtattcataatctttataactacatttcatttcctgtagtctcatgttctttctatatgatagatcttttttttctgtgagagaacagcagttgtttataatatttctagaaatattttggttttccagtagttttttttctagatgattccctttagattagcagtatcatcccagtgggcttggttctaataaagtaaggagcttttaaaatgttttcagtgagaactagattggaataaagtagatcataatgcttgttttcagtttactatttttcacataataaggttcactaaagttttgtttttttttttttaatcatcaataaaatgccatacatcttgccattctaaggaagtggcatgaactcttcatttactggagaagacttgatagtaattttctcagagattttatttctcctgatgttttcttgagcaatttggttactgtaagagctttaaacatttttggccttctctcacagatcttaggaaataaattgtagtttattttcctcccttcctccctcccttcctctctcccctctcccttctgtttccagaaaagtaattagcatttattgaatattttcgattttttaattgacagataaaattgtatatatttatcatgtacaacatgatgttttgaaatatacacattatgaaatatgactaaatctagctaacataaatggtactttattttcatgtctctgtgctgagacctaacagttggattggatgcccttaaagttggcatttatctttaccataatttggaaagcttcatggtctgtcactgttttttactctatcatttttacaaaaatactttaaaaagcacaaaattttttaggtttctctgattcgtattataggaagtatttagttgtaatatttagccctcaaaatgaaactgtactcagatagtgttacttctgtatcttcatgctgtgacaagttaagattgctcactgagaatttagcacatgtaagaggtaagtaaaacagttagggagggaggtgccacccgttgtatctacataaggagactcattcttcctcttcctttgaagaagaaattactcagaatccaggtattcaggaaggtggtctggcagttgtaggtcacctgtaaggcttagttaatacatttagtgctcatattagatgatgaagtttataacaagccatttcattctgtgatttgtagctgtggtggtgaagaaggaaaaacctctttatctagtggttcctcttgaatagtggggcttgaggcagaatgcagtggaaacaaagtagccaacaacacactgctttccatgctcttagctcctgcttcttgactctaatttatagtgccagtcattatttgtttcacttagtgcttgattttggaagggttgtactaataatataattacaagttgtattggtgtggctaacatgagagattttgaaaaacaatattgtataccatagatgtttagtaatagtatactacaaaagttccttggaaactttcagtgtgctgaattgaatgacagtttaaaaaataagatgtgaggttatatgggaagaattaatgcacattgtgagtcccccaggaaagttgggaaaaagcatgtgccctcttgcccttatttgagcacgaaatccttagtacctgcaggatttgtgttccataaatataccttgggaaaagctttagtagaattttagatgttctcagataaattatatttcaaaagctgctttcaaaatgggaacttgaaaaaatggttatggtcttcacacaaatcaaacatttttgtgtgtgttaatctacttagcaaatattattttctttaattctaggatagtattttaagcataactatccaaattgatagcaactaaattaattttttcatctcagtacttaaatatgagacaagatacagtaatttatttgaattatatattttgtcattttaccgtccagtatttttgcatatgcagttttttttttaacctgttacctgggtagtaatgagaggcaaaaagatgataattgtggaagtttgaagtactctaaaatataaagccctgtcttttttgtttaattatcgtttacaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggtaaggtagatacttagtaattgtcctctcatccatttcataagtagggccacctatattgcatctattgtgcaactttctattgtctattttatgtatcactaaaatggaaaaagtactaattataatttttaaaacttcatttgattataaaatgccagttgattttgcatatattaagatgtgataaaagtacatcttagaatctatgaaatatggcatttaaatgaaaggatttctatcacttatttaaaaggaatatctcacagagatctgtttaatagtaaatcttgatgatgatgatgatgatgatgatgatgtgtgacctctgctctgtgattctctattgctgttagtagcgctcttgatcctcagttctgtggttttcgtgccaagtattaattgagtacttgcttatgtgccgtttacttactgtaacagtaaaatttcagattgtcaggatcccctcagtctctcacttttcttggtcctccctaagactcttttaagtgatcagtagaggagttctttaccttgggagaagctggggtaggtgtggtatatactgtttgaagagaatattaaactacctgggttgttgaggagttctgttagtatcgcagacagtgtcttgggagctaatgtgggcatccattggcgttttgatagaaagctctggcaactccatgaacacagacaaggctgccaggagcaaaagagcagcagagtgctcctgggcctggccaacctggagcctcatttaccacatgattgcttgaggaacccgcttggtgcttctgcgtggcaatagttagtacccccttaagtagttttatctgggttcaagcccgatcatggtagtcagattgcattgcttcaggcagctggcatagattagactacatagttacatcttcttttacctaataaatgtattttagaagggttgtatttagatcttttgttgtgttaagtactttgaaaacgaaacttgctatctaaaggattgctacaattcatctttttattaaagcaaaaattgctcttttaaaaccagattatcacttccttatctggctgttcctgctatgttgaaggtatgaggttttatatatttggttgtcttaaaacagcagatagcataatactgccatttcaaaggatggcttccaggttccaaagtgttctggtcatggacaccttctcctagtctggactgtggatatctagagatgcttttaactgatacatattattctagaactaaagagaccctctactgactgttttgttctgtttatttctctaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggtaagtatgtcagcttaaagtttgtttgaactcatatagaaatctgaaagaatctttgctggttctcactcggggacacaacaagatgcagcacctcctaggtgtcatctagctgtttggaaagaatagaaggaacatttggaaacttaccaggtgctagaaggtgcttagtaacattcaacaacctatattctcctaggattatggactgctggcaatactcacggggaaggttttaaatggcttctcttcccatggtaataacatggaacttctgaaataaacagtcattagctctctgagttctgtctcagcttcaatcttctcttccttatttgaactttaggcatagaaataagagtaagaaggcattttggttaaaggatattttctccttttttaatcttccattcccttagagggagaaagtttatttctagtcagagaacataaaagatatacttttatttaagcaagcctgtggtaaaatccaagtgtataaaacagttaggggaagtactagctttttataagcatttataagaattctttaggctacttcattagttagatgtgacttaaaatatattcactcatttataaaattataaaagtgactattttgtgtaaagttagatacaactaataggactgctctgaggagcaccagagcaggagagaaagaaaactctgacataattaatgagtcttctcacttctagagtggcacactgattcatcatttgtagctttacggattgtttgggactcagattccggtgctgatccttaggcattggcgtactgtgtttgagttgcagatggtgttggatggcattgttttgttatatatttttactctcctgggatggttgctttgtgggtaatggcagtgacttgacattatcctatcttctcccagctgggtagttgtttgttgatgtacgttgctattcccaaaggaccagggctgtgggttttggccattagtctttgtttcttaattcacgttattattcacttttaccagcctgttttcaaacttgacttgtgttttctccaccaggaaaagcactgccaacagaagtacaatgtttcctgtataatgattcttcctcaataccagcgtaagggctatggcaggtttctcatcgatttcagtaaggattatattaatttctcattggtcttttccagtggaccttctctgtgtgtgtgtgtgtgtgtgtgtgtgtgtgtgtgtgtgtgtgtgtgtgtgtgtatatatatatttaaagatttgtaggtgctttgttggctgctagtatcttttgtcatatagctatatgattctttaaaacctaaagccactgctggacactgtggctcatacctctaatcccagcactttgggaaactggggtgggaggattgcttgagcccagtagttcaagaccagcttaggcaacatggcaagaccctgtctctacaaaaaatttaaaaagttaggtgggcatgatggcatgtacctagggttccacctactcaggaagcagaggtgagaggatcacttgagtgcccaggaggttgaagctgcagtgagcaatgctacccctgcattgcaggccctagcctgggccacagagcaagactctgtctcaaaataaaaatggaaataaataaaacctaaagccacacgttccttttattttggttggacacgaatttttttttttttttttgagagacagagtctcgctctgtcacccaggctggagtgcagtggcgtgatctcggctcactgcaagctctgcctcctgggttcaggctattcttctgcctcagcctcccgagtagctgggactacaggcaccagccaccacaacccggctaatttttttgtatttttactagagatggggttttaccgtgttagccaggatggtctcgatctcctgacctcgtgatccacccgccttggcctcccaaagtactgggattacaggcgtgagccaccatgcgtggccttggacacaaaatatttttaaacagctaatattgaataaaattttgtgtgatgtgtagcacatacctttaatttcctattgttcatttacaatggaactcagtttcatgcagtaatactaataatactaaaaacattgtataactacttcaattagagctaataaggaagtactgtgggccgggtgtggtggctcactcctgtaatcccaacactttgggaggccaaagtgggcagatcatgaggtcgggagtttgagaccagcctgcccaacatggtgaaacctcgtctctactaaaaatacaaaaaattagctgggtgtggtggtgggcgcctgtaatcccagctacttgggaggctgaggcagaagaattgcttgaacccgggaggtggaggtttcagtgagccaagatcacgccactgcactctagcctgggtgacgagcaaaactccatctcaaaaaaaaaaaaaaaagtactatacctgccgtatttttgttatccagttatctgagaaaatgtgtgcattttttttagttaggctctacctagtggttaaacatctgcaacacatctttaaatatctgaagaagtgaatgatagagaaaattgtttaatctgagttcaaaagtgatagctcacagttctaaagagatcattgtgggatctgtgtaatttgagggaatattttacctcagatattgctatacaatgatatttagatgaatatatgcagaactaatggttcaaacaaaggattttgattctagtcttgagatgttaattaagccttctcttagctttagactgtccttctgtccatattttattggaagcttgtgctactggttgttttacacattttctggtctttttagatgagcagtaggggatggaactcagattacttcctttaatgttaatatattgttttgaaataggactcatgattagacatgttatatatgccattaaattgcaaagttagggaaaatattttacttttggtgattgggggtgtgtgtgtatggtatacaaacagtccgtgcaataacagtattgtttgtatttacttttcctaatgtaatacgtttccaaattaacattcttagactgcttttatgttttctttaatgacagtaaaaatacctttctctgccatctccattttcgttgcttttccttagaagttaggcctttgtttttcagttcttgagagttgtgcactatagaggacagagtccacagttccacacttatattggcagtcctgcttgcctagagttagaatgataggtaattgtgaggagttttggttgaagtgaaagattgtcatctaattcactgacagaactacaattttaataggattatgtgaaaatgaaggcattcttttgtacttctcagttcagatacagcagttgccatctagtggtccaaataaagcatgcaaggcttgttttccccaggacgttgaacgaaactgttaacagtcctgatttttaacacttcgaatattttaacaaggtgattgatattaactgtagacataataatactaacttagtcttcaatatatataaattatgtattctttctgcagatttgttttgaagtagttttgcaatttgtttctctctttttttttttggaaggaatttacctttggagttattcttggttgtagaagaggggattgttattttggtgaatccagtttttcagagttgctgacctagttctgatttgagttatttgtgattctttaggttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccagtgagtatcacatctttttgtatacctttgaaagataattaggttgaagttttttggatcagccagtcagattattgatgaaagggcattaactaatataaatgatatacttggtgataatgagatatcattttcctttctaggatattttatttgattgactatatatatggtctatatatagtctatatatatgctttttaaactgaattgtttttctgatacccctaatttttggacctaagctactgaatctttcatcttctagtattgggagctctttcacaatacaagaagtaaccactctagaaacagtcattaaataaaatgcccatgttaaattttcatataaatggcacaaagtaaatatagattgaaaggaagaacagacagttcacccttcactaaagtggtcagaaaaaggtcacaaagaaaggaggcatttgagccaaataaatggagaataggaaagagagtgcagaagagcagcagaacttctggagcgggacgtgtgagacagcaggcagtgaaaacagcccgcggccacggtagagagcgaagcatttgtcctgcttcacactcctggccgtctcatgtggtggcacatttctgcattccatcgtcccaggcaggctatctttgcagcacctatcatcttacatgcttcaccaggggtctcatctccacattcatttttatgtacaccttgtacattgttgattgctataaacttttctctggttccagatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtaagggcatgaatagtctctatttttgatgacagaagatatatttttgatttcatgagtatttataataatgtattatgatcatctttcacagaaaagtaaattcacattagaatgtcaagagttttatttcagtggtagagatttcaagaagactggacctggtttacttaagtatttttaagccttggacaattaggaggagaccatcaaatttcttataatgtgttacttgtgagaaaaatatttgttaccagggtgccaagaagcagctcagttttaagctggatagtagttgagaaatctgaattgaatccaaatctgacagtttttaaaaatgaaatggaggttgggtgtggtgtttcatgcctgtaatctcagcgctttaggaggcccaggcgggaggattgcttgagactaggagttcaggacaaccagggaaatatagtgagaccccatctctacaaaaaaaacccaacaacaaaatgaaatggagatacattttccttaaatagaatattaagtaactattgtaaacttgtgtatgttttctgatggggcaccaaaacatcctgtggacacacagatctctttagccgttaaagggttgctggtgaactgtagtgcatgtgtcattgtcagtatttttcttcatgtgatgcatacttttatagctcttttttttaagcagtgcttcatcctttcaacaccggtatcctcctttaataaacataaaaaatcccatgcctctctttagtgcagtttaatttttcaaaatgaaattattcagaataaaagtaaatttaaaaactacataaactttctttcatatttctcaaatgcctccttcctcttgcccatgtctcaagatcctgtctcctccaccctgtttacaaatttttatttctgagaaattttattaaacaatctcatttaacatttaaaagaacaatagtattcactttgcttattgagggtggtactgcagaaagattcagaacataggctctggagtcagactgccaggctttctatcccagcatcttctcttgctcttgcgtgacctggggcagattacttaaatttttttctaccccacatgcctcatttgtaaagtggagttgtagtggtaatacttcatatgattgttggggagattaaataaataatgcatatacagaatttaaagcagtgctgaaacaggaaatatccatgttaaataactgatcattttctttttaaagctcagtttccttttcttctctcaatacttaaaaggtcagaataggtaaatgtaagcaaacaagactgaaaaattaaccagcattgttttattttctaaaatcaggtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaaggtaacgcatttctttccaggtcttctcttcctccaattccagtttatcttacaccttctcgttttagcttacagttctgaaagagtataagttagaaattcctagtgcattgctttataaaccttaagcctctgtatattgtagctcaagatcttcccagtgaacatttgagatgtgtgtgtgtgtttgacttctttgattcatgggaattcacttagaaatcataagcttatttaagggcttcacctcctgggatgcaaacaaacttttttttagcttactggtttgatgttcaaatcatgacttttaggggcttaaagccctaaaatatctttaaaagatatttttaaagtatgtacagattagaagtgtttatattagaaaaggaggccaaaatattacataattaattggaaagtgaacatagtgctgccctatattttggggtactcagagtccagtagctcatcttgggtgctattgttttctctctactctccccacttctcacacatccctccagtggtttaacgtggtctctcttgctttaaaaatattttctaaactatattccatcataatgatagccaattagttattaaataatgtacaatgatgataatgaattctgttaagccgtttaccagaaacatcccaggctatggagtggattttaagcattgccaggaggcagccagactgaagcgaggctgctccctggaagagccactcagccagcttccagccaaagcagcacaatcgttcctttccttacagggtcttaaaaagcaagacaggatcttttgttttgttttgttttgttttaagaataatatcttcagagcagttttacatttacagaattaatgcaaagaaagtacagagagttctcgcataccccagccagtttcctctattattaatcccttgcgttggtgtggtacatctatcacagttactgaaccagtgtagatacatcagtaactagagttcatactttattcagatttccatagttttccctaacgtcctttttctgttccaggatcccacccagcatatcgcattacatttagtagtcatgtgtctttaggttcctcttggctgtggtagtttctcagaatttccttagtttcgatggccttcatagttttgagaatgactggtcaggtattttgtagatgatccctcatgatattagaatggggtaatatattcttgagaggaagaccatagaggtaaagtgccattctcatcacataattaaagggtacctgttggcatatatctatcagtatgtatagggaagctgggcatagtggtcactcttgtaatcctagctacttgggaggctgaggcgggaggatcacttgagctggaggctgtagtgcacaatgattgtacctgtaaatagccactgtagtccaacctgcgtgacatagcaagactccgtctgtaaaaataaaaagaagcaagtatcaaatataagggtattatcaatttgatttttccctattgaagttaactttgatgacctggcttaagatattgtttgtcaggtttctacttttcttttccctttactggaaggaagtcactgtgcatagccacacttaagatttctaccccctcagagtggaggctcagcataaattatttgaatttctgcttgggagatttgtcctttctccctcatctgtttatttatccaagcatttatttatatcattattggcccagatatttacgtgatacttcactttataatccaatactactgctttttaaaatttgttgctcagattgttccagttttgaccattagaagctccttcttttagtttccctcttgggctgctgctgctttttttttttttttttttttttccttccccagatggggtcttactctgtcacctaggctggagtgcagcggcatgatctcagctcactgcaacctccacctcctgggatgcaagcaacgctcccacctcagcctcttgaataacttggactacaggcatgttccatcacgcctggctaattttttgtacttttgatagagacagggtttcgctatgttgctcaggctggtcttgaactcctgagcttgggcggtccacctgccttggcctccaaggtgctgggattacaggtgtgagccaccgcgcctggcctcctgtgtttaacatatatactgttgttgtcattgtggggtctttttgtttgtttttaagcatttcctttctggcactacaagatgcttcaagttcatcttgtatatttcatgcccttgtcctagaatcagccttttctccaaggaccagggccatttttaatctaatttgaaaattacattctcgattgggactattaagtttgaagtagagaaaaattgaacattgactaactgctgttcattgcatgatcatgaagaatagatctttgtcatcctagcacttgtattgccaatttatgaagtaaaacaaatcatgttaaaaaaagaaaaagaacaggcagtaagctcacatgcaaagtaattttgaagttaatgaataaatgctttgactggatgtgtgaacttaagcaagtcctataccctctctgacatctatagaatgaagggattggattagataatctctggggcatcatctcttattttgtgatattagttgtataattttagctatttggtcagtccagtgcaaagttgtgctcagtgtgcccaaatttcagtaacagatttattttacttttgaaatatttcactaacactgagtaaatacatttcagccccatatttctacattccacagctttttatgagtagttcatgaaaatggcatacaactttactgatagttctgcaaaccttcacagtagtgctataagacaaagtgtttttatttctcttttgctcttaagttggaaaagttaagggattagcctctgggtcagttcagtattaaaacagggcaactctctagggtgctaaatttaactgaactattaagagaattataatgtctgctatttggagatggctgcctattcttttacaaagttgtgttcaattgcctaatacctttgtatttataataagtgtattatcttactatagtattttgaaataatattcaaaatattttttggcaaacaacatcctcattttatatgtgctaattctatttggttttaaaactgttttcgtattattaatagaaaagatagtgttcataactgtaaatacttgctttctctattaaacagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatggtatgttttacagaactcacttactgtggtttattgtcttcagatatatagcagtagcagtgacagacccttcagtaaaaaggctgaaaaatgaacacaacccactaagcaagaaaaggaacgtttggcaatctctaaaaagttgtatcaagtatatccatcttgatttttaaatgtgttttcccttcaactcagaacctctattaatttgcctctgcagaaaatatcttactattaggcaactgttcttttttgcccaatcctttctaagcctttatcagaatctttagttaatgggagagttggacttagcatcaggaagatgtaataacccttcactagaatgtgcattctctagacttagtctgttttgctcattgctgtatgctgagtgcttaagcccggcgctcagtaagtagtgttaaatgagtgaatgctaagaagacaattctccagaaagagcagattcatgtaaattggaacttgtgtcacatctgttcaggagtctttcctgaattgtatctctaatgtgtcttacccaactagtagtaaatttctcacaaatggtaacaataactcaaaataaattttatagtatagatacaaatccaactatttacttttaaagcagcctagttgtcatttcttctctagagacactgaaactaggtctcatatatatgagccaggtcagaaacaagtctttttcaccctagcctaaagttttgccagtgtctcatgctgcctgcatctgcagtgtgtttatctcgcatgggctcagaatgagcatttttactttgttgggcaaatttgaagaaatctacttgtccagtcttggtacataaacctttagcttttatgcattaactggttgaactttttaattcttttaaaaattcagtcagtttcaagtctagaagataaacttacattttctccattctcatattttctatataacaaatacttttttattttttattttttatttttttgagatggagtctccctctgtcacccaggtgggagtgcagtggcacagtctcagctcactgcaacctccacctccgggttcaagcgattctcgtgcctcagcatcccaagtagttgggattataggtgcacgccaccatgtctggctaatttttgtatttttagtagagacggggtttcaccatgttggccaggctggtctcaaactcctgacctcaagtgatccacccgccttggactcccaaagtgctgggattacaggtgtgagccaccctgcctggccaacaaatacttttaatatagtgataagatgaatgtgttctttgctctatcatgaatgattctacagagtttaacttgctatgttttgaaataacataactaggaaactaaaaatttattttgtaaatttagcactttatattctgtcttagatcattgtacactaaaatagtacccctgattaagttcccatggacttagatttttgctgatgcagccatttcctttgttgactttcaagttactactactaactgtgcctttttagccgtgcccccactgcatcatgttcttgtcttggtattcttattctttaaaaattaataggcaatgtgagtgtacttaatgccactgaacttaacacttataaatggttaaaattttaagttttatgttacgtatagtttaccatagtttttttaaaatgctaataatataaaatttatttctaatgaatgtaattggtgctttaattttttcttgtttgtctaagtctaaatgtcagtttttgtctaggactaaataaatgctttgcagctattcccatacaaacacaacattaattgaacaactgttcacatacgatggctcagtcatggcctagagtaattggctcatcatactacctgaagtgatgatttgtggaaagtaagaaaatccgagagataaagtaaatcacaagcagaaaaaaaaagaggaaataagctaatttgtaacttttagtagagacaacttgataaaagtactgcttactacttatttgcctctttataaagttcatctccattttacagatgatgaaactgaaatgtagagtaacttcccacagacatgcagctgatgatggtagtcttgaattggttctgactagtgtctgataacataatgttgaccaggattctttcatagttctgccaattcactgtgtgacttagaatatgtcactaattagttttatcctctaggttcttaactttaaaatgaagacaatcaggagtttataaaagtaatgattaataaagtcatttctattgtatatgctagtcttggaagaaggaactagaaaatgtaagaccttgtaacctgtctttgttttttttccttcctgtatagacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaacaccattctctttttttttgtgcaaccagattgcccattctcttcctattacttgctccagggataggtaaaaaaaaaaaaaaaaaaaaaaaaatatacatatatatatatatatccacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttggatgtctgtcttgcatgtggaatttttctcccttcccagtatgtcagaactcttcaattcttgttctacacccagagacctataaacattagtcttttcattttcctctttattataggagtacaagtccatggcctttgctttgaaattccagttttcatttatgtctgtgtttaaatgccaacaatatggatgggttttccatttccaaggaacatggcacggtaaccctactttggattttgtaggggcattcatataaaaacctcctaaagggattttaattcccgtcccccccactcccctaaaaaaaagcaattgcaataacaagtagctcctagacttgtgataaatgggaggagtaatttttatagatcttattttataatgtaacagtatttttaaaagcgttgtgggttttttttcatttcattttacctaattgggtaatctaggaagattcgtcattctccttttgccagaattcaaggccctgaatgctgattactttttggtggtctcttgggttgtgtttgcctctcatcatttagaattgtggacaggaggcagagtccagaaaatttgatttcactttgggaaattggccttagtttctggtggtaggcagtgaggcaggttcaagttttagcggcctccacacttcctctgccccttcacactgaggaattgaggaactgtacatgatactacctatagcagacatttgttctgaatttcatgctgtttaaagtttagacagtatagtcatgtcatctcaaaaggaatgatgtatgtccgttgatttcttggctggcttatataaccattatttggacacaggctgtgtcactgtgctatgcaattactagtggattgtcttgaaaacattcttgcctttgccactgaagagtatttgctttaagtgatttcaacataaaccaattatgttttttcaatataagagataatgtggccaaagactattctagactttcaaaaaacatacataaatatatttatattgcatttaagtataatttgaattatataatcccatgtatagccaaggaacaaatgagttgttcggagtaggggaggtgctcctatttctttgttgtctctccacctcctgctgacagtagattggggaggatgacacactcaatgtgtgtgatactgagaaccctagtccaccaacctgtcgtcgaactttcagaaactagagcaccaggaatcacattcttttaaagcctttctgggcactttaggtggtgcctggcttcctttgtagcatggtgacacctgtatgaactccctaaacaccagtcttggcagcctcacagttccagctctttaggtgaaaattattatttcagattatccaaatcacagctcaggcagtgtggtgattttcgtcatattccttcctctagtcttttcataatgtacaagatgtgggtcaatggtgatggtaattgaaaggaatagtgaaagaaacaaaaaatgctatctttggcagaacagagtatgcaggatccttatgatgagtggtgggggaaaggagctctacttattgatgtgatattcaagaaacctaaaaattcaaatgaatgattcctgtaaactcaaaatatcatttagagtaacatttttagtgttgacaagtgtctggaattctttttttttttttttttttttgagatggagtctcgctcttgtcgcccaggctggagtgcagtggcacgatcttggctcactgcaagctccgcctctcggatttatgccattctgcctcagcctcccgagtagctgggactacaggcgcccgccgccaggcccggctaattttttgtgtttttagtagaggcgggatttcaccatgttagccaggatggtctcaatctcctgaccttgtaattgcctgcctcggcctcccaaagtgctaggattacaggcatgagccaccatgcctggccatgtctggaattcttgagcatggtcatccaagtaaaagcctacagtccccagaacaaaacccaacccatttttgttaaaaagtttctgttagtgggcaggatgggtttgttaggtaaattggtgtggttacgtaacacaacttagacccatagattttctttccagagtgacagctacagattgggcttcatggagatttttagctatgttagtaaggagcctacatactggtataccaattgcataaggcctcaaaaaggtggcagctgtcatttttgcctaaaataaggaaagcctgggatatgatggactttggtttttgaggtcttttaaggccctggacagagatagtcatagggaatgttttcctgtggctattatgaacaaattttgtgagtgtgaaatacacattcttgttatttcaaggaaaaaatgttctaacatttaactttttactaaatagacatttctgaaagtcacatttaagccatttcaaaaaagaagtagtgaatgtgttctctgggatggtgagttcatttttaactgttcttaatttatacatgcacaaagatgagccagcaaggtaaacatgatgaactgaggtcagctgttgcctgtgcttcaagtgcacaccaacatttcactttagagctggtgcatttaattggaatttctattaatatgcattgaaaaatggacatctgcttaatgttggaagacatgagccattcaaatcatctctcattaaaattggccttaaagagctttttgagccccagaatcttaatattttaaaagttttatataaaacctttaaattggtattctaagtgtaaagtctgttgtgaacaaagtaaaaacattcatacacaatttccttgctaggactgaggctctgtcccatgtacaagcaagtttcactggtttaattgatttgttacatttagtaaaattgcttgatttaatttttttctttttttctttttttttttcttgagctagtctgactctgtcacctaggctggagtgcagtggcactatcacagctcactgcagccttgacctcgtgggctcaagtgatcctcccacctcagcctttccaaatgctatagttttctttgtaaatgaaggttaataaagcagttgtagtcaattacatcaaaatgattgaatttgatcatagttttccaaagaaaatgaaaacattgacaaagagacagtgattaaggctttactaataaaggcaaggacttcttgcaaatgggataattacatgatttcaaagaagtttgtcttacctcctgtttagagaaaacagctaaaattaactagaactaacctgacattctcaaaggatgattgaaagctgtaaatctgaaagctgaataatatgtattattgcaagaacaactttaaaaggtcagggaagtagttcaattaaaagaacagaggaatacaaagcaaagcagactcaagccagctactgccactcacctttgctgagtctcagcacagggatctcaggttgcagtgctgctgctatcaggcaactccccgctccgtggggtctgccttgctgccagcggactgccatctaaactgctttcctctgcagcctcaggtgtcacacgaagacatgaaaatgcccatgcaataagatggacttggttcccttacatcttttttaaaccccttgttattgtgaaaataaagcacatacagaaaagtcaataaaacacatatagctgaatgcatttgtctaaagtgaatacctctctaaaaataaatcaggctgcaaaatagaactgcagctcagtagtccctccactgtggcttggagggcccttcctaagcacagtctaccctcccaagcggaaatgatcaccatccaggcttaggcggtaaatctttttcttgtatcttactacctaggtgtgcattcttaagcatcatagcttcactctatcttgttttgaagcttacagaaatggaatcatacagtttgcatctggcttccctcaacatgttcgtgagatttgtttatgaagttggacgttgctgtagttcatttattttcactgctgtataatattatatgactacaaaaaatgtatacattctaaagttgacaaatatgtaggtttcagtttggtttattaccaatgatactgctgtgtttaatcccacatacatctggtgcacatttgcagacattgctcataggtatgctcctaaaaggtgaattgctggatgatcaggcaggtgtaactccagctgtaccacctaacgccagactcaaaagtaaccattccgtttcttgttgttggcccccattagccgtgtatgaaagttcttgttattccacattcttgtcaatacttgatattttcaaatatttcaatttctgccagtctggtgtgtgtgtagtggaatctctgtgattttcttttgcatttctctgattactaatgaagttgagtaccttttcatatgcttagtggctatttgagattcctcatttgtgaagagtgtgtttaagtcttgtgcctggatcgttattgaattgcctttttcttattgatttataggagtactttatatactttgaataagagtctttggtcagttacttatgtcacacgtatcttctgccattctgggacttgccctttcactttaagggtatcttttgatgaacataagtttttagtgtgttccaagttcagtagtatcttcctttatgggtagtgcttttttctgtgtgggttgggaaatctttccctactctgagattataatggttttatctgatattctctagtttctaacagcttattttgcttacattgttaaatctttaaagtatctgaaattgatttttgttcatggcatgaggtagggaccagtttcatcttttccccatgtggagacacggttctgacagcactatttctttctccactgctctatgtcaagtgtccatatacgcatcagcctatttctggacgatttattctgcttcattgatctctatgtctattctggtttgattactgtagctacaaaataaatcttcatattaagtaaagcaagtcctcctcctaagttgtttttcttctcagaagtgattgacccttctaggctttgtgcatgtccatatatttttagaattaacgtattagattcctaaatgatcataatgacattttattttgattgcatttattctaaaaatcaatttaatgaaaattgacaacagtattgattcttccattcaccgaacattatatcattttttctttttttggtcttacggcactggctcagtacagtgttgaagtcattagagcaggcatacccttaatcacatgaaggaatatccattcaattcctagtttcctaagagtttttatcataaaaggatgttgaattttatcaaacactttttctgcattattggaaaggcatgatttttttctctcatacacacatgcattgcatacacttaaacacaagacaatttcatatcaattaggaagggataaatggagttaaagtgcttcaacgtctttcaatgtcttgattaatattactgagaaattaaagatactttttttgaaagatgcatattttaatttccagggtaatcactaaaagaacagaaacagtgtgtaattccaaaataatacaaggagaaaatggaatgataaaatgtgaaaaataatctgaaagaagggaacaaaggagagaaaagacacaagtaaatagaaaagacattataaatagacttaaacccaaatatatcagtaattaagtgatttgtaaatggactaaatattccatttaaatgacacagattattagaaaaataaagcttaaaaaccttatatgctgttgataagagaaacatcaaaaacataagaaaaacataagttaaaaaaatagaaaaactatgttaggaaatcactaacaaaagaaagcattagtataggtatattaatatgagacaaaatagaatttaaggcaaaaaggattaccaaaataaagagggttaaaaatggtaaaagttttaattcatcaggaaggtataaaaattctaaattcatatggccttattaatgtgatcctaaaatatataaagcaaaaatgggcaaaactataatgagagaaaaatcatagagggaggtttttttaaaaaaaattaatgtacttgatttactagaccagttttaggtttacagcaaaattgagtagaaagtacaaaatgttccttgtccccacacatgtacagcctccccgattattgacatcctcctccacagtggtacatttgttacaattgatctacattgatacatcattatcacccaaagtctgtagttgacattagagctcagtcttcgtgttgtacattctgtggctttccccaaatgtatgatgacgtgtccaccatcatacagaatagtttgactcccctaaaaattttctgcctagtcatccctccccactattccttggcaacccctaatcttattactgttttcatagatttgtctttttcagaatgtcatataattggaatcatacagcatgtgacctttcagattggcttctttcacttagtaataatatgcatttaagtttcttccatgtcttttcatagcctgacagctcatgtcttgttagtgctaaataatattccatggtctggatgtaccagtttatccattcatctacaaaaggacatctggtccctgccaatgctggctattgtgaacagagctgataaatgtctgtttgcaagtttttgtgtggagacaagttttgaattcatttatatgaataccaagaagggcaattgctggattatatggtaagagaatatttacttttgtaagaaattaccaaactgtcttctaaagtgactgtactattttgcatttccaccagcaatgaatgagagttcctgttgctccacatcgttaccaatatttggtgttgtcaatgttttggattttggtaattttttttttttcactgagacatcactggattttggtcattctaataggtgtgtagtcatgtttcattgttgttttaattggcatttccttgatgacatatgatgtggagcatcttttcacatgcttatttgccacctgtatatcttccttggcaaaatgtctgttcgggtcttttgcccatttttatattgggttgttcattttctcatcattgacattttttatttatttttatttttattttattttattttagttattttttgagacagagtcttgctctgtcgccgggctggagtgcggtggcatgatctcgactcaccacaacctctgcctccccgttcaagcaattctcctgcctcagcttcccaaatagttgggattacaggtacaggttaccatgcccagctaattttttatatttttagtagaggtggggtttcaccatgttggccaggctggtcttgaactcctcacctcaaatgatctgcccacttcggcctcccaaagtgctaggattagaggcgtgagccaccgcacccagccacatcatttactcttttttttgagacggaatctcgctctattgccaggctggagtgcagtggcacaatctcggctcaccacaacctccacttcctggattcaagtgattctcctgcctcagcctcccaagtagctgggactacaggtgtgtgccaccatgcctggctaatttttgtatttttagtagagacggggtttccctatgttggctaggctggtcttgaactcttgaccttgtgatccatttgcctcagcctcccaaagtgctgggattacaggcgtgagccaccgtgcctggcccatcattgacttttaagagttctttatgtattttggattcctttatcagatgtgttatttgcaaatatgttctcccagtctgtggcttgtcttctcattctcttgtgagaattgtcttttgcagacaaaagttttgaactttaatgaagtccagcttatcaattatttctttcatgaattgtgccttcaatgttgtatctaaaaagtcattgctatacccaaggtcatctatgttttctcctgttctagtaattccatagttttgcatttaggtctgtgatccatttcaagttaatttttgtgaacagtatcaggtctgtgtctagattcttttttttttgcatgcggatgtccagttgttccagcaccatttgttgaaaatactatccttacttcatggtactgcctttgcccctttgtcaaagatcagttgactatatgtatgtaggtctatttctggtctctttattctgtttcattgatctattttactatcctttcaccaatatcacactgtctttttttgagatggtgtctcactctgttgcccaggctggagtgcagtggtgcgatctcagctcactgcaactttcgcctcctgggctcaagtgattctcctgcctcagcctcctgggtagctgggattacaggttcccaccactgcacttggctaatttttgtatttttagtagagatgggatttcaccatgttggccaggctggtctcaaactcctgacctcaagtgatctgcccacctcggcctcccaaactgctgggattacaggcgtgagccaccatgcctggccacacactgtccttatattgttgctttatagcaagtcttgaagtcagatggtgtcaatcctccaattttgtttttctctttcaatattgggttggttatttgggtcttttgcctgtacactttaggatcagtttttcaataatccacaaaataccttgctgggattttaattgggattgcattgagtctatagatcaagttgggaagaactgacatcttgacaatattgagtctttccttctatgaaatgaatatctctcaatttatttatttcttctttttttcatcagcgttttgaagttttcctcatatggatcttgtacatattttgttagattaagaactaagtatttcagttggggggatgctaatgtaaatagtgatatgtttttaattttgaattctacttgtttattgctggtatattggaaagtacatagtgggagattttgctgactcttctaggtgtatgacagaatagcagacaaatcaatcatgatataaaagaattgaacaggtgtagtaaaattgtcctaatggacaaatataaaacataacaaaatatgcaatatctttaaaaattgaccatacatacagcaataaaacatatttcaacaaatatgaaaagattgaaatcacacagagtaagtcttctgactataatgtgaatgtgctagaaatctatttaaaaaggccaggcgcagtggctcacacatgtaatcctagcactttgggaggccgaggcggatggatcacctgaggtcaggagttcaagaccagcctggccaacatggtgaaaccccatctctactaaaaatacaaaattagccgggcatggtggcacatgcctgtaatcccagctacttgggaggctgaggcaggagaatcacttgaacctgggaggcaaaggtttcagtgagctcagattgtgccattgcactctagcctgggcaacaagagcgaaactccatctcaaaaaaaaaaaaaaaaaaaaaaaacccaaaaacctgggaaattccccaaatttttaaaaattaaaaaaggcttttaaaaatttattgggcccaaaaaactttaaaatttaaaaacatccctggggccaagggttaccccctgtaatcccacccttttggtggggtgggggggggcaaaccccaggtttaaaaaatagggcccccccgggccaaaaaggggaaaccccccctttttaaaaaaaaaacgggggggggggggcccaattttaattcccacctctttggaggggtaagccagaataaaggttttaccctggaggcggggggttcaattaacccaaattgggcccttgaattccaccctggggaaaaagaaaaatcccttttcaaaaaaaaaaaaaaaaaaagaaattagaaaatattttgagctgaattatttgcaacccgtatgaaataatggatctaggcaaagattatcaaatgccactagcatctcaaaaagaaacacctgggatattgtgtgccttttcataccacctatgaaaatacccttgtcagaaaaccatgctggttctaaatgtgcttcaatttatcagtttacagaaaacacaagggacagaggcacatggtaaacaccaccacagggatggaagcaaccacatctagaccatgagaaacttcacaggataaatgacagatcaattacaaggaataataggagaggagggcatggagggtgaagattaagagatttaagaaatatgtgaatgaaatgcatcctgattctgagaaattacaacttttatgaggtagcagtttgaacactgaagatttgatgatgttgaggattttcaactttaaggtgtgaaatagtgatattgtctttattttttgaaaggtcattttatttacagttaaatcctgaaataaggctgggcgcgctggctcatgcctgtaatcccagcactttgggaggccgaggcgggtgggccacgaggtcaggagattgagaccattctggctaacacagtgaaaccctgtctctactaaaaatacaaaaaattagcgggtgtggtggcacatgcctgtagccccagctacttgggaggctgaggcagcagaattgcttgaacctgggaggtggaggttgcagtcagccgagatcacaccactgcactccagcctgggtgacacagcgagactccatctcaaaacagacaaacaaaaaaaagctgaaataagtattgatgcaaggatattgtgtctggaatttgcttcaaaataatccagcattggtctaaaggaaataatattaacaatgagctgataaatgttgaaattggctagtgagtacatggggtttcatgatactattctctctacttttgaagatattgaaaggctaaagaagtatttagagggaaatttatggccttaatgaaaaatgtatatagtcaaaaaaaagaaaaaaagagccaaagatgaatggccactatgcacccactagattaacattgaaaggattgaaaatataaagtattggctgggcgtggcggctcacacctacaatcccagaactttgggaggtggaggcaggtggatcacttgaggtcaggagtttgagacaagcctgaccaacatggtgaaacctcatctctattaaaaatacaaaaattagccaggcgtggtggcgcacgcctgtaatcccagctacttgggaggctgaggtgggagaatcacctgaacccgggaggtggacgttgcagtgagctgagatggcactactgcattccagcctaagcaacagagagaaactccatctcaaaaaaaaaaaaaaaaaaagaaaaaggaaaagaaaagaaatataaagtattaataagaacatgaagcaacttataaactactatgggagtataaattagtttaactacttttgaaagcttcttggcgttatctggtacagttgaagttatgcatgttccgtccctcagcaattccacagtaagttacaaacttagagaaatacaagtccatgtgtctcagggtacatgtacaagaatgttcataacagcatacataatttgcagcggcccaaaacagtccacataccgtcacaatagaatggttatttgcagtatgtacatgccgaattctacacgccaatgaaatttaaagaactacagttacatgcaatgaatgaatctgaagtataatgtgcaaaagaagccaaaaaaagaatacctaggacaccgaaaaacacaatccattaaagaaaaaaaatgataaattgaattccattaaaaaaaaaactgctctttgaaagacaccactaaaaaatgaaaagtttggccacagggtgggagatatacatatttacaatatgtatatctgacaaaggactggtgtccagatacgtaaggaactctttcaacttgatagtataaacaatctaatttttaaaaatggttaggagatttgaacagacactttaccaaagaagatatacggatgaccactaatacgtgaaaagatgtttagtatcattagtaaggaaatacaaattacaactgcagtgagatactgtttcccacaattagaatggaaaagactaaaaagtggccatattaagtgttgatcaggacatggagaaatgtgtactctcatgtatcgctgatggcagtgtaagagagtaaaccacattgaaaagcagtgctctggccatttcttaaaaagttaaacatacacttcccacatccatcccagcaggtccactcctgggtatttacccaagagaaacagaagcatatgttcccccaaagacttctgcacaaatgtctgtagcagcttgagtcacaaatgaccaacactggaaagaacccagatgtccattagctgttgagtggacacacatggtatagccatacaatggaacagtaactgtccaataaaggacatacacaacaatatgagtgaatcccaaaacgctttgctgaacaaaagaagccagatttgaaagagtgctttctatatcattccacttatataaagctttagaaaaggcaaaactgctgggcgtgcctgtactcccagcaacttgggaggctgaggcacaagaatcacttgaacacgggaggtggaggttgcagtgagctaagatcattgccactgcactccagcctgggggacaaagtgagactctgtctaaaaaaaaacaaaaaacaaaaaacaacgcaaaactgacctacggtgacggagagcagaaggggttgctggggattgggggagagattaactgcaaagggcacaggaaatttccggggcaatggaaacattctgtatctagttgacacctagcaaactgcacatgaaaatggatacattttactgcatataaattatacctaatcaaatttaattttttaaaaaacaagtgatattcatacaccccaatagcattattcataataccccaaagatggaaacaacccaagtgttcatgaacagatgaatggatgaacagatgtggtctattcacaccacgggatatgactcaccctttaagaggagggggatgctgcacaccctgcaccgtggatgcaccttgagggcacaaggaatgaaagggccagttacaaagggacagatcccatgtagatgaggcacctcctgagccctgcctggtggtcacaccatctgtctgcaggcccctggatggcccactaaacacctgtgccagctgctgagtgtcaggtggctcctatgcagtttcacagtggcagtcactaagtcattggaaacgccttggcagggggaggggatgtgttgggggattttgagtggaggagtgttatcgtctgtcctacatctgaagagggtcactcgtgctgtggtgtggagggccagggtggaaacgcgggagcagcaaagaggctactgcggtgacctgggtgagacttgatggtggctgggacggggaagccatgacggaggtgaaaggaaggtcagggctctggttatattttgagtataataccagcgcaataccaaattaaagagtttgcattcgggtgggtgggtgtggcagagatggcaactgaaggggaattgcaggtttggggggaagatggggtcaagatctgagacggcctttgaagcagtggtgagggtggagtggagtgaggtggggcaggagtctgagaccgatacctggaagaaagcctggcggtggccagcagactaggcctgtttgggctgagtgacccgggagaggcacataaaagggtgagtgcatgaagccatgggctaccaccaacaccttagcataaactcggcactggatcagtcatgtgaacttgagggaaataggcaaagtagatgcattttaatgggtgcagataagggagaaaggtcttaccttggggctctgggtgataaataggattatggggggagggtggaggctgaggggcatggacagcaggagagacctggatatctccaagtcagggaaaggggacaagatggaagggaaggaaaatctcctacaagcctacactaacaagagagtgtggtcccagcataaagacagacatatagactgatggaacagaagaaagagatcagaaataaaccctcatgtgaagacgggcaactgattctcaacaaggatgccaaggtcattcagcagggaaaggacagtcttttcaacaaataatgctgagaaaactggatatccacatgcagaatgaagccacatcttgtttcacaccacacacacacacacacacacgcacacgcgaaactcaaaatggatcacaaaacaaaatgtgaaagcgaactctacaaagcccttattggggaaaagtttcatgacactgaatttggcagtgatttcccagacatgacaccaaaagctcacacaacaaaagagaaaatagacaaattgaacttcatcaagattaaaaacgttttgtgcatcaaaggacactatcaacagagagagaaggagactcacacaatggaagaaaacatttgcaagtttcattttggagaaatgattaatatctagaatatacaaagaatcttacaactcaatgacaaaaaaccaaacaactcaattagaaatcgggtgtggccaggcgtggtggttcatgcctataatcccagcactttgggaggctgaggtgggtggatcactcgagcccaggagtttgagaccagtccgggcaacatggtgaaaccctgtctctacaaaaaatacaaaaattatccagcggtggtggcgtgtgcctatagtccccgctacttggggggctgaggggggaggattgcttgaacctgggaggcagaggttgcagtgagcctcagtcatgccactgcactccagcctgggtgacagagctagaccctatctcaaaaaaaaaaaaaaaaaaaaaaagggaagagagagagaaattggatgaaggacttgaatagatatttccccaaataggatatacaaaaaaccaataaagacatgaaaaaaatgctcaatatcgctaatctttagggaaatatgaaccaaaagcacattgaggtatgacctcatacccattaggcttactattatcaaaaaacagaaaacagtaagtattggcgaggatgtagtgtaactggagcccttgtgctctgttggtaggaatgcaaaattgaatgactgctgtggaaagcagtggggcagtttctcaaaaaattaaacagaattaccatatgatccaacaattccacttctgggcatatatccaaaaggaatgaaagcaggggctcacacagacatttgtccacccatgttcctagcaggctacttcacaatggccaaaggcgaaatcaacacaagtatccacagacagaggaacagaccacagaatatggtcaatccacacaatggaatattattcagccttaaaaaggaagggtattctgacacatgctgcaacagagatgcaccttggagacattatgctaagtgaaagaagccagtcacaaaaagacaaatgttgcacgattccacttataagaggtacctggaataggcaaattcaagagacagaaagtttggcgcaaaagtaattgtggtttttacattgttgaaatttgccatttgacattggaatacattcttaaatcaatgtggttatgttacacatcattttaatgtgcgtttcttacttttttttgctaatgacattactgctgtttattctatatttattttagactatggaaatgatgttagacaaaaagcaaatttgagtgattttcttattcaagttcaaaatgggtcataaagcagcagagacaactctcaacatcaacaatgcatttgtcccaggaactgctaacaaacgtacagtgcaatggtggttcaggaagttttacaaaggagacgagagccctgaagatgaggagtgtagtggccggccatcgaaagatgacaacgaccaactgagagccatcatctaagctgatcctcttacaaccacaggagaggttgccaaagaactcaacatcgacgattctatggtcctttggcatttgaagcaaattggaaaggtaaaaaagctcggtaagtgggtgcctcatgagctgagcaaaattaaaaaaaaaacaaatttgtcattttgaagtgtcgtcttctcatattctactcaacaacaaggaaccatttcgagattgaattgtgacatgccatgaaaagtggattttatacaactggtgatgaccagctaagtggttggacaaagaagaagctccaaagcacttcccaaagccaaacttgcaccaaaaaagggtcctggccactgtttggcggtcagctgctggtctgatccactgcagctttctgaatcccggcaaaaccattacacctgagaagtatgcttggcaaatctatgagatgcaccgaaaattgcaacgcctgcagccagcagtggtccacagaaagggctcgattcttctctgacaatgcccaaccgactgcacatcacacaaccaatgcttccgaagtaaacgaattgggctgcgaagttttgcctcatctaccacattcacctgacctctcgccaaccaactaccactacttcaagcatctcaacaactttttgcagggaaaatgcttccacaaccagcaggaggcagaaaatgctttccaagagtttgtcgaatcccaaagcatggatttttacgctacaggagtaaacaaacttatttctcattggcaaaaatgtgttgattgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgatagttgcacaacaatgtgaatgtagttaatgcccctgaactgtgcatctaaaaatagtgaaaacggtaaatatttgtgttatatataggttgctatatatattttttttaagtgaagaaggagagccaacaaaggagtgccaggaaccagtttattcataatcatttctaagagacagccctcatcgtggggctgggggtctaaagggttcgtggctagcaggaaggtgggttgggccccctgagagcagggtcaagtgagggatcaggggagcttgagagctgacagcgcctgcaggaaggataaataaggagcagtggaaaggaaactaggctctcactggcaggagtcctcctcggtggttctgccaggaggtaaccaagactctccaggagagagatgtcagagcacacagagcagccaaagaagagccttaacattctgttcttgggctgggtgcggtggctcatgcctgtaatcccagcactttgggaggccaaggtggggtggatcgcctgaagtcaggcgttcaagaccaacctggctaacatggtgaaaccccgtctctactaaaagtacaaaaattagctgggcatggtggcaggcacctgtaatcccagctacctggcaggctgaggtaggagaatcgcttgaacccaggaggcagaggttgcagtgagctgaggtcgcgccattgtactctgatctgggtgacaagagcgaaactccgtctccagaaaaaaagtaagacattcacatgtcagagaatcagaactgcatacaggacatacatacaatggaaagtttaattcctctctctgccccaactcctctgttcccttccccatggcagacagttcccacgtgttatctcagcagagacagacacggctgtctatgagtacgtccgtgccacctagctctcctcttgtgtttgagtacacagatgaaagactactttcttcatctgatttatatcacctattctatggaatcatcttgttctttttttttctcctttttgagacagtctcactctgtcacccaggctacagtgcagtggtatgatcacagctcattgcaacctccacctcccaggctcaagcaatccccccacctcagcctcctgagtagctgggactacaggggtgtgccaccatgcccagctaatttttcttttctttttttttaagaaaaggtctccctatattgcccaggctggtcttgaactcttgggctcaagccatcctcctgcctcgccttggcctccctaagtactgtgattacaggtgtgagctacagtgcctgcccaccttgttctcttaaaggcttcatagtactccatttcagggatgtgtcattatgcctataggctaatgcaaaccacttttcactttttcctgtaacctcctgggttttttcctgttaagcaactggtggcagcatagatgctgaattcccccacccccgacacgtttctgtgcaccgggctatgcaacagatgtgttcagtcagcacacggatgaaggatggtacctctgcctctgcatgcctgtgccgtctcttaaattctctgggcctgcaccacctccttgccctctgcgtgcactttcattctgctccttctcactgagaaatgagggggcctggctgtgaagtctttggaacccccttctgtggtgtgtctttccctttccctctgtcacagctggactcgaaggaagctgcgagggacacccaggggactgggagctcaggcgtgtgtgatgggcacaggggtttctgtgggctgatctgggaggaagattcctccctcccctgacttctccccttccctggagccaccacttggccgctcggggctcacaccagcccttgagggcaaagctaggagcccatagcggcaatcggaaactctgggagggaaaaatgagaaggtcaagaaaagcccaaagtatttgtaagcattttaccaaagaaatgccaggacagctgtatctaccttgatgtagtataaatgctctaaatggtattacaggaattacaatttgtaagtcaaatcacattttatgagcacaaaaggaaaaccaccactaaggaaatgcacattgaatttttaaaaataaagaaaaaagaccttttagtaaaaccatcacccttccctttggccctctgcctttcgttgatgttttcggcatttacacttgttatctgttgagtcttcttaaagcgaggcccatggttacagaaaattcactggaggaaaaaaaaaatctgcatttatgcctctcagggtgtgtttttaaataccaaacagaagggcaggagggaagaaaacgatttgccttctggagccacaaatggttaagaaatgaaaaggctgtttcgcagttgggaggaggaagaaagtgacagggaggaagcagcctgcaaatgaacgagcaaaagcgtggcatgaatgaccgtgatgagtgtttccaaggatgagtccatgttcagagctcacagaaaaatcttccagaagaataaagaaaaaaataggaacatcaggatgctccagaggccttgcaaaaacagctgtggctttaatttatcaagtcaatatacattaactatagatgttaattatgttatattaagatagtggctgccttaccaggctctgttaaaggcacggcggataaggcagaaagtgaaacagacaagactccctaccctcctggggctcatactgcagcaggggacacaggccaggaattctatgcataattaaaatgcgcagtgtgacagacagacagtgatgagtgctggaggagcaaaacccaagtgggaaggggagctgaggcacgccagatggaaggtaatggggcaggggtaagggaggctgttacatgcgaactgcccccccaaaaatacatgtcgagatcctcacccctacccgtcagaatgtgactgtatttgcacacaaggcctttaaggaggtgattcgattaaatggcattattagggtaggtcctaatgcaataggactggtgtcctatgagacaagattaggacctgtatgcacaggggaaaggccacggggaggcacagggaggagacagcctctgcaagccaaagagggggaggcctcaggggaagccagccctgctgacaccttgatcccagatttctcacacccagaattgtgagaaaacggacgtctgaggtttcaggcacccgggctgtggtactttgttatggaagcccaagcagaccaatagaaagagctcgctgtgaaagctaacttttggggccgggcgcggtggttcatgcctgcaatcccagcactttggaaggccgaagcgggcagatcacctgaggtcaggagtttgagaccagtgtggctaacatggcaaaacccagtctctactaaatatacaaacattagctgggcgtgatggcaggtgcttgtagtcccagctactctggagactgagataggagaatggcttgaacccgggaggtggcggttgcagtgagccaagatcgcggccttgcagactggagtctgggtgacagagcaagactccatctcaaaaaaaaaaaaaaaaaaaagaaaaaagaaaacagaaagttaacttttgggtgatgctcagagggaagtgagggaatgtgccaggcagagggtgtggggcagcagacagcaggtgcaaaggccctgaggcaggaggtgcccagacagccagcagggcagcaggtgggttagagagccaggaggtggcaggggcagctttggcttttactctgagatgggcaagtgttggagggttttgaacagaggagtgagacacggtttcatctaatttgagcagaatcactctggctgctaattggaacaggcatcatgtagacaagggggaaacaggaatgagttagtgggttgtctacacttcaagagagacaggatggtggtgtgaacaagggcagggcagagggctgagttccggatgcaattggaaggtggagttagtgggactggctgacagatcacatgtgggatatgagagaagagttaggagaactgtgttttgctctgagcaactggaggcatgaagctggcgtggcctaggatacatgagatagtgggaggagccagaggtaagactcagctctgggcgtgttaggtcagagaagtgggttggaaatccaggtgcaggtgtgaagacggtagctggccactgaacttcagggagggtgcggcatgaagatgtgcaggtgggagtggccagctgatggatgtgtctaaaccaccagatggtgagagcattgagagtaggtgcaggaaggaacggggtgcggggacagtgccctgggatgcccagtactcaaaggcagggagtgagaaggagcagccggaaaggtcacaggagaaccagccaaggtgggtctcaggcaccaagggtgcgctgtgctggagatgggggagcggccagtgaccagctctgttgaacgctgctgatgggctgagtcagataggactgaacatggcctctgcagccatgggtggaggcctgatgagggtgagagagcaggaggcaaggaatcagaggcagctaaggctaaaaattgggagaagaagtgaaaacagcaaaggttttttttgttttgctttcaattttttggagcaatgtggtcttgctatattgtccaggctggtctggaactcctggcctcaagccatcctccgaattggcctccaaagtgctgggattatagaggttttaggagacgggagggaattgttaagtgaggagatggactaggtgcatggctcctttccctgtctcgcctctgcagactctctgtgcagtgcacacgcactggtgcctaccctggagcactgtgctaggtgctctgggtcctggagaccaaggagtggaggtgtcagcccctcccgaccccactccacaccccactccctccagctggccgcgtgacctggttctggggactgaatctgagcctaagtgcctcggctcctaggctgactcatctccctcctcccgacctgagctgctgtagtccccactgggccctgggctgggatgggggttctgtgactcctgtccatcctgtgcacagacagtccagcagggccaagtcccaaggagagtgctcaggcgacatcagggctggccgctcaactgtgctctgcagcgtgcctcctgagacccgctggctgtggcggttgagtgggacaacaaactcagagcccagttggtgcctggcacctggcaggggctccaggagtgattggtgaatgacaggcaagactgaagggcaccgagggaggggggcaggcacaagactgacttgcgatgggtgtcctcacagaagggggcatctgcccgatgggttctgggttccagcagggccatttggggatggctctgcagcccatgacccttggaggacagggagacctgcaggggagggagggggtctgagttgatgcatgtggagcttcatacatggctgggttggggtcagcaaggcctcttccccggctggcatgagggcatcgggggatgagactagaagccagggaggggctgagccaggagcctcgacacccaccccagggactctttactctattggcggggagaggaagcttgttgctgaaggcttaattcaggggagaagagagcgtgaggggttgaattgtggccctcccaaaaatgctacagtcccaactcccagaacctgagaccatcaccttggaaccagtcacttaactcggtgtgtaacatataatttggaaaaagtgtctttgttgatcaaattgagatgtcattaatgtgggccttcatccaatgtgactggtgtccttttaaggggacatttggacacagggacagacgcatcaagggaatctgatggggagatgcagggagaagacacaggcttccatctccaagccaaggagcacctgagccatgaggagcaagcagggaggcctgggacagatgctcccttgcagtggtgaggagtgaccttgaccttgacttccagcctccacgcctgggagacatctccgttgtcctccccccgactccctgacaggctgccacagcaaggggtgaggtgtgtggggaggtttaggaggtgaggcggccgccctacagtgacacacagagacagggggtttggctgatggggttaccaaacaaaggagactctcagcccaacgtgcaagaagccagtgctctgacactgggcttttgagaaaagaaagttttgattgctggtgggctaacaaggagacaggagtccagctcacatctgtctccctgtgctggctttaaggcaggaattttattagaaaaggtttaggagtggattctgggattagtaggtgattggtggagttttgaaaaaggaggtctggaaagttcttgcacccgtgcagttgtctcttcatgcctcctcatgggtcccatgtgcaaattctggggaagttagtgtgacatatgcagtagaaattcaggctatgacaattagcaggcgggctctgtgcagacttagttggccatattggttccaaccaattgcagccggttttaaaatctcataagcagagggagtttcagtgtttccggaagttgtcttttcttatctgctatcctgaaaactcaagcatttctattagtcattaggtttttttttctaagctctggggcacggtttcagtgggtgacagccaaagcccaggggacaacagtggagggcccgggggaggggcagtggccgtggagcgagaggggagtgatgtctgaggtgagccggtggacgccagtgtccatgtgcagcacagacacgtggcttggaagatgggacttaggcaccaatgatggctctatgtaaggccgggcctgcagactcaccctggtggggagggacgtccctcagaagcgactggaaggaaactggcatggaaagggaatgtggaggagctcatgggtggagtgggattaggaaaataccactgcgaaataataagaaatatgtacattgttatctggctctggtttctgacatacagctcctaatactgctgtagaaaggggtgctggaagaatcttttgttctaatatttgccctttgaccctggttcctgacacagagctcctaatcccttgggagttcctaggtgatcggagcatcttttgttctaatgaggtgactcttggtgggctctggatggcatcaggatgggctggttgccagtgtgctaaaggtcaaaaccaaaaaaggttgccttttttggaggggcactgacaggggaggtaagagagagcacatggggagctggaaatgtgggcttgggctgggggtgctcacagaggcacgtgtgtaaattgtatacatgggctgggtatggtggctcacgcatgtaatcccagcactttgggagctgaggcaggcagatcacctgaggtcaggagctcaagaccaacctggccaacatggtgaaactccatctctactaaaaatacaaaaattagtccagtgtgatggtgggtacctgtaatcccagctactggggaggctgaggcagaagaatcgcttgaacccagaaggcagaggttgcagtgagcaaagattgagccactgcactccagcctgggcaacagagcaagactccatctaaaaaagaaattaattaaattaaattaaaataaataaatagtatacacgcaggggagaggaccatgagccgtggctgcaatctatccatagcagttgaatcagagtccgaattttcataagatccttaggtgatgtgagtgcatgtgcaaatttgagaactggttttgaagaaagcctctgaaatctagtgagtaagaagactgggggctgtaaaggagaggaaggggggctctctgggaagcccaggtttctgcctgggttaactggggattgaggagccaggaggtgacttctgatggtacactgggcagacttcttgcctcagtcttctgagagaggtcaaagctggagttatagatccaggcatgtgggtggtagtggaagccaaggctaagatcatagaggaagaaggtataaactgaaaaagagcccaggcagaagtttttattagtgagtcctgtagaaagcattcaggagctgggaggagagcagggagagtggggtctcaggaaccggggagatacaccaccaggtcaaaaggtccagggagtcagatccaagtgcgtccgtaggttccgtggtggcaagagaatttggagtgcagtagggctgcacccggaagtaacaggctggaggagctggtgacaggcacaccatggggacgcagtgagagcagagctctctggcagcccggtttttctgaggaggtgagaaggagtggggtccaaagacgtcaacaaggggtggatgcagacacatttcaatggtgcagaagggagggcactgagcacatgcagcccagggtttccatttcccctccggagtggaaggcactgtcaccacggaggagtgaggtggtggccaccttgggtgggagagtgcagaggagggagcagtaggggcctcacccacacgcaggcctgaggacccagccagccaacgctgaactttcaagtcagcgtccccttccctccacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgctagtgatgataatgatgatggtctgttgcaatggggagtgtggagaagggttgcatcatctttcctctgaacaggagtgaggaagctcctctggctgctgagatgctagtgttccctggtccctcatttcagtaggaactcagctagagcacccaccatttccttatcactctcacggtgtccagatcagcctgttaaaggcttcagaccacagcttcaacactacattcccactttctctttctcagcctgaaatcttcctaatatataataggataacaggggagctacctcacaagtagaccagggacatgaacaggactctcattgtaccctaactgagattgttgaatattcagggccacagccaccaccctaagtgttgatttgagggggactcaggcaggactttcctatctaccaagtgctgtctgctgttccttaaggataatatattccctttgagtcagagagataatttttttttctaaccttcaaaaggcttctataaagatttagatctacaggaggaatcagggtcctggggctgaagaggacttagacaccaactagtccatgaagaaactgacactctgtacagcacttgatgttttcctgaaacatttcacgttctttctctcctggtcctcctgacaatccttcgaaggaggtaatatcagattcttgtttatagataaggaaatagagtgatttagtatggtgcaatggttaagactccacagctagcccctcaggattcaagttctggttctgctattttttattttattttattttattttattttattttattttattttattttattttattttatttttagagacagggtctcgctctgtcacccaggatggagtgcagtggtgcaaacatagctcactgcagcctcaaactcctgggcttaagtgatcctcccacctcagcttcctgagtagctgggacaatactcataagccaccatccctggctaattgttttaattttattttttgtagagatagggtctcactttgttgcctaagctggtcttgaactcctgggctcaagtgatcctccagcctcagcctcccaaagcactgggattacaggcagctccactatttactagctgtgtgaccttgaataagttactcagcctttctgtgcctcatctttcctatctgtaaaatggtgataatgcttggtgcaatggaaatgctgctattttttatgattattccttaaaccaggacacagtagacctgtggatttcctcaacacatgtttatcgagcccctactatctgtcaggcactatgcaagtgctgcagatacaatagtgagcaaaaccagacactaccccttcccttacggagcttcaagtctagtgggagagctatgcatgaatccaatcaatcacactaatgtaaaattacatgtgtcacgaaggaggcacatatgatgttactgcaagaggacagagccagtctggggccccgggggaagtgaagaccgcagtgaaatctgataagtgagttggagttagctagactggggatgggggtggagtggacacagggcagtctgtgcaggggccatcaaggacacagcagcctggtagagggacaacatggacctgctcaaagcctgctgaggctggagcacagggaccagcacagacctgagtgagatgagtcagtgggtaggaagggcctgatcattcaggtcctcataggcggtgtaacagattctgatcttcaggagcaaaaaggaaggatgctaagtggagaagtgacaatagccacatctgtgatgtgcagtccatcctgcagtggagggtggacaggcggatggccagagggaatggaggcatgactgtgaggaggcccaggggaacagtggccctggggcctgtgctcaaggaatagtgctgtgctggagattaattatgtgtgttgtcggtaggttgattacagccccggccagggggtgagttggcctagggagacagtctagagctgtgctgtgtaatagagttaccactagtcaaatgtaactattaagcaattaaaatgtgcagggtctgaatttagatgtgatgtaagtgtgaaatacacactgaatgttgaacttagtaaaagaatgtaaaatgtcctattcataataaatccattgcatgttgaaatattttgaatatattgaattaaaatatattattaaaattaattttaccagtttttttttctaaagatatggctacttgcaaatttaaattccatatggaattggaatttgtggctcgcactgcgtctagagtgagacctcagtcaaggacccagccctgggaaatcgtcttcaaaacaaggcttttgccagaggagtgcaggtggagagggggatggaagggcaaagacagggttggggggggcggcgggggcaggtcctgtgaggcagcgcttgcaggctgcagggggttagaggcaaggcccagttgctcccaagtttgcactgcgtggggcccagctcgcaggcccaggacgtcgttctctgcagcttggtagacgcctcctttctcggctctagcctggctgggtaaatgtctacagcaagccctcagcttaggggaggcagaaggaggcagactatttcataataactcttctccaagtctcaaatattgtttttcacaactccctccttagccgtttgtggaagaagtgctcgtcccacgggatggagagggagtgggtgggcggcagctcccgagccggggaccccggctggctcctgtgcggcgtgacggggtggttggctgagccctaggccccctccgcctgccgcaggctgggctggcgctgcggacccaagtgcagctcttccccgcggggcacgggcgcaggcggcgtccccagggaggcgtgcgcgggagcgccggggatgggggacgggcggggctggagcggggacctacttccttttctgtcccaagaggactcaaaggaaaacaattcacttgatcctggatacgttttcatctataattcggaaatatgcaaatgaaaggcccacatggtctgaaaggggcaaatcaagctcccagcgtgcggcgcggggaaccggctcttccccagggagccccggaggcgcgcgccccacgccgagggcgcccggggaggaaccgcaccccgggctcgggagtagcgcgtccgggccctcagcggccaccgcccgggggctccccaggcccggtccttgccctctgccgcccgccctctaggccgagcctccgctcccgcgatgtcgccgcgctcgccgccgccaggcgcgctggtccgccgggtcgcccgggcgcggggcgcgccgcccgccgcagcctcccctcttcccccggcttggccctgcggcccgcagcggggtccggggtagagcggccgctttgttcccgccgcccgacggcgcggggctctgcaaaggcggaagctcggcgctcgccatgaccccgtgcggacgcccagtgcgcccagcctcgccgcgccggccgggcccccgggccttcccgcgctgagcgcccgaatccgccccttccgcggccgctcaccgcccgccgccgccgcagtacgagccgcctccccgcccccgcccccccgcttcgccgccgccgccgccgcaggagagggagggaggcggagggaagggaggcggcgggccctgcccagagcccgtcccgggcgccggcaagcgagctccggccgcggcggcagcgccatcccgggccgcgggcagccgcccctcgccctccgcgtccggaactgccttcgccttcccgcgaccccgcagcagccggccctcggggcgccacgaacgctgtcccctctgtggagcagagacccccttccccttcttagggggtgtcgcctcggggatcgctgagcgctaggggtccaggaggcggggacgggagcgccgtgacccgccatggctcaagcggccaaacagctgaagaaaatcaaagacatcgaggcgcaggccctccaggagcagaaggagaaggaggaatccaacaggaagcggagaaaccgctcccgtgaccgaaagaagaaggtaggagggggcggcggtgaaagcccagcgaccgcggcacctgcaagtggctgctgggggcaggggtcgggcggcccgggacgcggtggggcgcggcgcccggtgcggcggagttggcggcacccgagcggggaaggctcggtgggcgtagaggagggacggaggcttctgcgcggccgggaaggggacagggcggcaggctggaagggcagagcgggtggccgggaggctgagggcgcgcagaatcctcccgccagctgcccgcagagacctttcagcaccttggacagcacccggcaggcccgcgctgctctaggaccaactttcccggccttggctgccggctgcgggtggtgggctgccctgctcgggcgcgccgcacccgctggctttccaggagagctggtttgggtaaacgcggctgcaggctccggggagcgggccgggggggggcagctctgcccggcttctccctaggtgacccactctgacgaagagagcgtctttcccaggtgtctctgaacgagagtcgggctcctgcccttccttgacccttctcagggagcacctttcctgaccctccggatctggtagcagaaaagaaggcgccttctcctctacccggggtatttgcaacatcttatgctcaggtcactcaagatgagccatccatgccagggaggggaagttcctttggaagccaggcacgggtgctccagcctggcccaaaggcctggtcagagaccagctctgcccatgggcagacatcccgggtatttctgtgtcggggtgccgagacaaaataggcccgcaaagacccagacctccaggggcaactgttgctgtttttagcccttttggggtctggggtcctcttacccctgatcaaagcaccttgagaagcaccttaggtcagaaacacctttgatggtgaaaggacggtgacagaagtcagggcaccttagagccacggaggaggccaagagtacgtgggtgtaattctgggaatcggagatgctgaactctggattcaggagagctattttcacccgaagaagtcgatgtggggcccagcctgcacggctccccagcaaggagtggggcccctcaggcttccagggagaggctctggccttggttgagaaggaaacacgttttctttccctgaaactgtctcattccgagaaagaagtttggagcctgcagctgacagcagagtgttggggagcaggctgtctgtgggtcacacaccccttgacagttggtcagcagaccaacatccatcctcttcctagagatgctctctgatttcaaaggaagtaaccaacactctctaggctttcctgtacccttcagaaactgacgtccccacctcccttgagggattgccatcttgtgtgtaaatagtagtttcacaaaggcaccacccctttagaggaccgaaaaggggcctttttcaaaccgatgatgaatcagagtttgggttggtgccaccgagagagaatctccgcaggtccctctgctggggtctaaaataccagagcccgtcttgtgagtcaggcaggggaagtctggctctacgctgcgatgctcacccactttcttggcgtgaatgtgaacttcttctcgggaaggagtgctctgtgtttccattcctgcctcctgctttggaagccaaggcgctcctctccgagctgctcactcagtgttctcatccacctctctctcgcagccttcctccttgacactcccgacaccatatatcattttttgaaaatagtcaaaaaaccctctcccaccccctctcctgtgattcttttccattctgtgaaaattccctttaatataactctgaattccaaatatgtataatacacacatgtgaaagcggtgatttcaatattctttttgcttctttgctcttaatctttacatttgtagtaaacctcatttctttttttttcttttggtggtagatgataatatttaatatattcctccccccaaatggtgttatcttgttttactagccggtcgcagcatactgcgtcagtagcattcaaaaatcttccattcagattttcattattttatgcagtatcctgggtgctatgattaatataatgataagaaaattttcatttaaagtgatagcagtgacgcatactcttaggactgattctttgggtgcaggggagatggtatggggtgggatgtagggatgctttgttcgtattttgtaagggctgtgagttttctcagccattgggatggtcttgagggtcatctcagagaatagagttaaaatttatagcaaaattgaaaatcacaagcaggtggaaagctctagagggaaaggtgagggaggcagtgcagaaaggagcatttgaagaaagcttacaaggggcctggtgaggcagagggcctagggctaactcaaaggttcatataaggtgaagtctaactaagccatttttcatgaaggagataatttttcaaggtgaaatgtattaaaatcaggcagctgaggactttacagctgctcacacagactacagagtgtgtggacccagtttccgtttcttataccagcatgcagaaggaattccatacatgcagacaaacatgttactccaggacattggcctcttgtgtggatggatagctgagccaagggcattctgaattaactcaaaggaaaggtgtttgtcccgcgggtaacctacttaccagggactgactgagcagaaccgcatccctcccgtttgtagaaataaccatggttgtaactttggcgatggttgcagtttttacagttgatgatattgtgtgggaaggtgcttgctaaggggtgctgtgtgcggggggtggaggaggctggtgttgtgacgcactgactgacacagatagaagccacctcgacgcagggaactgagctacactctggagctctaacaatgcctgcttctcatggggcttcattcagtgctgtgcatgtgcagagccaaccttgtcagccacttgctgttgtagctgcagcttaaaaaaatccagcgtttatgatatttactgataagtccccctgcttttgaaggttggaatggaaatacattgcaaagcatgtgtaaagcaggcatttgcatgaaggatgacagcttttgagggctgggggagcctgaggcataagaatgtgtgtgctttttatgtttacccagagcttgagggtaggaggagaagaggacaggaagatgggaggaaaagtgaagcagaggatagaagagggcagaattcaaggaaggaagagtggatagggagaggagcgctgacgccttggccctgagtgacaggttcacactaagccggatacctgcaacacggtgagaccccagggtagtgtttactcagctctctccttgtccctagttatgttcacctacttcatcgtctgatggtgaaagaaaagaccatgtcctattcatagctgtgtacctgacacctagctcagtacctgactcaagcggcaggcagtggatgtttgtggagtgaatggttgaatgagtgaattaatataatattaatctctgcttgcccagatgttgtcttggttgcaggcatgtgttccggtgaatgatacaccctttgactgactgtcttttgggggcatctggaaaaagcctgatttgttttctcttctaatcatttgcaaagcaatagagatttgtagggaggcagtggaaccatctaatcttttggtgcagtggattccaccactgagcatgtagttagttccttgcagggtctctgctacactaaatgtcaagtgattttagacatttgtaacaacaacagtgtttgcacagggtcccaaggagccaggcactcacaaggagggatggaggaagagtgcaggaagaaagaaaagaaagcccaggcctggagagtggcctctgccacttagctgtgcaggcagctccgtcagtctttccagtctatgcagcagtaaccgaagagcctgcagccttcctctctcagcaggaggaggccctgctcctggacaggagaggggttttttgttgatccagtgattggaatcacaggggagatttggggtgggggggcacctgcgtgagactggagggttgacaaggaggcttggtgggtctggaggtggggaaagtgggatggaggggggaaagtgggatggagggaggaaagttaagcattagaatcatgttggcccatgactttcatttgcaaagggcctcaaatttcaacttctgctgttatctccaaaaggttttgtaaattcaatccaagagattgccgacaaaattgaaagagaacagtgctcatcacacatctttaatctgggtcctgttgctaaaccatttcactaatgtatgttgtggcattaatggatatttatatgtaaagcctcaatttggcttttgattagcatacttatgttgtattgcatgtgaattattagagcatttgtttctttgttgcaagactttaaaacatatcacaactttggtatccctgctttggcatttcttcttattgtagtacctcgggagcctccataaatgaaggtgggcctgcctctctggagctctgggaggcgccggcaggggctgaagatgtgggaattttcccagcctgcctcctgtccattttttcagttcagctcctccctccctgctgcagaggtagcagtggtgggggctgttcccaggatctctcctcacttcccagccataggctagaccaggagagcagggtcttgagggctgagaagatgttacactctgaattttggctgctgctccacctctgtgaagggtgactgtgaggagcaagtgatgtgcaaaccatctagtgctggactgtctcagagcaggtgcagcagcagctgaaattcagagcctggagcaagtcacctccctgggcaggggacacgagctggcctccagtgtctccccgtttcttttgctcaccccagcaaaggctgctggctcaccagttctgctcctctcctctcaatgtggcaacacttaaaaaaaaaaaacaaactcatctgaggtttcttccctattttcacaataaaaatgagcacgtagtggcgagtgtgtcctatgtacaggcgctcttcatcggtgttagcttgcccctgtgtctgctttggcaacacctttgaataggtgatcctgttattgattccttcctccttcaatgtcaaagcccaacactgtcgcctgcaagaaacctttcatatctgtcccctccttacccccaccccattgctctctctgcaccttccacgcatacacacatgcacatgcagaagttcttgttttatctcttctactaaattgtaagcactttgaagccaacacttgagcctttgtacataaccattcactagatatctatggcttgaattggttgaaaagctacatttaactagtacaggttttttttcttagttgttctttttgattttgagagagttggccctaaagaattggtaccaagtaaatctattgtttcccccaccttgaattcttctgactgaaataaaatctattgtcactgtttttttcttcttttctttttttcttttttctttttttttttttttttgagacggagtctcgctctgtcacccaggctggagtatagtgctacaacctcagctcactgcaacctccgcctcctgggttcaggtgattctcctgcctcagcctccagagtagctgggactacaggcgcgtgtcaccatgcctggctaatttttgtgtttttagtagagacggcatttcaccatgttggccaggctggtctcgaactcctgacctcaagtgatccgcctgcctcggcctcccaaagtgctgggattacaggcttgagccattgtgcccccacccagccagtgtttgtttttttgagaaaggcagatcaactttgcctggctctctatctccatttctggttcttgagaagctcaaaactccacctcctacagaacactggcatggagtcggctgcccaggttccagtttgagctcttgcatgtatcagctacgtgtgcatgaacaagcctctgaatttcctccagcctcagttttctcatctgtaaaatagggatgaagatcaaatgagataataaatgagaatgtgctttgtaaattttaaaactcccatatatttaatggagtatagctaataaaataatgattgttcataaagttattctttctaataaatcctttaccaaagttcattcctggccttccaatggtattgtgaagtcttgaggtttgccggggaaggccagcttgttattctttcagtactgggaaatgagaaaaggatactttaaatcatatcttcatttcattttcaggaaaaaaaatgaattttctatttggacaggatttttattgcagacctgcgcagtaatctgcatgggttcgtcaataacttccaggtgggcttagatacttgcaagctttattgaagtcttgtgtggcaccagtgctgtatatcagaggggaacataaaagggcttcctaactttgctgagactcctatggctgttagatccacaggtagtaaatctgggtgtgaactgtcacagataatggaatgtgtggtgttgtggggagaccggattcctctggcggagactctctggatcttgggtgcacaaagcacagcacattctccaagaaaggaaaacttgcattggagacactcaaagtgaaagcaaagatgtaatggccagccaattaaaaaaagagagcaccattctttccttctcatttgcttccaatgtgactggactcttcttctcaaagatttccctgtgtttttaccaaggaaatagtacatgtccaattgcttttgcatccattggcgagcattgacaatgatatttgcaaaaaaacttctttctttatcaagggaggtgcctgcacttatgagggtctccagtgttcctcgtgcatgacatgcattgtcacactctgtcgcccaataggttgataaccccagaactgggctccaacccagatgcacctgactccaaagcttattaacagcccacagcactaggctacttcccccaggtattggttgtgcccttaggatattcaaagctatgctaggcactgagagaagagtcaaagctgaagctatctttccttccctgtctgggcacagtgactcatgccagtaatcccaccactttgggagccgagatgggaggatcacttaaggctaggagttcaagaccaacctgggcaacatggtgagacccagtctccacaaaaaatttaaaaactgaagatagttttccttctttgaagtgaaggacttataaattagtgggaaagctgccagagttggaagtaacctcaggcagaggatggagagcttagggcaaagcctgtggcctccggttccagtgggaatgtgggtgtccgaggcccctcagaatgtcttggagctgaggactccgtcgccgggccctgaggttaacacagagtgcaaatgaaagagcaggtgaaaacggagtcctggggtttctgctttgtttctggctagtctgtctcttaacaggttaactttccccttaacttcagtttggagattctctgttcaccacatcatcaagtcaacatcttctctatataatcacttcataatgtgcagacactagtcaatacagaggggtggcattgctgccatgattgtctgtttttcctgttatctgggcctttagctttttatgtggatgcttcccaggcctatcccagaagcgcctgccaggagccggacacggagatgatacgatgagggtggtgtgaatggatgagcctggctggctcttgctccgcagctctctcctggctcttgcatccccatggttctgtcgcctgcccctaagaagtcgggtggtctgagtagtttccaatgtgcggtatcacatttgcatacaaatgtacatatgtaagcgtgtgtatacgtgtgtacctatgatcagatgccaacaggggccccttcttgatttggcatttgggcagttagttgatgacttccactgagcttgggaaagaggagggggacgggttaggaggaagatggtgagtccttcttggcatgtggcataggtggcttcctggggctctcacctgatagagggagagagctcatagaaaacatcttcgatagcaggggcagctgcggggcttgcagtgggaggagctggcagtcagctcaagtctgtgccctccagctaggccctggaacacaaagcttctaagcattggctttaagtacgacacacacatgaccaagctgacagggtgttaggacagctaaggatgctgatggtcccacccagaagccagccccactggctggaggtgggctcagggagcaggacccatccactcttaaagacaggactttggtgccatcacccatgtggtgacgtattttacattcaccaaaaacatgcttaaaatgtttttaagaatattcttttaattgaaaataggaatatgcttcagttgttgtgttatgttcactttaaattgacacaatatacacttgtatatataatatacgtggaatagaccaggaagactcagggccagagtagccaagtaacatgtcatcagagaaatacacactatgtgagcagtggtcatctttgtcatgtgtgtttccgggtgattgaattttcttttttatccttttctgtatttttaataattgttcaaaataagctgggcacagtggctcacgcctgtaatcccagcattttgggaggccgaggcaggagaattgcttgaggctaggagctcaagaccagcctgggcaacacagcaagaccctgtctctacaaaaactaagaaaatttaagaaaattagccaggtgtggtggcatgcctgtagtcccacctactcaggaggctgtggcaggagattcacttgagcccaggggagttcaagactgcagtgagctatgatggtaccacagcactccagcttgggtgacagaatgagactctgtctctaaaaaaaaaaaaaaaaaaaaaaaggaaaggaaagaaaagaagaaaggaaaaaaatgttaaaaataaacaagttgtcgagacacagaaagaaaaagcagaggacgccccacctgtctaagagggtagcagggctttctctgactgtgtgtcttctggagatgaaatctggaatgtatagctgatgccacaccctcagtaagggattccaaggtgctgtggactagagccaagtaggtaacggaatgtactggctcaaagtggagctgaagcgtggcccccaagagcccaggcagttgggtcttggcatatgaagacttccattgtaaaccaacttgaaaatgtatgtgtgttgggcctaatactcccttctgcagccagggggatcttccaaaaatgcaaatcagatcctgacactcccttctttcagtccttcagtggcttcctaattgcccttagaatgaagtccaggctggttaaccaggcttcctcccttccaccccctgaatctactccctagctgcctctcctgtcttattgctgtctttcctgcatcctgcactgggctgtacactgatacttggaaatgtgtgccttcacttgcttttagatcttcctgtgtgccacatccttggcctccaacatcaatgtcaagtcctccgtcagaacgcagttgaaacattgcctccagtgtcctagatgaggttgggctcccctgtcccatactattccagtgtacccttgggcaagggggccagagcatcagcagagctttagcatgcgtcaggaagcagtaatgaagagctgtggcctgtggagtgagatggagtcagatgtttactggctggctttgagcaagttgctcaatagtgctccctgagtctcaattttgtcaattgtaaggtggagagaataatacccaccccacagccatgcagggctgttgggaggattgaaggacttaatatatggaaagtacctggcatataagcacttggtaaatggcaggacaatgcctcagctcccacccatatccaccttggggctgcccataaaatccaagacatgagcattagcaggctgtggacctaggggtgggtggcagagagaaacacatgtctgcacctgagccctgaatgggtaaatagatgaagacttaaaaaatgtgggccttggagttttcctctttaatcccgaatgagacttaaaagatgaacgtcctgtcccacctggctaaattctcaccttgtatttattaatttaaatgcagtgttagcctttctggagatggccatcaggtcaaatgccaaggttggtagtactcagctagtattgctgccagtttcttaaatgagttagtaaagaatttggagaaatgtgaacctgatctgaaactcagagtgaagaatcagaaacagcccaagtcaggcaaacttcaaagtctgaaacatccatagagttgcactgaatttatggagacactagattctcctgcggcatagagatttggccagttcattgtaatgccatttgcaagagctgctttggttgctaccattgaccacactctggagaggagactgtttccctgctgatctgaggttacacagtgccagtgggcagggaaggcccttccacagcttgtttagcctgtgaagccttgggaagggacaggtgtgtgatggatccagccagtagtctcctctgatttgggatagcacacaatgcaagggacccagggcctgtccgccgacatggagcaatgtctggaaatcgtggtgttttaccaagttcttgagctgttgcacttaactatggtatctgctttaggcaaagcaaaccatagtcaaaccatttgtcttttcaaaaaaatattgtcttcttgccagtcacatgtatcacttcattcttgaacagatctgcatttgaaggacacctggactacagctggtgtggttgaatgttagcacttttaacccagatgtcaatactgccccacacaggacttacaagacacagacggaaaaactttatgattctgtaccgagcaccatcaccagatttctcaggaagaacttttaaggctaactccagtgaactcaccatcctcactgctgctggagtctccattgcatccctgcttcctctagtcttgcccttccaatacggtctttatcttgcagcgagagcccctttttttttttcaaacacaaatgtgatagttgtcacttcccttccgaaaacccttccgttgctttcccctgccttgaggatgaagtcagacccttccccgaccactgtgcctcacccctccccaagcctccccgtgctcctaggatttgctgggctcccttgacccacaccttgcgcagggtgctccctctccggaactcagtctgattccccctcatcccttgtttgtttgtttatttattttgagacaaggtctcaccctgtctcccaggctggagtgcagtggcataatcacagtttattgcagccttgaactcctgggctcaaacgatcctcccaacacagcctctgagtagctaggactacagacacgcaccaccaaactgggtatttttttatttcttgtagagacagagtctcactatgttgcccaggctggtctccaactcctgggctcaagtgatcctcctgcctcggactctgaaagctctgggattacagatgcgagccgcggtgctcggcctctactcatcctttaagcttcacctcctccaggaagctttcctgagtctgggtctgagatactatggaagaagtgcctgtcctgagggacgctggatgcagtggtgaccagatcccttcccactctgccactgtatgttagctgaggcagtttcccagaccctttaatgcagtggtgcctttattatttattcatttatttatttgagacagattctcactctgttgcccaggctggagtgcaatggcgtgttcttggctcactgaaacctctgcctcccaggttcaagtgattct

SEQ ID NO: 12628 - DNA, 7697 bp, Human
ctcactgttccacatggctggggagacctcacaatcatggctgaaggcaaggaggagcaagtcatgtcttacatggatgtcagcaggcaaaaagagagcttgtgcagggaaagtcccccttataaaatgatcagatttcaagagacttattcagtatcatgagaacagcatgggaaagacctgccccaatggttcaattacttcccaccgggtccctcccacaacatgtgggaattgtgggagctacaattcaagataagatttgggtgaagacacagccaaatcatatcagctcttttgctattggctgccgcaggaggccctctctgcacagctctgtctcagtctcactgggatgatggctcctccatgctgctagccctcaggttctgtgatggtgctttctatgagtcaacttggctaggtcatggtgcccaaataggtggtcagtcatgatcctggctgtttgtgtaagggtgtttttggatgaaattcacatttaaactttgagtaaagaagatcgccctccataatgtgggcgggactcatccaatcagctgatggcccaagtagaacaaaagactggccttccccgagcaagagggaattctggcagcagctggtctttggacttggactgcaacattggcttttcctggtcccacccttcagagtttggacttactggcctccacaattatacaagccaattacttaaaatagatctgattctctcagtgtacacaagctgggttctctttctctgaagaaccctgactaatagaggtaccatatgtcttccttccaccctgcccacaacttagttagcaccgtgcctttattgcacactcctccaatcatgtaatgcgagccctgcagtttcctgcctgctctgtatgccttttgcaggccagcacgacagccgcaggcctccctggaggctgcccaggcacccgccccttggaagccaggccctgacgaccgctgggtgttcctgcgtctgtggcatcccccatctgttgggccctgtggattcagaattgtttgtttacttaaagccagaacaaggcattcctgtccttcccactttcagggcaagaggcctgaacctccagtgtagcggattcatttctgtccggtttgtggccaagtcagagccatttcctagtgccaaaaacagagactgagcttttttctgtctgtgggagattttacaacccagtcccatttcaaagagaagactgaggccaggagtgtcttacccggagtagcctggtgagtcagtggccaggaagccaggacccctctgacagtttatgctttatgaccgggcgcccttgttctcattcatggagattgacgacaatttctgctcttctcccagtgacctgcacagtgatgccaagtcagccattctgctctgcctcctggggtctgaactgtgttctccagcagggatgggggatgcatgaagctgcacccactgcctggcctagagagagccactgggccccagtgaccaccaggcgacaagatggggatctcactgtgcactcaggtcacaacacctgtgacttagaggagtgactttggtccttacagtcagtgaagtgggcacgcaggtggggaaacataggtctgacacctacttggaggccacacagcagcatgtggctgccagggctgagagttgcacccagggctgggcaccatcaattgcctttgacggacatgggttggtccctagaggcagcagggccagggcggctgcagccccagctgtcatagctctggggttggggaaacctcaggtgtgtcagtgtggctgggaggtggtgagacatgcactgccttctgcatccccctagaaggagaagctcaaggaaaggcatacttgggaggagccatgggatgaggctggaatgctgggggtggagcctggagagcttggagccctcataagacctgatagcaaggagggggcacatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggtgagcagagggtggcccttccccttgagcctctctccaaggaacctggatggggatggggagacggtgtcctgggggcagtctggtctcctctaggggtttttggggatgggctgggggagcttctggggccctgccccctctctttgggcagctgttatgctggaggttgagtctgtctccccatggctcaggagctctgtgccagctgaagagcacagccccgtgcagttcccacactgctctccattagcccctaggtctttggggtggagcagaaaaggctctccaggtcatcatcaagttcagtcctgaccttgcacagccaggcctctggggcccccagaaggccaagggcaaacagcagggttgcagtgggacgggatcgcctgtgcccggagtgtgcagcctagatgtgtctgtgatgaggacctggaaaagccctgccctgggacaaggattgctaggtggggtctcaaccctgagcaaggggctcagaccccaaggacctcaactgagccatctgcacgatggatggtgacttctgcctgtctcccgatgatcactgccctccccatggtgaccccatgatttgattgtgtcttctaaactcaagcagccgtgtcctcactttaggcacttgactggggaacagtaagggtgagtctcctggtggtctgtgggataagagggggttaaaaggctgctgagcctggaggagcaggccggtgtgggaggcagaaatcagagaacagccggactgggtgtgaccaagcttggaaggccaagtgatggccccacgccagggctccagacagaatgttggaagtcatgcttcattccagcttccaggtgaccctggattcactcctggggccatcttcccagatcatctccttagccccggcttcctattcctgtatgctttcacccctccctcctccaaggaacaagaaacccatccaggaagggctggacttccaggggaggcttccagctcccagtcagcctgaaacttaaagggccactgcccccagcatgtcctctctgaactctccagcccgaatcttccccagagcagggcttgggcctctgttctctgtcccagaaatattatactcttggcttatgttcttgactgaaaggtattgggctaattgtttaaccttttacagactcagttttctaatctgcaaaatgaaaatagtgatagcagtcactacacagggtagttttgaggtgtaaatggaaattaacacatataaaatatttggcatgaggcttggcttacagggagctgccaatccgtgataaccaccaagcacgtttgccccttgggtaagaccagggtgtgtgtcctcatccctgtgtctgccttgggtctcgtttcttttacccatccattaccagtctttccctcccacaggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacaggtaggggtgcagaggttggggagggggttcccagtcaaccttctttctcagaagtctccctggcctctttgttgtctctgacattttcaggacagtaggaccttcaggtataggaccagatgtcctgtggtggggatagagtagatggaatcccaagtttcaggattacagcagttttaggggcaagactctgatcacaggactatgttgaggtgtgatatagtcaagtacgaacactgaaaaccagatgattttcatctcttccttcttctcttccttccttaccctcatctatatatctacctctctatcttctatgtatctaactatccgtgcatatccatccatccgtccacccaccggttcatccattcatccatccatccatccatccatccatattcatgcatccacccacccatccatatccatccatccatccagccagccaactagccgttcacctatccatccatctatccatccgtccattcatccatccatcaatattcatccatccacccacccatccattcatccatccgtatccatccatccatccatccatccacccattcatatccatccatccatccacatacatccgcccagccatccatctatccatccatccacccatccatccatatccatctatacatccatcaatccatccacccatccatccatatccatctatccatccatccatccatccatccatccatccatccatgtccatccacattcatccacccacccacccatccatccatctttccttcttccctctattgtctgtacctgtgtgactgactatataatgtataatgacgtgaactcaccacccaacctgagtactcgaatataataaagacttacctgtgcttctctgtgactccttgcctctgcctttcccaacctcgggtaatcactaatatggattttatgcttatcattccctttttcaaaaaatttttttcttgcatacttatgtatatctaaacaatctataatttagttttagtcgcctttgagctttatagcagagtaatttgctctgtgtcatttgcgatttgcttttcatcactcaaaattatatttttaagatagctatattcatacattatctgtagtaaattcattaattcattcatccatccatccaataatgtttgttaactgccctctctgtgcttggggtggctttgtccatcctggggattaagggaagggggctcacatggaatcagagagagaaagtttcctataattgttctagccattctccctaaccatttttctttgggagaaactgaggctcagattgaagaagagcctgctgtcaggtcacacagggactcagggacagcaatcctttggggatccagagatcatctccatctgctggtcacagtggactgagagttcccttcagaacctcaaagggcctccccgactccctctctctctctgcagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgctgcattgtggctcgcaagaagcctgggccctgagccaggagggccagccagaggtctggtcaggctgtgaggccttggccatctgtatgctagagaggggtgaggaatggatgctgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcctgagtagctgggactacaggagctcgccaccacacccagctaatttttttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagatggggtttcaccgtgttagccaggatggtctcgatctcctgacctggtgatccacccacctcggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggccagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtgtgtggaagccacgggctcaagcagccaaggcagggtggacagtgtgagagagctagtgtaagctgttgatgagagctgttgctgaataaaaccatattcacctgcctatgggccctgagtgttctttctgtccatctacccactcccctcagactttagcacgggctggacctggaccccaggacctgacaccaagtgagaagaggagcagcccagggatcaagggtattcctcgtacataaggtgcctttgtgcaaattaggaagaggtgctcctgcagatggacacattgcagaaaggagtgttcagggctgattaattgagaaaagctgttccatctccctgtggaag

SEQ ID NO: 12629 - DNA, 34658 bp, Human
agcttgtcaatggcttgggtcaaatttaacatcataattcaaaagcacccaaagaacatatcctaacagtaaattagtagtaccccttcatattaaatgaactgcactatgttttaattgtaaatattgatatattaggcattttgaaacttaaataaggaagtagagttacatccttgaaacattgtataaggaattttgtaagatgcattaccttaccactcacagttgctctgataccaactcttattaaaatcatttttttccatctgtggttgtcccatcccataatatttaataatattaagatagttttttaagaaaaggtaaaatcatgactcattcaaatataaaaccaaacccgtgttcaagattttatttaactcaaaatggaaccaggcagagaagataaagaaaatcccagaattagacaccttagagcaggaatattgaaataaatgtgcaaaaggaggcaaaacttccactgaatctctgagagaattcgcatgtcttgacaataattatttagcattgatgtcacttacctagtttacgtaactgaaaaatagcttttttagaattagttattccaaggggtgttaagatagaatctaaactatgtagttttccattgaagcacacacttctccccataataatataatgcacagcacctgtcagggatattaaccatacatacccactcaaatgctccctttcccaccaagcttattaaaataatagtttgtggccacaatttcttcccttctcatttatccaatacacagcaatcttgtttcaaaactcctatgctgctacagctgtccacagtctcatcatacgcattctttgctattgcaattttcttgaatatggaagattagctgaacatgcattaagctcaggaaactctaaagaaaatcagataatgtagacaaaagtctaatttctaggctggctgcagataccttgttcaagaagcgccggcaggatcttcttttgtacagctatgttagctttaattttgcacagctctagacatcagaactcatttctaaacacttctatgcagctcaagaataaaagtagcagaaatgcaagagagaaaagctaattcccacttggtgaaagagcacttaagtctcagtgagcaaacaaggaggagtcagccttggtcacttccccctcaagcggccagagagcggaaacacaaagccaggccagtgtcactccagggattgcgggaacctagacaacgcaccatcctgggctcagcgtctacccacccctcacccgaggtgctctcggttccgtagaatgtccagtccacaggaacggcaacacggacttgtctttgggactacaaccagcaagagctcccgcctgccccatttcacctgcaccctagggcgcccgcctccttggctacagcaccactgttcctagtgcccgccgactgcccaccctttcacttctcgtagagacggcgtccccgacaacgcctcgggaaagaacctaaccaacatgcgaggaagtggcgccaggctcgttcttcaagagaagtgacagaactaaccctcagcctgcaatcctgaccagggccgagtcccgagcgcctcggaccgcgcccccggccctctccgccccgccttccctcccggcctcagtccctcctctcacagcactctggtggtcccatccgggcggcgggcggcacggatcaggctcctggtagaaggcggccgagcgacatctccggcgaccctcagcaggagcgcgccgagtacggcgagtcaaagtcccaggagactggagtgaccagctgcaaatgctctgggctgcgaaacaccggcttccgctcctggccagagctcaccaatcagcgcccggctttctccgtcatttcctcctagaaggcaaagggaacctctggcggaagaggcttccggaacggacccggaaggggcaggtcttgtgggcgggtccaatcggctgggagcctcgtggaggctgaggtgagtcctggaggtgcgtggttggggcggagagcattatctgcggctccgattttgcagattctggctgaggcgttcgtgatgtcagcagcagccgagacgggcgtgttaaaggccggttgctagggctgggggaactcaggtaactacgggcgtccccacagcagtacttggaagcccctcagctactcggcgcggttgcgggtgctgagcagagctgcctgaccgtgcgtgtgcacgggctggcctgaggatgatatgaccgtgtgttcggtgtgtggaaccctccgtcaccctcccctgaccgaagactcgtttaggaatgtgtggcaggtctgttgccacggtccaggccttcagtgcatcttggaaacatcgttttgggggctgtaggttaggaagcggagatcatggggtctcggaagaaggtttggtcgtgaactgtcagaaaggaggcgaaagctgtgcacgtggaacaaagtgaacagtgcaagttgtatgggaggtagtttaaatatcgaggcgatgaaaaaaggctgctagaattgggcttactcgaaaggaagtgggcctcagaagataatattagttaaaagaagtagaggagaacatggatgttattctaagtaaaacgaataatatgaagaatacaaggtcgcgggacgaggaaggaaactagccagcctgacaggaaggtttattcgagaaatacgggggttagataggatgagtttttggaaactggcaaacgatttagccttttcaaggctttaggatagggaaagctcatttgaaaagattagtcggtagtattatgacgtttaaatgaaaagagtgaaaaacatggaggcggaggtgctaggtggaaaatcagtgcagtaatccagtgataaagagctggaactgaaagtgctggagagaaagggatcctgtttcagagtaacagtcaggtggaattgactaaagagaaagaggcaaagagaagcagtttagcatagtggttaaaagcagaaattttggagttagactggctggattgggatctggctttggcaattagctgctaaatgactttgagttagcaatttgccatctctgggtctgagttccttgtctgtaaaatagagataggaagagtgacttcccttgtggtgttattgtggagaatttgtttatttatttttagagacagagtctcactgtcacccaggctggagtgcagtggcgtgatcatagctcactgcaacctcgaacttctggactcaagtgatctttctgcctcagcctccccgagtgcgtcaccatgcctggttaattttttaaaaaatgttttgtagagataggttcttgctgtgttgcctatgttggtctgaaactcttgactcctaggccttggcctcccaaagtgctggcattacaggcatgagccaccataccaggtccttatggataatttttttatgctcatatttacaatgtgctagaggcttttctaagtgctttgcatatgttagctcggtttcattaattgctgtatgtaattaaacaattgcataatgttatcagttactatagcgtaagcactctctaaatcttggctgctataataatatttttttattaataattcaaaggttattaaatggttttgagcctgaagagctgggaaaattgtgtcttagtgtcagaagaaaagagaggggtaccagaagtaaggtaggcttggttatagacatgttaaatgtgaaactataaggtattcaagtggagatgttcagtaaatattggaaactctataattagtattcatgtaggtggaaaggactggaaatagacagatgggagtccctggacctaggcatgctatatgaattctccaaggaaaacactgtagaaggaggtggtagatggccaaagacagacaaacataaggaacaactacagagtctggaggaataagaggaattgggaaagaattaatcaaatggcctaggctaagagcattatcaccatgttaatattatctttccttgattttaaattggctttatgttggttcctgtgagagaagcaatgaggccagtaagtgattattaccagaaaatattatcagagagttgagattgaattttttttgtgttagactaaaacagcatttgataattagaaagaccctgtagagttaagccaaccaaccaaagaaacaaaaaacaatagcaaaaagaaacagctcctcataaaagactgtaacttctttatttttgtgtgttttaagttgcatgggtgttttttggggatactttttactcttccatgtaaagaacagatgggactgatttgttatctccttcattcacctcttgtcccttttataaataaccagtggattatggattttcagtgaatttaataaaagtgcagaaattatggcatctttccaaaaatagtgtgccaagttgctcaaccattttctatgccaagggtaagtggctgctctgattttgaaatgaaggacagactttcatgtactagtagttctcaaagtgtggtccaagaactgcaatagcagcatcacttggaaacttgttagaaatgaaaaattctaggccctacctcagacttatgaaatcagaaacaggtgctgggagaagagatgagatggtgttttctagcaatgttttcataagccctccaggtgatttggatgtatactagagttagagaaccactgtacaagaaggtaagtaccatgaggttagggattttgccttgttaatagtgtatttccagtgtctagaatggtgcctgtctaattggtaggttttcaatagatattcattgaaaaatatgttcagtctcagactgccaatctctgtgtaaaagctttgatgctggtttaatgggcagaagtaaatcagtttagctgcattgagcctataatgtcagatatgcatgaggtgggcatgacaacgtgactaatttggaacttgaggaatgagggattatattgagtcaacactgaataaaaaatgatgtccaggtattttaggtcaatgattcatttagagtaaataaagattaagaagtcacaagttacatgcttttaatgacatgatcaacagttggtgttgttctggcgcagtggctaacacctgtaatcccagcactttgggaggccgtggcggatggatcacttgaggtgaggctttcgagacgagcctggccaatatggtgaaaccccatctctactaaaaaaaaaaaaaaaaaaaaaattagccgggtatggtggcacatgcctgtagtcccagctactcgggaggctgaggcaggagaatcgcttgaacctaggaggtggagtcagctgtgagccaggatcccaccactgcactccagcctgggcaacagagtgagactctgtctcaaaaacaaaaaaacagttggtgtttactaacctagtagaaccaaggcacccaaggagctgagttttctttgtttatatgcacagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaaggtgagcctaaaatgaccagtttgatactgatttattggtatttgaggatggagaggtagtagaagtgggggggctctgatttatttatcatgagtttttttgtgtctgtgcccttagaagaaaaatctttttcctttaggtctagctagccaagcatcaagttcctttgtgttcttcgccactgaattctgaaaaccacaatgaaataggagcttatttcttagatgtctatttgttggaatatttacaggtcattatttgcagtaattatttattcctgatgtattttttctctaccaattctatttttcaagctcgacttatgcttatagctggttataaaatattaggcatgtaaaaggaaggttagtctattttggcagaatctttttctaatatggataatgcccaagtgttgttaaagtagactttgatactttgtgtgactgaattccctaagcctaccacttttgccaaaccaaatataggcattttgatattgtccattcattttgtgattcccaagaggttagtactttgattcttgttgccaccaagagtcctttgtggttaaaaccactgcagtactctgttgccacacagattattttcttataaaatgggtctcagttaaaggaatttataaacctttattgaaaatcacgtagtgttgttctagggttaagaattagattaaagggattaaatttattttattgcctagggagtttttatatgtattacaacaacgtagggctttggagaaaataattaagccttttcttaaatgtttcattgcctagtacaaatactaatttctatattaaaaaacttgaaatggattgtggagtttcatttttattcataagagtaatttggaattattggtgctcttaattttactgtgcctgagtattcctatgcttttcccttgagttcatgcttaactcttctacattgtttttaatttttatgatttcagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggtgagcctttgaatcagcccaggctttgatctattaaaggaatgtaaggcttatgctgaagcaagttgttgacaaaaattgtcaggtaaaacaatgggctgtcaatatacaaagtagtataatgatagagtgaagaggatgggtgtgaattgggtggttcattttgtttccttttgttcattttgtcatattttctgataaaagcctcttaagtgtaggaataagatgaagagagccatgataactcttattgtggaagtgctacgcaaaacagtaaaataaggaaagaaaacaaagactggaaaagaagagacaaaataattatttgccattgacttctgtaaagtcagtagaatttcctgtatctcacaagtcatgagttagaaaatataaaagattccattcacaacagattaagtaacagacataaaaataccatgaaactttactgaagaatggaatagaagacttttatagagatataatccatgttcttgaatgggaagacaaggtattgaaaagatggtagtgttttctaattgatttatatagctaaagctatgtttagacatatgtttatatagatacagatatatttaaatagatatcttaaaggttttagttgttacttagaacttgacctaatatggaaaagcaaaggaattggaaacactaaaatttgggaagaaaagaataataaaacaggggttttagatattaaaatgtcatataaacccataatttaagaagtatcatattgatacttcaatgcaagtaccaatgcaaaatagattattgcaaccaaatggaaatctcagaaacacatccatgattacattcctaattagtatattttaaagacgacattttaataagtagaaaaatgatagattacttataaaacagtccttagacaattggctatttgagcgaaatttttaaattaaagctttacctcatgctatataccaaaatgaaacaaagattaaagacttaactattaaaaaatagcattttaaagtaaactagaaaatatgtaagtaaatatccgatagcaaggtagaaaaggactttattagcaaagaaataaattaaaaaaggaaactgttggtagattggaatacttgaaacatttgtacattaaaaacaagtcagaggacactgaaaaagttaaaatatttaatattttcaatataaaaagaaaggattagtatcattcatctattaataacttacagtcaaataagagatgacactctaagaatgatagacaaaagaaagtcatgaattggcaattcaaaagagatactttatggccaataatcaccataaagcatgtaaaatatttctcatttgtattcataaaaaatgtaaattaaaataaatattaagactgaacattttttacttatgatatttgtagtagtttttgagaaaactaataatagagttaaatgaatggggaacaggccttgtcatacatatccctgctggttctatagatttacccaacctggagatcattttgatagtatgaatccaaaactttaaaaataaacatatcatataacccaagagcttttcattttagttttttctaatcagagatacatacagaaatttgtatataagaatgttcacttctgcatatttataacagcagaaggttggaaactaaatgtctgaaacagaaaaatttttaaataagttgtgctattactttagaattgattattatgtgagcattaaaaatgtgaacactctggaataacatggaagaaatggaaataatattaaatgaataaagaaaaggttgtaaaatgatatgaatggcatgattttagtcttctaataggaaaataacctggattatacataaagactagagcaataacaatgtctggggattatttctggttggtgagaataaggctggtgtttattcccctgtactttccccatgctttccaaattttctgtaaggactgtgtattgcctttttaataattaagtctcattgtttgtcaagttgggccatatatggtaaagaaaattatttttcatctgtattatttgatccctttaggacacagatattattgtatgggatgtgatcaatgaaagtggtctgtaccgtctaaaggggcacaaggatgccatcacacaagcattgtttctacgagaaaagaacctgctagttactaggtaaagaaataatggtttaatttccagttattttctaggaagagagaatttgctttattccttactcatttctctcatgagcagtgtgctcatgcttatgcattagttttctctcctgttctcctgcattccttctttccatttcttctaagtagtatcgtagagctatccaaagctatattatttttaaaatcatttttctaatttgtcattcttttttcttgatatcagtttttctgtgtttcttagccttttgaaactcattatagaatgagctttgtctaccttctagatctctagaaagccaggaatcagaatatggagcagagggaagatatgaataccaggtgttaaattcggcttgccttttgaggagagatgtactgtacttcataggccttctgaacacctattaggatgaaccatttgaaatttttatttgtgtacataaaaaatcatcaaatatcaacaattttatattgttcaacctaatataataatgaatattcctaaagaatggccacctaggaaaagctgggataccaaggtttgccaggcattaattagaggaaccatagtaatgactcagaaaaagctgtgagcactaaatgctttaccaatggtggatttgtttctgtgggataggatacaggtaaattagtgtcttgttcagataacacaggttctgtaagagaatgattctatagttctaatagaaaaaatatatattacagcttagggaatataaaggcaaagaaataacactgtaaggtggggttatatgggacggactttgtaaatcaggtttttgagcggtgtttttttccagtttgctcatgaaggaggattatattagatttatgtagtgaggaggtagggaagaggtgtttgagcaggagtagtagaggccattggctgcgagaggttatatttagggggttaagaacaaataaataggaaattttgagactgctgccaatgagcctgactttgattctacagggaacattgagctagtgcaaatattaaaaattaaggttatctgacagttgcacattggatgggatgagagaacagcaatggacaaagagaccaaatgagaagctgttaaaataatccaggtagtaggacttaagttcaggttagtgtacagaaatggactagaggagttaatacttagaaacttcacagaggaggcattttcaggacaagagactaactggacaggaagacaagggagtgggagcggtctaagatgtttccatggtagactgtctgaggggaatgccagtgctgtgatgatggaaatgataggaggaaggcctgatggatcaaattctgtattctttggtactctgcatctaaagtcattcttgtgcttataggtggaacattttattttctgcacaggaataactacaaggaaagttaggattctttgcttttcaaaagtaagatcagagagaatcggagctttagacattattgaagcatatgttccttttaaagcaacagtgagttttggatctccctattcgttgaatgagttttcctaaacaggctatatatttttttcctgtttcttcttttagtgggaaagataccatggtgaaatggtgggaccttgatactcagcactgctttaaaacaatggttggccaccggactgaggtaagtgtagggtcatgggcccagggaaataatgggaaggcaaaagggaaaaggtggtggtcttctcttcccctttcatggctctttgtttttagtgcacacagtaattatcatatgccatcttgagggacagtgaggctggtatgatggaagcaatgccagccattggagcagatactgctgctctgacatgtagtaaaaattggccttgcgtggtttttaattcctgagtttcatcatttctaaataataagtgtccacttttatgaatgtagggaagtttaatgatattatatgtgcagcacctagcttattgacaggtaagcagcacgtggtagctgttaaaatagttacttgaacagagatctattcagttgagttcagggactgttttttatatatctttgcatcctcagtgctttattcatatcaggcattcaggaaggtaatacctagaattaatgacaagaagattaaattctttgttgatttgcaacaatattattttcattatttaattcccggatacttgaagctgaaagttatgcaatggacattagtggggcaccttttatttgctagacactgctaaaagcaaagaaatagaagacttaaaatcatcatttgagtggattctagttaagatttatgctgaacagccattatcttaatttgattatacgaggttagagacaaactgctagtatcacaaaagtaacaatttcaccgcaggccatttttttctctgtaaaagtgagacttctcttagtgcattttgaaagggttgtcgatatgccttttctttgcctttaaattgctagacattttactacggtgtaacagacttttggaatgtcatattatgctacctggaatctcttgaaaatcgtattactcaaatctttttatattctataggtatgggggttggttctgttgtcagaagaaaagcgactcatcactggggcctcagacagtgaactgagggtatgggacatagcttatctgcaagaggtaattacttcttaaaatcatgggcaatatgtttagaagtttcataagcaccttggatttagaatcagatgtaattattcagtacttcacatcatattagaaggaattctatcacaccaataacctgcaacacttaaaaaagcttttcttccttatatgctcattatccttatttatttgagctcaggttagctttaggcttacagcttctggtaatactaatgttttagtttgtggcactcttaatcagatattcttggacctttgggtgtccatggatggccttcagaatatctgtgaacctttcccctcaaatatatatgtagaattttatgtttataaatatgtatattctgaaaagatctataactttttcttagacattcaaagaatttacatagaagaaaagcttgcagaccttaggtttagctgaatttcggtgtgtgctgggtccagcagccatttcgatgggagttacattagtaggctaggggttatcttttctttatttaaggagaaaatgtatctacctgtcttgcgatgcttttgcaattcctaatgccaatttgaattttttgttctataatatggtcaacctttcacctaaatacagaaaattttgaagttagtgaagagtggggtcattattttttcaccattgtcactaaacagtagtccttatgctatagaaagtttttggagatagtataataagtaatattttgtttgtatattatgtagtcagtttttaataagttctgatacctgccttgctactgaagaggtttgataagggagatcactgattagaagctgttattggccataagaaagatttctaagtcttcaggattaagagttacctcctgggccaggcacagtggttcatgcctataatcccagtactttgggaggctgagataggaagatcacttgagtccacacacacgtttgaggccagcctgggcaatatggcaagaacctgtctctacaaaaaatttaaaaattagtcaagcacagtggtgtgtgcctgtggtttcagctatttgggaggctgaggtgggaggatggcttgagcccaggagatcaaggctgcagtgagatgtgatcatgccattgcactccagcctgggcgacagagtaagactctgtctccgacaacaacaacaacaacaacaaaacaacaacaacaacaacaacatgcctcctggaacatactatttcagcttttattttctcatttttataaaacagattgaagacccggaagaaccagaccccaagaaaatcaaaggatcttctcctggaatacaagatactcttgaggcagaggatggtgcctttgagacggatgaagcccctgaggatgtaattcattttcatttcttaagtttaattgtgttgaataatgggaaagtaagaattgcagatttttagggaatcatcactttagggaatatttttgtcacttgcacttattagaattatgtttttttcagaagttcagcagaacttacatctaaccttcatctgctcttgcttcttctgtagcgaatcctttcatgcagaaaagctggttccataatgcgggaaggaagagacagagttgtaaaccttgcagtcgacaagacaggcaggattcttgcttgccatgtgagtaccatacttaggagaaaataacaaggactaggctgttccttccaaacactcattctttcatattcaatgtaaagatgactttttcttgactcatgttaataattcattatatggtactgtgtggacctataatctctagctttattagcataacaacaaaaatattaataattactattaggttggtggaaaagtaattgtggtttttgccatttaaaaagtaataattgcaattacttttgtaccagtattattattagcaaccatttattaaatgcttgctcttctaagcaatttaagagcatttaacttcttgttcagccttcagagcaatgctacaagtaggaaatggtatcctcattttacagatgagatagcaaacccagagagattaagttgtccaaggtaatacaactactaagggaagaaaaataaatattgttgtttacttttaattgagaattaggtaaattacaaattacctctccttgactcacattaaccttttgcctttctagggaactgactctgtgctagaattgttttgtatcctttccaaaaaggaaattcagaagaaaatggataagaagatgaagaaagctagaaagaaagcaaagtatgttttcttaatacttacattaataatgaagtatcctgggtaggccccatgttactgaaaaaaaactggcttctttcatatttactgtcttatcaattaccattaaaagttaaagaacttgtgaggtatcgataacccaaatttgtcaagtctcagagagacagaaaatcatctgatttggcaaatcttttgatacctattctggtttatttaacatggttggattgttaagtgcaggttaatgagttttctaaaaagtcctgaaattagaaaaataaccggagacatttcagtggaatagttggaattacaaggaccttgttacaagaaattttatgggctattgcattcagaatccatttcttaagggtacctattaagtgaaataatactttatgacattgtagtgtacaaagcatttccacttatactacattgtttaattatcatggtaatcctgtgtggttaagtgacttttccagaataacacagtttgttggtcaaggggccagattttgaactcaagtaagagcaaagctgcttctagaaaaataagagcatgatatacttttcttcttccctctagattacattctagcaaaggagaggaggaagatcctgaggttaatgttgaaatgagtctgcaagatgaaatccagcgggtgactaatataaaaacttctgccaaaatcaagtgagtaaaaataaattatctgaagttatagaaatagtaagctaccaagtattattggctttttcatgctatttgtaagctgtctgtatgaattatatatgtggagacggtggtcatgagacatctgtgtcacactctgctcctgttgtcctaatcatgggcccactttttgtcttgtatttggattattatagtaccctttttagctagtcatttactgtcttttcctgcagctaatttaagaaaaagaaaagtgtgtcccacgttcagaaaggatataaggtcacttataaagaatacatacacagaaccaaagtatgtatcagaaccaggatctgagcctagttttttttttttttttttttttttacttaaaagcctactcagctactactcaatactcggagcactcttttaattttttttgagatggagtcttgctctgttgcccaggctggagtgcagtggcatgatctcggctcagtgcaacctccatctctcaggttcaagcgattctcctgcctcaccctccgcagtaactgggattacagacttgtgccaccacactcagctaatttttgtatttttaatggagatggtgtttcgccatgttggccaggctggtctcaaactcctgacctcaagtgatccacccgcctcggcctcccaacatgctgggattacaggcgtgagccactgcacccagcctcagggcactcttacttgaaaaattgtttatagttattcaaactttatatagatagaggacattgtaaagccttttcctggaaaaagtaaaccttgtgagctaagatggtagctagaacatttatgattattttcttgtacaggtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggttcgtgaaatgatgttttatatagctgtagttagtagtatttcttttaattttttttggtactcttaagggttagttattaactccttaaggccctaaatacaattatctttagtgcatttgggccattagcctgtggagcttagagaagaaaaagttgccttttaaaatgtggtgcaaaaaaaaaaaaaggcaagcttattccatgtttagagcttgtaactgtacttggctagagaaaaacacacaaccatactacctactctttaaacttaataaaaagcaggctgttattgctgcccagtaattgtaccctaatttctcacccttcttttactttcccagatgactgttttataccttgcttctgttgtcaaatcaaatacctccaaaaccttgaagctaatgatcatatctcccaccttaaaggaaataataaccctctctcacccctgcattgctctccagttactaccccattctctgatttgttttctccattctgtcttcatctgtctcccatcaagcttttgtccccactgtttcaccaaaacagtcattgtcatcagtgatcttgtttccaaatccattgagctaaaagctttattttatgctttgtccttgaattgatgactttctgtctttgacacactctttgactttcattatttccccttcccttgctgtctgtttattctcagtcctcgctccatctttcttatctttatgacgtctaagtgttagagtgctttagggcagagtctttggaccttttgtgtatctaaactcactttatgtaatctgtcatgtagctttctctgtatgatgacacataaatttatatccagctttaacctcctccctaaacatcaaattcatatatacaaatactttgtgtcaccacttggatgtctaattaagcatttcaaacttttatgtgtcccaaaccaaacttacgttgttcatgtctccaaaaatcttcccacctgctattccttcagacttccctatcttaataaatgattacttgctaccagttgtagtctaaaccttgtagccattcttgattttcttttatttatttatttattttgagacagaggctcgctctgtcgcccaggctggagtgcattgatgtgatctcgcctcactgcaacctccacctcctgggttcaagtggttttcctgtgtcagcctcccgagtagctgggattacaggcgtgtgccaccacgcctggctaatttttgtatttttagtagagacagagttttaccatgttggcctcaaactcctgacctcaagtgatccacccatctcggtctcccaaagtgctgggattacaggcatgagccaccgcacccagcccattgttgattttcgtatcccatattcatccaatctattagcaaatcctatcagctctaccttcaaaagtgatcccaaatccagcctcatcttaccacctgcactgccactaccccattcaaaccactgtcatctctcatctgggttattgtaaagccccctgactggtgtccctgctttcttgcttgcccctctatagtctgttctcaacacagtagccagtgtaatctttttatagtggaagttagatcacttccagtagttccatctcactctacctaccttacacaccttatctcttactactctccttttctgctccactagagccacactggtcttcttgctattccttcaacagaacaagaatgtgcctttcttatggctgttgtgctccctgttctttctgcctgaatccatcttccccatttatccataagctttttctgtgtcttatcagatgacagtcctatcattcttaccctactccttgcactcttcatcctcttctcccagcattatgttgctctatagcacctaacacctgatataccaaatatttagatatttattattcccaaagaatgttaacctttatgagattaggaacctctgctgtttcatccactgttgtatctccagcacctagaacagtacctggtaatgtagtgggcattcagtaaatgtttgttaagtggacatttgatatatatttgattaattaattaatgtttgtggtcctataaaaaatgtagggatatgtaatgatgtactaatttgacttgtaatccttcagactcactcacttcttggtaatggcagattgggctccgtggagcccagcagacacttttctactctgcttttgtgtgatttctgttccttaggatttggaggccttataaagtaaacaaagtttggtgctttttagtattttctcccatgactataattgtgtgtgagtcaagggtttttaagacttttatcttcttttatgttgatctgtctaagtgcattgaaacctacacactgacctctaaaatggggatgcagattctcttaacatgagttctttattttttctttctcataggtctacactgcagtgtattcgcacaatgacctgtgaatatgcactttgctcattctttgtacctggtgatagacaggtagtcataggaacaaaggtaaatggagactttttctgggatatctggatcttttctactcaaaattcataaagttaagaaatctggttcttctttttagcatattggaaatggactggagctaagtaatctgggaggatgttagtttattacatattttgtttactgaagttttactttattttttaaaaattatgaagaagaaaattaaaatcatgaccctgagataactaccattaacattttggtgatcatcctttcatgtgtctttttatgggcgcatatgtaattgtgttttaattaatgataaaatatattaagggtaataattaaatatattaagtacctaatatcatgcttggcagacagaagcattcagtaaagacaaactgatcaagtccttattcctaggtgctagtcagattgggagacaaccatgtggaaataagcagatatggatttggatttagtttctgccctttagaaataggtaatttgggccgggcgcagtggctcacacctgtaatcccagcactttgggaggccgaggcaggcggatcacaaggtcaggagatcgagaccatcctggctaacacggtgaaaccctgtctctactaaaaatacaaaaaattaggtgggtgtggtggcgggcgcctgtagtcccagctactcgggaggctgaggcaggagaatggcgtgaacccgggaggtggagcttgcagtgagccgagatagtaccactgcactccagcctgggtgacagagcaagactccatctcaaaaaaaaaaaaaaaaaaaaatgagtaatttggagcaagtcacataactgctcatagtgtgttcctttatattatgggatgacgacacttgctttttgacagcagctttcgtaccagatggactggtaccagcctctggcacttactagctatgtgaccttaaccctgttagccttggtgttctcgtggaaaatgacgttactgacccatttcacagagatgaagtatacaaaactcttagcagagaaactagcctgcagcgaatagctaatcgataatagagctggtagcagacatagcagtagtgattgtaccagtagtgagaataaaatggaacaaggtctatggagtgttttgaaaagtgctttgcaagtatttgtcattattattcccataaaacaaagccatatgtacatgagttttattacaaaatgtatggatcacaatggatatttcttgcttcaacaaaaaaatgtaggctggagagattttaggaacaatgccaggaaacagtattcacatctcaaaactttccttcctttttcactctttcaacaaatgtccatctctgatttgccgtcgggaaagtagttttttaattgcttaagactacccatgtggctaaaatgcaattgtcggcttactggctgtgctaggcaattaatgtacattatctcatttaatcctgacaacatctttgaaacattggtgatataaatttcattttacagatgaaaaactaggttcatggggatgaatttaccaatgggcacaaagcagacctggtactcaagtcttttagcttatgctgtctgtaccaccttgtgcagaagctcatcgtaaaacaggctttgcctctgtgtgtgttacatgctgacaccatgactatggcatatacagacctctaaataggaattttagagtgattgctttctatgccattatgatttttttttaaattcactgccttccttagtgctgtaggtagatcccatttcttattgtcaatgtattgcagaggaggaaaccaaaagcagatggaaaagaggtggttgcttaagccaataactatagaggatcatccgcttaaaggattggctaaactttaaaggcttttaggtttgcatttgctattttgtttattctgatttgcctatggtcatgatattttccttgtgaagttgtgtaaccaatgaaagtaatgcatccagtactgcatggtggtattattccatacttctacactatggtagccctgccaaggttaacccagcacatcagtaggggatttaatagtatttaatcaggtaggaaatacagaacatggaatgtgggatccatttcctaagcaatggatcacatttttgcagcttggttatgaagtcttttctaaattgtgcagtcatgaatcatggaggttgtacgtatgttcattggagctgtgctcattttgtgtcttcccagacagggaagctgcagctttatgacttggcttcagggaatctgctggagacaatagatgcacatgatggagctttgtggtccatgtccctctctccagatcaggtaactaaaccagattttaaagccctggagttcagccctgtggctaccctgatttctctcagggtttctttaaagaaagcctgaggtttttttttttttttggtctaatctttagtgtttgtatatgatgccttcttataaatgaccacctgtcattatgaaatgaaatcttgtttggctacttttgcttatcagcagcgtgacatcaaattgcttaccatcatgatttttttgccaatgttttgtaatacttcttaagggggaatattctcttgggcaacatgatgcagagaactgaatagactttgctgctccccttttttcctcaaacaaacatctatgactgtataagctaagtagttttagcaagtatgtcagcccttacaagtcaataaatatgtgctcaccttcagagcagttcctggcaaaagtatgcttattctaataatggtgctgttgcttagaaaatcttgagatttttttttttgacaacaccttaagaaattttggcccatttatttaaatattctcaatgatagacaattttcatccgttgaaagtagaacttagttttggaaaaaatcactgaagtttagagtgtttaataccacttggggtccaaacgaaacagctgtgagtctaaaatagtaataaatcttgcatttgtagagtgttctatcttttccataaactgtgtggtctttttttcaacaaaactagggatttacggaaaggttgtttcctgtgttataaatctatgagggacagacacttgagatccagtgttctatgtactttacactaacactgccatgtaatgagactaattttcttgataacggaaaacagcttcaaaactattttaagtagggacattgcaggactaaatttatatccttctgaggtgaatactttaaacaaatctagattatccattctatgtatatttttcaaactggtttactgagagtttttgtttcttcttgatgctagataatagtataactagaacttttcattagttattatttctgcctatgttagtcgatggtaggaattttcacataaggtttgtggcagcagacccaaaagatcagtgaaaggggctagggagaaccacgtttttcttaatttttatcccatgacgttaaataaaaatactttcttagacttttaaaatgtatcttcatagcaaagtttttatgctaaaatagtttttaattgaaatttcatttgattttcagcgtggctttgtgacaggtggtgcagataaatctgtcaaattctgggattttgagttagtgaaagatgaaaatagtacccaaaagaggtgagtagacattttttgtgtccattttttggagtgaaaatggggagctatggaatggccttttgacgtcttatatcatttgttgtgctctaaagagttaggatttgtctgaatttgtatactcatttattttttcttgatgttttttgtggtgctagactttctgtgaagcaaacccgaactttgcaactagatgaagatgttctgtgtgtcagttactctcccaatcaaaagctattggctgtgtctttgctggactgtactgtgaaaattttctacgttgatactttaaaggtacagtggttatgcctgcggatattttccctttctgactgactgaccttaagaatttgggttgaggctataaagaagtggccttgactgtgcccagcgatagtacatttctaaaaatgtgtgtgtgaatcaaagcaatgtaactatgctagggaagctagcattttaaaataattctatggttcatgaattttgtttaaagcaagttatatttcatatgttcaaaaaatcttgtggacagaaaattctgtcatactaagtagttataagagcattgctaggtgtcctgggcagtgatttcacacttggctatatattaggatcatctaggttgcttttaaaaatatagattactgagccctatacccagagagttgataggaccaggttgggcctgggaaatttttttgtgaaacaaatgccctggaatcttttcagtgaggagatacagagatctgactgaggcagtaagcttctgggggcttccttgcctccactatactgcagtattcttggcaagcacatggagggtctgtgtagtggacacaggtactcctgccaagctgtcttttgtgggttgtctttgaaaatacagatataaagcaatttaaaaatgtgtttaaagttatattttagacctacatgtaataaattatacccatattttatagacagacattaattatgtttttttgatgtttagttttttctgtcactgtatggacacaaactgcctgttatatgcatggacatctctcatgtaagtagtttaaatagtgtctcagtaatatgttgtcttttttacagcagatactttcttaattctggcttgatgtcttcatcttagattatttgtttttatcatcattctgttatatatctttctccaaaaacagtctcaaattaatatatattgtatcttatatatattactttaatgttttcagaataattttgcaaatatcatctcaatcaatccttataaatattatctctttccctcttgtagctctcccaaatagtactttattgtttaaaatactataattggtagagtacactaaaatatgaaagactttaaaaaggcattcctttttattctgaaggataatgctgctgaggagctcggatttatatttggatagttacggtattttacactatgtagacttttggtctcttgaccaaaatcatttatttcccaatacctagttttgattaggagtggcaatgtatattaaaaacaatgtctattctgcagagtgagactccgtctcaaaaaaaaaaaaaaagtctattctgtgtgaaaggagttgacctcatagctgtctgtggtcagtgcactaacaaagttaagttacaatgttaaatgtatttcttttttttttttttttatgttgacaaccatttggaccacgcattgaaataggagagataagagaaatactgatagggaatgtgggctacataaacattctagtagagtctttctcagcttctcttctgtttctttctcccactttctttccaaatcccatgccagagattagaaaatctttttcctatctaacgaagtaaatagataaccctatgtcaaggcacagcactgccctgtgacagtacgaaagtatttaagccacagagttcgtgcttttacttaacaagctttttaagttcctctgtaggtaagagcaaagaattcagtgtttttagtagagatgaaaatcagttttttggcttcattttaatgtgtttgaaagaaatgggttaaatattctggttagctttttattcatatacggaattcaaaaatcaaggtagtgttttacttttatttctcataggatggagcactcatagcaactggctccgctgataggaatgtgaaaatctggggtttggactttggggactgccacaagtctctctttgcacatgatgacaggtatgtatagtcttttcaaatgtctccctttgagtcacctgtaagttatcactttccttgagcatctgtgtctatttttcagtgttctcaggcagtgatacaagttctaaaatatagtcagacaccctagaactagctagtcaaaagctatttatgtgtgtaaaactctttttactaacctggaatttgatgacattttaatatttctgtcacttttcagtgtgatgtacctacagtttgtacccaagtctcacctcttcttcactgccggaaaagatcataagattaaacagtgggatgcagacaaatttgaacacatacagactctggaggtaaccacatgccttctgtgcttgcttggtacttaagaaatacttttaagaatatttacattacccactaagtagtggtcaatgaatgaggtattctttattttttttttctcctccagggtcatcaccaggaaatatggtgtttggctgtaagccccagtggagactatgttgtatcatcgtcccatgacaaatctctgagactttgggagagaacaagggagcctcttattcttgaggaagaaagggagatggtaagaactttaggcttggttacaaatatgccagtaggtatctgacaggctgtcctagttgaagttttctgtctagtgcagttacacctgatgcattgccaagtccaagaaccttcaggagatcttttcaagaccattgtcacccatttcagaagctaggcagagataaagatgccattagggtattatgttgtcaaaggagcagcttctcgcttcctcatttctcttcatatagagaccatgtttttttctctcaaattaatgtatatctatctcatggcaggaaagagaagcagaatatgaggagagtgtggccaaagaagaccaaccagcagtaagtaaattttggggaccttgagattatgccccatatatagttatcttattgaaattgactataatgtccagaatttctaatagaattaaaattgaggctagaagttgcaggtatcaccagctgataaagaatctgtgtaattctttctcttcaactgtatatcctaattttgtggttcaagtgattgaccaaatttgctactgaataattattctgtcaattgagactttagggaattattttattcactgtagcacaaaaataaaaattagaaaatttggatattctctttttaaacatttgcaggatgttcttacaataatacatatgctaagttctgttactggtagctgataacactgttagtattttcataaaataataatagctgttctcatatggatgtaagattaatttatcagctctttaactcaacagtcaacagtgttattcaaggatttctttgtttctggcaggttccaggagagactcaaggtgacagttactttactggaaagaaaactattgaaacagtgaaagcagtaagttgatatagaatgtggtatctcgttttttaataagatctcaactttttagtaaaagttttattctgtatcaaccagaaagccatttttttggcaaaaagttgatgagatttaaagatggggattataacctgtttccttctcttgtaaccaaagatgggagtagtcctgaatctctttgatcaatatgtgctcctttcaggtgttcctgggacctgccctattcagagtgtctagatatcatcccacctgagtccatgacactcagtctcttccctgtacattaaaaaataagaaaaccaaaaatgtctttaaatgctttttggcactctattcgcacgtctttattaaacagattgaagctatttcatttggcaaatttctggtcagttcttccagtttcagtgtcctgggatgatggagtatgttgtgatgacttctttcctttctcatcctctgtaggctgagaggattatggaggctattgagttgtaccgagaagaaactgcaaaaatgaaggaacacaaagccatttgtaaagctgcagggaaagaggtaataagagagtacagtaagttacagtatcaataaagggaattcccaaggagaaaaaccattgttttgggatttattaactaagatcaggatatgcaataaatggaatagaatctttccaactcactatattagaagaaattgaggaagtgtgggaagaagggaacttggtcttaatgaaagcgaaggaaaggaaattacagattgaggtgattattgtcttgagtagaaacccacgttctatgttggtttgggaggcagggtaaccatttcagatttctagataaaatacattgtccaagctcattcatgagtactatagaaactaacaggtttgataattcttttacactctgtcagttttttagggtctcttttttcccttttcaaaattataaaatacagttaccactctgtctataacaagtgctacctaagtctcagtttttttaatgacttgatttaataatttcttcataggttccacttcccagcaaccccatcctaatggcttatggcagtatctcagtgagtaaaatgtctaacggttttcctttgtttattaaaaggttacttacaaggacaagaaaggaagtagaggcattatgatttggggatggattattgggaatactttgtcttcaaaagtctcttttgaatcttggcattctctaggatattttgtatttcaaaaggaccactttagtgtgacttcccaagccagcctttttggttggactggactggcattcttctgttttctagtgcctgtttatgttcagtgtccaaagccctctgaagattctgttaatctaaattaacttttgaatcagccttcagaaggaaagttgacagaaatcagtctgatgagataaagaagagagagaggggaagagtgatgggagaatgtatgtttatctagtaatctctaattagtattttattgcatgtctcatcacagtaattttgtgagtcagggtatcttcaccttatagataaggaatctggcttgacttgtagcatagttggtaaggggcagagttcagttgtcaacccagatctgactgactctaaactcatgcagatcttgccattttagaatactttttctgaagtaagaaggaggggttcctgttttataggagatagaaattagagaactttagtagaaaccaaccaagagtatcactaatggtattaatccttcctttatagccttcagcttatgtattagagatttttaaagggatcaagtcgaggtgagtgagtccttgcgcacaatttttgtaatctgtcagcaaacatttatgaagtgcttatctgaacgggaaataaatagaaattataattgatggttatcttataggtttaactatatcaaagttttgatggaaaataatttataatgttctttttgaagtgctagaactaggaagttccttctaaagtatgaagagagatgcttttaaggacaaataaaggggagtgatttatgttgtaggcgatgaaataatatataattcaattagaagcaccaattgttaatttgttttatattttggcttcttttctatgtacatacacaattggaatattatataaagttttatattctgttctttttcacatatttcctgaacatttgtttgttgttcatattcttcaaaaaaaaaaaatcattggattcagaattattccattgtatgaataattactcgatattgcatttgtttctcctttttggctattatcagtggcttcactgaatatgtttacacatatatctttgtcatcattattgattatttttcttaagagtcctagcagcctaataactgaccagtaggcataagcttttaaagttttatattgccaaattactttccagggtgattatactgatttttagcaggctttaaaaaatttgttgccagtgtgtgagccaaaaggtaatattttattattttcatttcttttgactattaatgaagttaacatttcagcatatttgttgaccatttgtattttgtcctgtgaatttttagttacctctttttgctcttaagtattattttactggtttttaaagaattcttgctgggcacagtggctcatgtctgtaatcccaacattttgggacacttgagaccaaaagtttgagaccagcctgggcaccatactttattttctttgtcatacatttttgcaataattgttatattatttgtgattttccttttgattttatttatgagtttgaactactgaaggctatcattttcataatgaaccacaatatctacatatatattccttacaagaaacaacacttgtcttaggataaagatgaaacttcactacaggaatgtaaaagaaaattgattaatgtggaggttacaatacatttcaagataggaagattctgtgttttaaagatttaacttttcctaattaataggtttgtaatcccatttgatatcctcttaagattttaaattggaattgatgaaataataatacttgagctagttctagagggaactattttcccagattaaaaggctacaaaattagcaaaattaaaatagtgtagcattggtgtcaggatcaatcatcatgtcaggatcagtcatcataatagactctaatggactcaatatatggtaaaagaatatcatatgaagatggaatattcaacaaaaggctttggagatattgtttatctggaaggaaaaaaagttagattttcccatcatgccattgaccaaaatgcattccaaatagattaagatattaaatacaaaaaacaaagagagtcatctagcttacagatgaatatttaactctaggcaagatgtatccaagtataaaatcagtagaaaaaataataaagggaaggatttaaaaattgaccatgttaacaacgttaacaaatgtggcatttttatatttattttttctttttcagtgagctggaagaatctctacttgtgctgcctttctcttatgtcccagacattcttaaactctttaacgaattcattcagctgggctctgatgttgaacttatatgccggtgcctcttcttcctccttaggtaacatccttttccaaagaataccatgtctgttcagcagaactgcttcagtagtaccttaactgaagctgtcaacactttgggattaagaaatagtatgccgaactcggtggctcacacccgtaatcccagcactttgggaggctgaggtgggtggattgcttgagcccagaagtttgctaccagcccaagcaatcagtcttgcctttaaaacaaggatcatgatgacccacctctttaagtaagaagtcatggtaatacattgctcaggaatgcttactcagtcataggcctccatgttacaatcttaagatagctctggttctagtcagtttgccaaaagccaattatgattggccagtttgcctcatttgttgtttcttttaagccaaccttgtccagcctgtggcccgcaggccacatgtggcccagtatggctttgaatgtggcccaacacaaatttgtaaactttattaaaacattatgatttttttgtgatttctttgttgttgttgttcatcagctatcattagtgtattttatgtgtggcccgagacggttcttccagtgtggcccaggggagccaaaaggatggacattcctgttttaaagtgtttagtgtaagctaacaggttttgctttgtcctttaccaacattttaagaaagtcagtttatttctcttggtctctacaggtgcaaatggaaatgtaggggcatatatagaggtaaactaaggaacataaagcaaatatgttcattaggctatattcttacttatgaagattctgttaataggtagttgagaagaatatatgcacaaaggcttgatattcttctcatctctcaccctcattctcaagcggttacagcagagaacagggatggagacaaattgaacattccttcaaatactgttatgaagacaaaaactggtcagccaatgccaaatagttaaacaggtatatgtagtgaactgaccaaataggtatttggtgaattggcctggttttatgattcttaaccctccatttcttatactctatccaggatagtagcaagagaagaagaataatatgttctgttgccatattcataatttggggcaacttgtaaagacataagttcatatttaaccatgttactaacaatttttttttactgctatggtatacgtgctattgaattagggttgctggttctacgagtaacactgtgaatacttatagcgtatcagaggcttatggatgggtactacctgacaggtatggtagggtcatcaaggatatcttggtactctaggtcagagtttgaatctcacgaatgtctcttttttgctgtggctttattagaagtattaatgcatctttgttaagttagcatttcttagaaggctcattctgtctttgagttttccttaaagtaccactgtcaaaatctgtagccactggcaggttgctgggctggaagaagagcctttgcaaatgagttgaatgtgtcataaggtttaggacagtattttttaagttgtcatcaaattgaactgaatagtagagaaagaaacttctttggcttttttttttttttttgctcgaaacatttctataatgtatattttgttgttgctttgatattgtgtctgtttactgtttctagaagggttaagtagggctagaacctctctgcaacatggctgtgttttgtttttctatcaggattcactttggacagatcactagcaatcaaatgcttgtgccagtgatagaaaaattaagggaaacaactatttcaaaagtcagccaagtccgggtaagtgtctttgtatagagataaaataatgaggcaaattcctagtgtgatttagaaatagtatagtatgctgtgctttgtctttagcaatacccaccaccgataaatccatatttgagatagtttttgttagaattagtaggaatagaaaaaacaaacaagaaaagttcttaatgagggaaagataagtaacaacacctgaagctttggttaccctaactctcatacgctgctataatgaattgaagtgggagaaaattttttaatatttcttgtattgcactccaggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatactataagtgtatgtcatctgtttataaaatgaattgtctgtctggattggcaggcaaccacagccgcagacctcaatctgtggtacttatcaagcatcagctttttcttgtaatgtcatgacttttctctgctttttgggagcactgtgatatgcagtttactggggcgatgagttgttcatgcacaggtgattagtgtcacagcattttaagtgcatacgcacaacacttgagctcactgcatagcaacaggaggtggctgtgaaattatttcagtaacatactgtgtattacagttcattttatgcagctatgatttaatactgcatctttacattattttacatttctcccaaaactgtgaattgcaccatgtatgatctgtatttgtgtgtgttaatgttgataatagatttgcgtgtattttatggcagtaaatgataaaatagtctagtatctacatatattttgtgcattcatgatataactacttttttcctaatttttttcatctgaaacttttctcattgtttcagatctccaaaaatttttccaatatatttattgaaaatatctgggctgcgtgcagtggctcacgcctgtaatcccaccactgtgggaggccgaggcaggcggatcacaaggtcaggagttccagaccagcctggccaacatggtgaaacctcatctctactaaaaatacaaaaaactagctgggcgtggtggcaggcgcttgtaatcccagctactcaggaggctgagacaggagaatcacttgaacccggcaggcggagattgcagttagccaagacagtgccaccagcattccagcctgggcaacacagtgagactccatctccaaaataataatagtaaaaaaaaatctgtataacagtggagccaagtggttaaaacccatgttcaacggattgtctactgtatatcttcatggtaaggatttggggaatgttctaggaaaagatattgacagatacctctgggtctgggcttttcttttggggaagtttataaatgactaaatcatacttcttgttacaggcctgtttagatgttctgtatcttcttgagacagttttgctttttatcttttttgttgttgttaatcccaaagatttaaaactatggtttctgtctgaatttggtcattgcaaccaagttactgtgttgtggggccaccattttcttctaggctcagatatgcagtccttgtggcttgccgatttgtgtcccaaaccacaagtcttaatgttcttgagcataacacaatcactgaagtgagtaagggatgcagtggtgttatttgttgggcagaataaataagtgaattttggcatagagtttctgaaggcataactatgaaggcaagagaataggcaggcaggataatgcattctaggtgctttccaaggagtcagtgttgtttaggcagctattcctgccaccagggagaggagttaattcttgaaaaaaaatttaattttttatgagaacagaagttgattcaatatccttcttagagttgctcatcagaacataaatgtcactttctagtaacatttttgatggtttccaaaccaaaacaagttccaggagggcattcgagatgtatacatcatcaataattactcttatgttaaaagttgctgttttcccgtagctttgccaccatttataactcaaaagcctgatagtgctagggaatgtaaagatgtttctgtctgctaagtgttatactaatcgaagagaaggagaacttttatgataaagtgacatgtacagaacctagccaagttacaatttttggtcaaaatacttgaaactctttaactctaaaagtttaaggtcaataggtgcattataaagtaaattttaagccaggcaaatttctagtcattaagtcagtattcattgccttagtcagccattggctgtatataatccttaatataaaaaccatctaatgactaatatctcttgcata

SEQ ID NO: 12630 - DNA, 66627 bp, Human
tagttggcaaagccttgggtttttgaccacccgccccaaattgagtccatccctttggcagcaaagctgctagttttcttggctattcctacccacactggcaaaactgcagttctggtgcaacagggtgggagagaagcagcctcaggccagaaggccacagacatctactgtccctgctagctgtttctgaagaatagatgtttctcaaattgttttctgtatttgtttgatttccagtgctctgaaatggttgtttttgccaatttatccaattttatactggttttgtgtgcagagaattgctgactatgccacacagacatagctaaaagtcccttccacagttttttacgtaggaacctgtattagttaggacctttcagagtcatgtaaaagaaattcaactgaattagttaggacttttagaattttaatatgaactggcttaaacaatacaggaaatttgtggttcacaattctggatagtctgtaagatggccttgctcacaatcccgaatagtctataggatagtccatagaatcaaacaggtgaggtttgatactgcagctcaaatcatgccaccaaacacaaggttcttctccatctttcccgcattcatttgacagtactgacttcaaccccaggctctacttgttgctgtccctctaaactcccatccctctagggtttccccttataggaggaaaacggttgccacatttccaggcatcatatacttacaccatgctagaggagcaaggaagctacagtttactggaagcctcagccccagtctttgtgggttcattgtttctgactgggcttgtgaccatctctgctgctagagggaatggttatgttgcctggcttaaatggaaggaataaatgctcaagtggcagccaacaaatacattcaatatccacacatattggctccaaataataaatcaatgaatgagtgggctcacccacttaggctcacatgctcacagcacttaaagagctccacaaaccatgccctccaaatgaaaccacggtctacattctgccagctctttctccctttccatttctcctttcttctctttcacaccctcacctttggctaggccactcgatgttgcaagaaacacgtccatcagcaattgcctcagtagaaaactccctctgctcccctcctgcatccacatagcagcttcaggcaaggcctccataaggcccagcgtggatcagtgcctgccccttggccgaatcagtgctgtcacaggcagagaattgtcactgccatgctcacctgcccaacccagtggtcagagaagactgttctactgcgagaggagccatgagaaggcttttccgaaagtcaaagaccaatggctacctcagaccatcccgtatccactcgtgggaggcccctgaatgaatctaaggccccaggggttgaactttactgagtagggagcgcagagtactagggacaaatttaccgcccgctttgaggaaagctgatgtgggagcagagagcaagatggatagcagcggccaatctaaacgggcaacgaagtgccacagagtgctgcacgtaggaatgcgagtgacaggtagggtcgtctattccaagtccctcctctcccctaataaactgccacatttcagaaaacacgaagactgctgaggccgtttccagccttcgctacgcattagcagagcaactcaacaagcctgggtgaaaggcttctcgaagaaattcagttatctctactgccagccaaacacggactgggcagctttcctcgggggctgctcggtaactgctgagccgggggcgcgctgaagccctgcagaagcccacacccgcttcaggaattccgtggatgttcccgacagaggtttattcccgcctatccctacaggcccacggcgctctttcctccaatcccacacccagtcgaaggcggggcagccgccccacccagcggccagccgggcggcccccagtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtaagccgtccgtccccgaaacccgcaaggccaccgactgcgcaggcgcctgcagagcactggccctcggcgcgttctctcgcgctcttcttcagtctcctcagcgagcctggggacgaagggggcgcggtgcctcctgggtgttgtagtttgcttccttggcgagaggccttcgggctggctggacgccggggccttgggaactacgcctcccagcgcgccccgcgcgagagcccaggtcgcctgcccttgacggcttcagccgtctgagcggagaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtcagtcgcagggagcggtcgcgtgctagggtcgcggcgatacccctggagtgcccgaggaaccctctcccgcgccggcctcgcgcccgcgtctgtcaggcagcgtgtggggctcggtgctcgcagcgctcgggtttgaagttgggggtggggggcgtggctgcccctggcgtgggttcctccccggaaagcttcgccccagttttcgccccccttggccgtgcgtccctcccactggccgacgggcctcccttcgtggcgtcctcgtttgtggtgctctcgggggccgggggtggagagttaggagtccccaggcctcggggaagctcttggggggcgcctggacagaggctaggggacccagccctcacggttggtggatcgtgcccggcatagtggccaggctccagggcttacccaggggaccaggacaggctcctggtgtcgcccaccgctggcactgagcagtgggcgcctttgggtgctgcgatccttccttcaggtttcagtgggaatggacagacagatctgaagttgaaaattcttttcacaactcatgttcaactatgtgtgttgtcagaatgctcttaatgaggtcagtgttctccctcttttttttaaaactgatcgttgtgagagtgaaacaggttttacagaatatttaacacctccgtcttccctgaagtaattctgctgtttcaagttttgggattcagtattacaaagccttcctcttgagcaaggcctagtacaattcttcaaggtccctagcatgttaattcgaggtgttttgaacgtgcatatacaggaagtgcagccgtttggccgttgagttagtgctccatccagccttgttagaaaagctttcgctgaatttttaatttagtggagtggtcatgttctaatgctgcagtactttggggagtattccattatacttggcagttattaacgaaatactgaacttgtgataaggttttgttttggtgctcagcatttctaaatgaataagtgggactgtgaataagaaagatcacctcactttctgtttttagagttattgtggtcatttgataactcctttctgtctttgtgaaaataattactgtaagctggagtggcggtagtaggggtaggaaggaggtcagtagagtggtttccacctctcattcaaagtatctggtagatccaagtggggtaggttagttaacagtagctttttttttttttttttagttttttattttttgagacagagtttcgctcttgttgcccaggttggagtgcaatggcatgatctcagctcaccacagcctctgcctcctgggttcaaacgattctgctgcctcagcctcctgaggggattacaggcatgcgccatcacgcccggctaattttatatttttagtagagacattttctccatgttggtcaggctggtcttgaactcccgacctcaggtgatctgcccgcctaggcctcccaaagcgctgggattacaggcgtgtgccaccgcgccctgccaacagtagtagcttttgagaagtgactctttaaacaaggtatctcgaaacaatgtaatacaacttagtttgctttctcttcaggatattgtttctaattatggatcttatccagactatttctcccctaatttagaataggaaagtggtatcagaaagtgcataataactttaatttgtacagttatatttgcatagttgtttgcttggcaagaagagatcgggcccagcatgtaacccaaaagaatattgtttctgttttgaaagatccctgatagaaacttatgttagtttgtataagagggtacaaggaaaaatgcagattatttagaatacaggaattactatgtagaaagtactgtgaccaggtgaagaggacttaaagatacagaaggcagtgttcctgccttcagggtagttgaaccttatctcttactttaactgtcaacaagtacaagattgttttgattgaagaacatatgcgggtacagtggatgtacaaaggagatagtggtcagtttcttaaagtgaagaaaagagctgaagaagagggaaactgtaaggaaaaactatgtagaaggtgatgaaaatcaggagtgtacaggcatagaaagaatgggcatttaggtagaaggagcagtgtgagaaaaagcatgggagtctaaaattagagagtagcatctgcaaaaatagcaagtataatacagggtggtggcaagacctgaaactggggagataggcagagaccaaattatggatcttgcagaccatcagaataattacaattttattttataagcaaataggagtcattgagaggacaaagaagagacctaagccagctcagcccatttttaaccctctgctataggtcaggcactgtattaggtactgtatattttatgtccttaagcttaaagaaggcttagtcatgactaatgcagaaattggggggctagggcagggatggggaaggaacttttagagggaaaggtgggcagaaacgtaggtgagaaagaacatggaacacttttttttttcccaatacagacaccatcactcagttttattggttttgtcgtattagcctctgaagtaggcaattattggtgtgaacatacattttgaaaaacatctggagtcaagagtgcacgagtgtcaactcagtgcaagtactgttggtaagcattatgtcccgaggatgaaatcggaggaccaacaggcccaggaggcttcacagcgaacaccacatgcctcgcgcccaaaaggacagcagaccgcgcttcagaacggaaccgccttctccatgtaaacttttgacgtaaactgtgtgcttcagggtggcctcttcttctccgagatcctctcctgcgtcccgagtttgggaatggcccggccgtgctcaggcccaggcggtggaggcctcggtgtagtagtgccgtgcttgtcgacgttcccaggagtccgggttcagaagccccctctccggtggattggcagcttcgcggtagctgggctagtcttcctctggaaactcagtaaaaagagtcggcgctgtccgcctgagcgcgggtttcctaccgagctagaggccagcctgcctcaggcgcagaagggtttgccgccggccttggtcagggcgagcagctccctggtggcgcccagagctggggtgtcctggggcgcggcaggcggaaaggcacgcgcgggccaggggtgcagtcagcacagaatatggaagagaatgggaagttgttttctgtagctgtagcattagttgtggtgataagtagcagaagatgaggttgcaggtatcctcaaaagtattgcgtgccattccaaggaccttaccattttttcctgtagataacaatagggtttatgtattttaatgaacagagagacatgataagatttttctttttattttttttttacttttttgagataaggtctcactgtgtcacccaggctgaaatgaagtggcactcaccgcactccgtcatggctcactgcagcctcgacctcccaggctccagcgatcctcccacctcagcctcacgagtagctgggaccacaggtgaacgccaccacacctggctaattttttggtatttttttttttgtagagatggagttttgctgtgttgcccaggctggtcttaaactttgagctcaggcagtccaccctcctcggcctcctaaagtgctgggattacacgtgtaagccaccatgtccggccaagatttttattttagaaagatcattctggaattgtagagtaaggatttcagaagggatggagagaaggtaagaatggatgtagaaagactgtttaggaggtttttgcactaatcgaagtgagaaataagggtccaaactaaggcaatgttagaggggttatggaggaggagggtaatagaaatatttagaaagtagaattcataggattcagcaacaattggatatggggagtgagggaaaaataatagaataagatgacttggattttaacttgggtgattgaagagacaatggtaaaatatactgagatggggaattcaggaagagaagcacatttgaggagaaacagtattttagcttcagaacatattgagtggaagttatctgtgaaacatccaggtggaatcatctgctatggaactgtgaatgtggatttggagtacagtataacaggctatattatgagtggtatctgaattctttgatttagataacaccaaataagaagagtttgttaacataaaatagttctggaaataggctgtggagaacatttaaagccagatagaagaagagctgggaaaggaaattcctaagtgtttggagatgtagagaaatcatgagaaaatgtcatagaagccaaagtgggatctggcaccatcacagctcactacaacctccgcctcctgggctcaagccatcctcctacctcagccactcaagtagctgggactgcagacacataccaccacacctggctaatttttgtatttttggtagggatggggttttgccatgttgcccaggctggtcttgaactcctgggctcaagcgatctgcctgccttggcctctcaagtgctaggattacaggtgtgagccactgcattgggctgggatcatttttaaaggaagttatacttcacaatcaactctcaagaaaaaatagaaattaatttttttttttaaaaaaggaaagcctcaggcacagtggctcacacctgtcctcccagcactttgggaagctgaggtgggaggattgcttgagccaaagagtttgagaccagcctgggaaacatagggagactggtgtctctgcaaaaaaaaagcaattagctggctgtggtggtgcacacctgtggtcccagctactcaggaggctgaggtgggatgatcgcttgatcctgggaggttgcggctgcagtgagctgtgattgtgccactgcattgcagcatgggtgacagagtgggaccctggcctaaacaaaaggaaagccatactttaaatgctttgaaaagttgagcgaaagaagttattaagagtctattgatttggtattgaggaggttattcaatttgataactgtgtgagaacagttttgatagaatggttgggggacgaggtaggtttcattgagttgaggagttgaggttagagagtggaaaagcatatgtagattataataaataaatcaattttagccatgaaggggagaatagaaagaggtggtagcagagggtgataaagggttaacagatttttaacatggcaaagacttgaacctgcttttcttttttaaaacagctttattgaaatataattcacgtatccataaaattcactcctttaaattatacaattcattggtatgtagcatgtagttattcattggtctgtgtgacttaattttttttttttttttttgagacagagtcacactctgtcacccatgctggagtgcagtggtgcagccacagcttattgcagcttgacttcccaggctcagatagatgatcctccgacttcagcctcctgagtagctgagactacgggtgtgtgccactatgcctggctaattttttgtattttttttgtggagacggggttttgccatattgcccaggctggtctcaaactcctgggctcaagtgatccacctctctcggcttcccaaagtgctgggctcaatgagccaccacgcgcagtctcattggtttttagtacagatgcttctctacttttctctacttacgacacagttacatcctgataaacctatagcaattcgaaaatattgtaagtggaaaatgcatttaatgcacctaacatcatagcttagcctcgcctactgtaaacatgctcagaacacttacattagcctacaaaatcctctaacacaaagtttattttataataaagtgtggaatatctcatgtaatttattgcatactgaaagtgaaaaacagaatgattttatggataccatgtaaagttgaaaaatcccaagttgaaacattgtatgttggggacagtctgtatatacagagttgtacagccatcaccacagtcaattttagaacattttcattactcccccaaaaaaacctccccattagcagtagtcactcactatttcccctgccctcattaatctacttctgtatctcttgatatttcagatattctggatatttcatataaatgaaaccatatatatcatcttttgcaactgctttccctcacttaatgttttcagggttcatccatattgtaggatatattagcacttcatattttttattgcaaaacagtactctcttatctggatataccacatttcatttatccatttatcagttgaacatctaagtcgtttctccttcttgactattctgaataatgctggtgtgaatattcatgtacaagtttttgtgcgggcatacgttttcatttcttgtgtatatacctaggagtagaattgctgggtgtgatgttatacaataagaaatatatatttggtcttggtctggttcctagcctagaacttcaaagatccttggaactccctgagtaatagaggtaatagagcatattttggaattcataataagtctctcagtcacatctgaatttatgctaataaagtgattcttggtaggcccctagacaacttcaggatggaagctggttgccagaagaaccaactgtgttgattagagagttggaacttgcagccccacccctggatgggtgagggggtggtggtgaggactgggtattgagatcagttatcagtggccagtgatgtaatcagtcatgcctgtgaaatgggacctccataaaatcttctaaacagtggttttcagagagattctgggttggtgaatgcatccttatgctgggaaggtgttgcttcaacttcatgggacagaaactcctatacttggaacccatctcggcctcacccttgtgccttttgatttggtggtttatttatatcctttataataaactgataggcataagtaaagtgtttccctgagtttcggtgagccattcttgcaaattattgaacatgaggagggggttgtgggaacccctatttatagctatttggtcagaagtacaggtggcaatgtgcagcttgtggctggtaactgaagtgagggtagtcttgtggaactaagcctgtggagtctgacataaactctgggcagttagtgtcagaattgaattatagggcactcagttggtgtctggaaagttggagaactgtattggtatggaaaaacacttccacatgtggtgtcagaagtgttgttagaaaacagctcatgtggtaactcttgttgaacagtttgaggaactgccaaattgtttcccaaagcgactgcaccattttataatccaattctccaatttctctacatctttgccaatacttgccatttgcttttttaaattttagctatcttggggtgaagtggtatcatgttgagggttagattttcatttccctggtggctaagatgttgaacatcttttcatgtgctcattggccatttgtatattctctttgtggaaatatctactgaaatcctttgtccatttttgaattgtattgttggttattgaaagagttctttgtatgtttggttactaaatgtttatcagatatatgatttacaaatacttctgttttctgggttgtcttttcactttcttgataatatacttttgatgcattaaaagtttaaattttacagtataatttatctgtttttttttgtttgtttgttacacaggcttttggtgtcatgtctacattgccaaatccaaggaatgaagatttattccatactttcttctaagagttctgtggttttagttcttatattcagttgttggtccacatttttatatggtgtgagataggggtccacgtttttttgttttgttttgtttttgagacagagtctcactctgtcgctcaggctggaatgcagtggcacaatctcaggttactgcaatctctgcctcccaggttcaagcgattctcatgctttggcctcccgagtagctgggattacaggcgagcgctaccacgcccggccaatttttgtatttttactagagatggggtttcaccacattggccaggctggcctcaaactcctggcctcaagtgatccacccaccttggcctcccaaagtgctgggattacaggcgtgagccactgcgccctgccagagggggtccacttttttgcatgtggtactctagttgtcccatcctcatgtgttgaagagaccattatttcctgattgagtggtcctgatatccttgttgaaaaatcagttgaccacaaatgtctgggttttttcccctggactctttgtttgattctcatggttgatatagctatccttatgccaggtaccatgtgctgttttgattactgtggctttgtagtacattttgaaattgagatgtgtgaattcttcgactttgctgtttccagtatttgttggctcttcagggtcccttgcaattccatatgaaactgaggatccatttctgtaaaaaaggccattggaattttaatagagattgcattgaatttgtaaaacattttgggtagtatttctgttttaaaaatattaagtcctccaatccattaacaataggatgtcttttcacttatttagtttgtctttaatttcttgcacaatatttgtagttatcagtgtcaagtctttcacttccctggttaaatttatttctatttttttttttaggtgctgttgcaaatgaaattgttttttaaatttgtttttcaatttgtttttcacaattgtttttcacaattgcctagtgtttagatatacaacttattttctgtcaccttatatcgtgtgactttgctgaactccttattagttcccatagttttctagtgtattcttttgagttttgtatataagatcatgctgtctgtaaacagagatagttttacctcttcttttcctatatgggtatcttttatttatttatttttcattcctaattgcccaggctagaacttcccatacaatgctaaatgaaagtggcaataacagacttccctgtcttgttccttatcttaggaggaaagcttccagtcttttaccatttagtataatgttaactgtgggtttttctttcttttcttttttttttgagacacggtctcattctgtcacccaggctggagtgcagtggtgcaatcatggctcactgcagccttgacctcccaggctcacgtgatactcccacttcagcctcctgagtagctgggtctacaggcatgagccactatgcctggctaatttttgtatgctttgtagagacagggtctccctatgttgcccaggctggtctggagctcctgggctcaagcttctgcttcagcctctcaaaatgctgggattataggcatgagccaccatgcctggcaactgtgggtttttcattgatacactgtatcagtttaaggatgttccttatgttcccagtttgttgagtactttgttgagtgtttgtcaagtgtgttgcttaattatctacatatttttgaagttttcaacattttgtctgttatcgattttcagtttcatttcattgtgatcagagaacatactttgtatgattttagtcttttaaagtttattgaggcatcttttattgcctaacatatgatctgtcctgagactgttccatgtgcacttgagatggattcgtattacattgtctttgggtggggtgttctatagatgtctgatagatctagttgctttatagtgttgttcaagtcttctttttcattgttgatcttttctctagtctatccattattgaaagtgaagtattgggagtctccgtttatcattgaactgcctcttcgcctctcacttctgtcagtttttgttttgtatcttttggaggctctgttgttatgtgcagtgtatgtttacaattgttgtatcttgttgatggatttacccatttatcattatatgatatttaagagatagtcttcattgtttggtattagcatagactttcttttatttttattttttttgagacagagtcttgctctgttgcccaggctggagtgcagtggcacgatctcggctcactgcaacctctgtctcccaggttcaagcgatcctccagcttcagcccccgtagtagctgggactacaggcatgtaccaccatgcccggctgatttttgtatttttagtagagacagagttttgccgtgttggccaggctggtctccaactcctgaactcaggtgatccacccgcctcagtctcccaaagtgctgggattacagacatgagccaccgcacccggcctaacatagactttctagttcccttttggttactgtttgcatgaaatctctttttctttctttctcttccttccttccttccttccttccttccttccttccttccttccttccttccttcctccctccctccctccctccctccctccctccctcccttccttcctcccttcctcccttcctcgtctcgctctgtcgccaggctggagtgcagtagtagcacgatcttggctcagtgcaatctccgcctcccgggtgcaagcaattttcctgcctcagtctcctgaatagctgggagtacaggctcgcgccaccacgcctggctaatttttgtatttttagtagagacagggtttcaccatgttggccaggatggtctccatctcttgaccttgtaatccacccaccttggcctcccaaagtgctgggattacaggtgtgagctactgttcccagcctggaatatctttttctatctttttactttcagcttatttctgtctttgaatctaaagtgagtctctgtagacaggctacgattgcatcttgttgttttttaaatctgtctgccaataactatcttttaattgaggagtttgatttatttacatattactgataagaaagaacttctgccatattgctatttgtttttgatacatcttttttgttcctcaattcttccattgctgcctccttttgtgttaaatacatacttttcattgtaccattttaattcctttatgtttcatttgttatatattttcgtagtagttgacctgggattacaattaacatcttaatttgtaacaatctagttcagattaatatcaacttaattttaatagtgtagaaaactttactcctatgtagtcctaccccctttatgccgttattgtcacaattacatctttatacattgtatgctcatcaacactgatttacagtgattgctttatgcagttatttaactcagataggagaaagaagaaatacaaacaaaaatacatttatactctttttaatatttacctacatactttttttttttttttttttttgcgacaaggtcttgctgtcttgcccacactggagtgcagtggcatgatcctggctcactgcagccttgaccttctgggctcaagtgatccactttggcctctgaaactgttgggattataggcatgagccatcatgcccgactgtaattacctttaccagtgttctttattcatgtggatttgagtatcgtctagttagtgttttttcaaagcagcatgatggactccctttagcgtattttttttaacaggataggtctactagcagtgagttctcttagtttttcttaatctaggaatatcttttctttttcttttttttttttgagacagagtctcatcgctctgttgcccaggctggagtgcagtggcgtgatctcagctcactgcaacctccacttcatgggcttaagtgatcttcccacttcatccttctgagtagctgggaccacaggtgtgcaccaccacacccagctgattttttttttctttttttgtattttttgtagagatgggattttgccatgttgctgaggctggtctcgaacttctgggctcaagtgatctgcctgcctcagcctcccgtatatctcttatgttctgttttaagggattctgtattctttctttttttttcctgatcctcagactgacctatttcaattaacctatcttcatgttcactgtttctttgttctgcctgcccaaataagctgttgagcccttctagtgaacttttcatctaagttattatacttttcaattctataatttctattagattttttaaaaaattctctttatcaatactctctttttggtgaaacagagttatcttgctttccttcagtttttaagacatggtttcctttagctttagaacatacttaaaatagctgatttaaagttcttatgtagtcagtctagtcagtgtctgggcatccttagggacagtttcttttttctatttttgtgaggcagagtctcactctgtagcccaggctggaatccagtggcgcaatcttggctcactgcaacctccgcctcccgggttcaagcaattttctttcccatcttggccttccaaagtactgggattacaggcgtgagccaccgtgcctggcctggaacagtttctgtgattgctttttttttttttaatggatcattccttcttgtttctttgcatatgtgtaagtttttgatgaaattggacgttttgactccatcgctatatttcctagtttctttacagatggataggcggctggatgagatataaataatatgattgtctttttagttaaaaacatgtaaaatttagtttattttgaaaaagataatacccatggcacataaaggttaaattgtctttccccctttacccttttctcagctgagatctctttgaagggataaaaacttaatatttccttgtatattcttccagagatgttttatatacatgcaagtagtatgtgtgaacatgtaaatactctattgtaaacagtcacgaggaagtaatatgtacaggaagggaatcagtatttgttgacacctattgtgtaacaggcactgagcctgtttctttatatttgagggaagtgtttcaaactgatcgccttgaacgtttatacaattattttatgaagcttttatataaaacgttattgaaaacaaaaatactggcagaagtcatttggaattgcttctagagctggcaccatgtattgaagcatggcagtccctcaacaagtgaaggttaagttagttcagaagcactaaaaattgagaaccaggtattgtgataggttgaaaataaaactttataccattgccgatgtttaaaaatgaggtatacttgtcatttataaaactgttgttgtgtgactagaactttctttgtaagcttttttatatgtattgacttttcacaatctgccattgataggtgccatcagataaatacataataaggaactattattgagaaatgaggatcgagggggagatgagagaagaaagatttttaaggaaaatgcaaaaattgaagtaggacattggcaattttcaatgtttccttccaaagtagaaatatgatttgttttgtttttgtttttttgttttgttttgtttgagctggagtcttgctctgtcgtgcaggctggaatgcagtggtgtgatcgtggctcactgcaacctctgcctcccggattgaagcaattctcctgcctcagcctcccgagtagctggtactacaggcatgcaccaccacacctggctaatttttgtatttttaggagagacagggtttcaccatgttagccaggctggtcttgaactcctgacctcaggcaatctgcctgcctcggcctcccaaagtgctgggattacaggcgtgagccactgtgcctggcttcaaaataggaatatgaatcaagaacttagactttctgcttgagaaaattatgagaaaagaaattgcagatataaagctgaagaaaagcttacttaagtccattttcttaccactactgaggtaacaaacaattgaaaagcagtgggtaaaattctaagtttttcaacaaagcttagcattttaaggaaaaaaaaaactgtattacaacattagagtttgcttcttcagatattcctcaggttacttttcaaattaatgtcttagaagcgttatgattgtataaaatttttttgtagtcaactgaagccataaaagcatcatttccttcctttaggtctaaatgatggaatagttttacatgatgataacgagttatagaatataagttacaagacaggaacaatctgctaatgtgtgtgtgtggtgtgtgtaacaagtttttttaaacaaataatgattgttacttttaacaacttaatttgaacttttattatcatggtttagtaaatagtgcttttactttctgcttttctttaatcaaaataattcactatgtaagtaaagagtttagttactatgtaacattttaattccaaatcttgacttttggcctattttgcctgcgtaagattagtatttttacttctgtctccagattttatttaattccaggaaataatgcagcagctgttgttatttatttatttatttattttttaggcagagtctcactctgtcacccaggctggaatgcagcggcatgatcttggcttactgcaacctcagcctcatgggttcaagtgattctcatgccccagcctcttgagttgctgcaattacaggtgtgcaccatcatgcccagcaattttttctatttttagtagagatggggtttcaccgtgttggctaggctggtctccatcttctggcctcaagtgatcctcccaccccggcctcccaaagtgctgggattacaaatgtgagctgctgttaattcttacgcagtacctttatatcctagacagtaattttattcctattttccatttctttcctctaaaatgttaccttgtgatagggcttggctgtgtccccacccaaatctcaagttgaattgtgtctcccagaattccatgttttgggagtgacccagagggaggtaactgaatcatgggagccagtctttcccatgctattctcctgatagtgaataagtctcttgagatctgatgggtttatcagggatttccactttggcttcttcctcattttctcttgccactaccatgtaaaaagagcctttagcctcccgccataactctgaggcttccccagccatgtggagccataagttcaattaaacctttttttgttcccaacttctggtatgtctttatcagcagcataaaaacgaaccaatacaccttaactgaaatcttcatggggtggtggttcttacttacccaaccaagataattgaccactttataacttttgagcagctctctacatttaaatgtttacagatcacctattaaggaaacttctacttagaattgtcagctgaggattttctctaactatcgtgggtgatattagacctacttgttattctatatcagtagttaataatctaaggtaattttttcctcaatctcatttttaggaaatttttttgaagaaaattataaaaattaatatatatattttcaaaaatttaagtaggacccaaatggagccctttgtccccccaagtcctctggtaccacatcccatacattaacccagatgtcatatcatttcatccaggtatattttagtgtgtatctctaaccacaacacagtgatcacactaacaaaaattaacaattgtttcttaatataaaatattgaattaatattcagatttctctgattttcataactttttttcctaactattttttcacttcttttcttttttgagacagagtttgtctctgtcacccaggctggagtgcagtggtacgatcttggctcactgcagcctctgcctcctgggctcaggcgattctcctgcctcagcctcctgagtagctgggattacaggtgcacgccatcatgcccagctagtttttgtatttttagtagagacgaggttttgctatgttggccaggctggtctcaaactcctgacctcaggtaatctgcctgctttggccttccaaagtggtgggattacaggtgtgagccaccatgaccggcccctaacaattttttcaaatcaaaatccaaataagctctatacatggcaattggttgatgtcttttaagtctttcttttttttcaaggtaatgtgtcatttttttgtagtatttttgtgtttcttaaccttttacaaaaatagactttatttttaaagctgcgtttgtgttagagttcgctcctggtatgctgtacattccgtgtgtttagacaaatgaataatgaacatgtgtccaccactaaagtaccaatacagaatagcttcactgccccaacaatcctctgtgttccacctattcatttcttcctcctccctaaaccctggctactactaatccttctactgtctctatagttttgctttttgcagaatgtcatatggcctttttaattaacgtctttttttttgagacaaggtcttgctttgtcgtgcaggttggggtgaagcgctgggatctcagctcactgctgagcctctacctgctaggctcaggtgatcctcccatctcagcctcccaagtagctgggactacaggtgtgcaccaccacacccagctaattttttcttttttttttttgggtagagatgaggttttgccatgttgcccaggctgttctctgactgctgtgcttaagcagtccgcccaccttggtctccaaaagtgctgggatcgcagttgtcagccactgtgctcaacttcttttacttagtaatatgcatttacatttcctctgtatcttttcatgacttgatagctcatctctttttagcactaaataatattccattatctggatataccacagtttatccattgctgccttttttggggggatttataatatacctgctataaacatctatgtgccggtttttgcatgtacataagttctcaattcatttgggtaaataccaaggagtgcgattgatggatcatataggaagagtatgtttagttttgtaagaaactgccaagctttcttccaaagtggctgtgccatattgcattcctatcagccatggataaaagttcctgttgctctatatccttgccagcatttggtggtggtagcattttgggttttgccataataatggtatgtggtagtatcacattgttttaattggtagttctccaatgatatagcatgctgagcatcttctcatgtgcttattttccatttacatatctttggtgaggtgcctgttcaggtcttttgcccatttaaacaaaatgaattgttttcttactgtttagtttaaagagttttttttttttttttttttttttgagacaaaattcccccaggctggagtgcaatggcactatcttggctcactgcaacctctgcctcccaggttcaagcgattctcctgcctcagcctcccgattagctgggattacaggcgcctgccaccattctcggctaatttttgtgtttttagtagagacgggattttcatgttggccaggctggtctcgaactcctgacttcaggtgatccgcctgccttggcctcccaaagtgctgggattacaggcatgagccaccgcacctggcctaaagagttctgtgtatatttttgggtaatagtactttattggatatattttctataagtattttatttcaatgtggcttgtcttttcaatctttcagtcttaagactcttaatttttatgttcaccctccctctcttttttttttccagagcattaactaaagaaactaaattgtatatcctatagattttgcagcttgatctgtgtgatatgagatatatagatctatctgtttatctatctgtccatatatgttttcatccagaattcctggctcataactcccatagcccctgttatttcttaagtgacttaaacaataagcatatcttttgttaaagtattttgccttttgtctttggttcctgaagaagctttgaaacagcttctgagcaataaaggtgaaagacagtcttttgttataatgttggagtactttagatctcagaagtaggcctcagaagacagatctctctctctctggccttctcctggtctttgttcacttgctcatttttctccccaaggcaggccatagaaactaaaaacatgctctaatcttcccccggctttctgtccacaagctggccataaaggaattctctgacttacattgtctgattttaggtcataagacccccatttcaaaatggatcttgtcccataccatggaggaagcaatgctgcacagagaggccaagaagaatctgaacaaaacaggccttactgggtttccccactcaatctattagtattagattataccctttttgttcagtcgcatttctgcatgtttgtccatacttcaacatgcctatccaatgaagtctccatcaaaaatttaagaagatggggttccgagagctttttgattgcagaacaggtagaagttcctggaggttagtgtagccagagagggcacggaagctctgcactccttcctacatgccttgccctgtgcatctcttcatctataccctttgtgtatcctttataataaactgaacataagtgtaaacctaagtgtattcctaggttctgtgagctgctctaggaaattaatcaaacccaaggcaggggtcatgggaaccatgatttatagctggtcccatcagaagtgttactggaaagatgtcctgatcagaacccaggatagggtttttagacctcacccaagaaggaatttgaggagagtccttaaagtgaaagcattagtttattaagaaagtaaagaaagaaatgaatcgctactccataggcagagcagcagcatgggctgctcgactgaatatacttatagttatttcctgattatgtgctaaagaacggttagattattcatgaattttccagaaaaggaatgggtaattcctgaaactgagggttcatcccctttttcgaccatatagggtaacttcctgatgttgccatggcatttgtaaactgtcatgatgctggtgggagtgtcttttagcgtgctaatgcattacagttagcctatagtgagcagtgaggatgagcagaggtcactttcataaccatcttagtttcggtgggatctggccggcttcttaaccacatcctgttttatcagcaaggtctttgtgacccatatcttgtgttgacctccaatctcatcctgtgattaaggatgcctaacctcctgagaatgcagcccagttaatctcagccttattttacccagcccctattcaagatggagttgctctggttcaaatatctctgacggaagcacaggtaaaacagcctagggcttgcaattggcgtcagaagttggaggcgggcagccttggggactgagccgtcaacctgtggaatctgatgctacggatggtgtcagaattaaattggagaacacccagctggtgtccactgcaaagttgattgcttgcttggtggagtaaacccctatatatcatggtataagagcagagaaaaaactgattttctacataatcagattgttttgtttgtttatttttcagggatagtgtgtgcatccatcaaggagctcttctctttctatctcttgctctctttttttggtgttattagcagccgttgatgatcattgccagtatccatttttatttatctataaagtggtgtaaacaaaaaataaaattctaagccccccaactgactgatggacccccctctaggttaagggagtttcaaactaaacctgaaaaactagttcaggccatgaagggaatgggaggttgggcatgcatcattataccttcctccccttggaattcagacataactgaccagcattaacattaaaacagagatcttaagactgacaaaacagactttgtagcaataagataccaaattccaatctgactctagtataacatcacatgacagatggcaggccctgaaagaaatcaaggtatttcacctcaaaatatatttattggacatattttgaaatagccctgcaaagctgtctcttgtggggaaaatctgcattttctagagaatccccttccctttccagatctttttcctgatctagaagcaaattaactagagtctggcatctttttatgtctgataagagctctgaaaccggctacctggaggtttcatctgcatgataaaaatcttggtctccacaaccccttatctgaactcagatgctcctttctattgagtctagatctttagataataacaactctttcaaccagttgccaatcagataatctctgaatccacctgtgacctggtagccctggcttcaagttgtgctttatttccagccgaaccaggatacactttacatgtattgattgatgtctgcctttaacttctgtccccctgaaatacataaaatcaagctgtaaaacaaccaccttgggcacatttctcaggacctcctggggctatgtcatgagtcagtgtcagaggtgtttgaaccagaacatctctgtcttgaataggggctaggtaaaatgaggctgagacctactgggttacattcccaggaggttaggcattctatgtcacaggatgagataggaggtcggcacaagatacaggttataaaaactggtcgtggtaaagaagtcggccatatcacaccaaaaccaagatggcaacggaagtaacccctggtcatcctggctactcatatatgctaattatgatacattagcatgctaaaagacactcccaccagtgctatgacagtttacaaatgccatgccaatgtcaggaagttaccccatatggtctaaaagggggaggaatcctcagttctgggaaatggccacctctttcctggaaaactcataaataatccacccttatttagcatataatcaagaaataagtatccttagtacagcagtccaggctgctgctctgcctgtggagtagccattctttattcctttactttcttttttttgagactgagtttcgctcttgttgcccaggctggagtgcaatggcgcgatcttggctcactgcaacctcagtctcccgggttcaagcgattctcctgcctcagcctcccaagtagctgagaccacaggcatgcgccaccacgcctggctaattttgtatttttagtagagacggggtctccatgttggtcagcctggtctcgaactcccgacctcaggtgatctgcctgcctcagcctcccaaagtgctgggattacaggcatgagccaccgcacctggcctattccttttctttcttaataaacttgctttcattttgcactatggactcaccctgaattcatttttgtgcgagatccaagaaccttctcttgggatctggtttgggacccctttcgagtagcagtggtcctcacatctggctcagaataaatctcttaaagtattttatagagtttaactccttgttgatattcataatattctttttttttttttttgagacagagtctgtcgcgcaggctggaatacagtggtatgatctcatttcactgcagtcttgaccttctgggctcaagtgatctgcccacctcagcctcccgagtagctgggatcacaggttcacaccaccatgtccggttaattttttgcatttttgatcgagacagggcttcgccatgttgcccagactggtcccgaactcctgggctcaagcagtctgcctgctttgacctcccaaagtgttgggattacaggcgtgagccactgcgctccgatattctttcatttcttctttacttacttgccgtaagattttgataaagataaacttggcagcattaatacgtcacttaggaaatttaggataaatgctcgatttctccccaactttattaatcagctattcaaaaactgaggtgttcctctatatccttcaaaggtgaccaatgaatttttattttttagtataattgtgcactcatggatttaaatataattgatgcattttagcttattgcagttgtttaattttatcgatactcatattgtcccatctttggccagtgggagtttattcaacttgacttctgagtccttttaattccaagcatcattcatgacttactactttcttttgtgactgatgtttctgccttatcttgtacatattctgctcttagacctgaaatctacttaacaggaacacttaaaagttccctttattatgttgttaggttcacacagcttaatatgtatttacatctcaacaactaaaaagggaaaaacagtttttctgtactctctcacagcacttttgacaccagaagtgtgtagggatttcccatatcaaacaatgatccaattcttggcaggcactaggtgttctacaacttaacctaatgctggcagtgcactaacctgaagttaatgcagaccccacaggttaagggctcagtcttacaagactgtcccccactttagatatcaatcacaagtagtggggtccccaggttacccacaaccctatcccatttggctccaaattggacattcccaagaccccctcttcaggtttgagaacttgcatgaatggctcgtagaaccatgtaaacactttacttactattactggtttattacaaagcattttttaattttttaatttttaagattttttaaaataaatagagacgcggttttgctgtgttgcccaggctggcctcaaaactcctggcctcaagcaatccgcccatacgggattacaggcgtgagctagcgtgcccgtatttcttattatatcacagtatcacaagaagttaatagccgtttgaaaaaataatacacgtaagttgaaagaggaaataatatttttatttcactcctacataactaaaattactaatggtttgtgtgtgcctgtaggacagtgtacagcttgtaataccttgcagtcagattggacatcactaccctcatttcttgttccatgttgatttttacatggcacttttctttttttgtcacatgaccccagaaaactcagcttcacaagatatattgtcaagaggaatgcagtgctatctaatgttgaaactgaactacttttagctagtattttgtgctgtttctgaaagatgtccagtattgctgtttccctcaaatttaagatgtcccgaaactcccctctgagtttgcttgcggtgcccctgggtgcttcagtgcactctttgggaatcttgactaaatactattatccaggtcttattataatcaatgtgtgatttttatttttattaaataaatgtgttggtccccccatcacctcagttgagttctaatttaagatttacttgaggccaggcatggtggctcatgcctataatcccagcaatttgggaggctgaggtgggcggatcacctgaggtcaggagtttgagaccagcctggccaacatggtgaaaccccatctctactaaaaatacaaccattagccaggtatggtggtgggcacctgtaatcccagctactcgggaggctgaggcaggagaatcgcttgaacccgggaggcggagattgccctgagctgataccacgccactgctctccagcctgctgacatagtgagactccgtctcaaaaaataataataataaaggcaagagtccaaagtggatttttccttctgatacttaatatatgtatagttatgtgtcacataatgtttcagtcagggatagactgcatatacagaggtggttgcctaagattataataccataactgtacttttttctgtgtggaggtatgtttatataccaaggtgttacagttgctgacagtattcagtacagtaacatgctgtacaggtttgtagcctaggagtaataggccataccatatagcctaggtgtatagtaggctctaccatccgggtgaaaataatttgttaattttcctactttcttgtcattaatcgtttttaaaaacttttttttttttttttttagacagggtcttgtgctgttgcccaggctggtgccatcataactcactatggcctcgacctcctgggctcaagtaattcttctgcctcagccctcccgagtagctgggactatagacacatgccaccacactcagctaatttttttttttttttgaaatggagtctcgctctgtcaccaggctggattgcagtggcgtgatctcatctcactgcaacctctgcctcccaggttcaagtgattctcctgcctcagcctcccaggtgtctgggactgcaggcgcccaccaccacgcccggctaatttttgtatttttagtagagatggggtttcaccatgttggccaagatggtctcgatctcttgacctagtgatctgcccgtctcggccttccaaagtgatgggattaccaccatgcctggcccacgtttggctaattttttattttctgtagagacagggtcttatgatgttgccaaggctgatcttgaattcctgggctcaagcagttcttccaccttggcctcccaaagtgttaggattataggcactagccactccacccggtcgattaatcttttaatagttgtcgtcagcatgaaaagggcattcatacattcatattcattataatgaatttgagaatttcacattttctaaactgattataccggcatatcttgtctgaagcatgtgagtagggcagaagctaaaataaagattaagtctcacggtatagaagaagggtacagaaaataacccaaataaagagtaaaatcttgattagagtacaagcctaaacaaagttaatagatatgaaaggattaattatacagctactaaattggataataattgctctgtggaatgtacatgagaaattatttttgagcctgtatatgtgagtagtttgcatttaatgggtcccggtcataaacctcaaacatattatcatgagaagaatttcactgttgatatgaaatcttttaaactttatctgctcagtctgaaggattatttctgtcccatttcagcttataaatgtaaaaaaagagaatgtgctcctcatatctaatgagctgctggtagaccacacttcacacatgttaactgttgatggagagattgaacctgtccagctttacacactgggagaggaccctaggaagctggagaggacctaggaagctggtgtctgatttcctctggacttcaccctatgtgcttcttcctttgctttttttgttttgtattctttctctatggtagatcttagctgtgagtacaaactatatgctgagttatgtgaatccttctagcaaatcaccagtcctggggggtacagcccccaacacagtaataaatgacttaaaaaggaaaacactattccctgcctcatccttgcacctctctcagtcttaggtttttttttttcttttaggtgtttcttttgctatttgtttccttttttctaataataaactgctatttcttgagataccagtttttgacgttgtctattaactaggtattacgatagatgagggtttaggtttcttatacccttgccctagttccctgtgttcagtcctccaatatgaccatttcacagtgtgtaagtcagtattcatgttatcattatgataactagataaatattgtataatactgaacaggggactacagattctttttcccatctaacttttctttctcctagagttgatagttgtttcttattttcatttgctttgtttactgttttgtttgtttgtttgttttcagatagggtcttgctctgttgcccaggatggagcatagtggtgaggtcatggctcactgcagcctcgatctcctggattcaagcagtcctcccacctcagcctcccaagttgctgggaccacaggcaggtgccaccatgcccagctaattaaattttttgtagagataggggtctcgctatgttgctcaggctggtctcaaactcctgggctcaagcaatccgttctcttcagcctcccaaagtgctgggattagcagtgtgagccaccgtcccagcctatatgaaaaatttatccccaaagctccagtggctctttaacatgtcttattgttgctttccacgtggtcagatgtatctaatttccatcattccttggagctcttcttcctcatgcttcactgtggattagttggtcacagatttgcttttatggggacttccctttgctgcactctagggttgaatctcaatcaagtcttcctactgtttgtttactgccttgtttttgtaggaattattgagaaagtatattattgggattgtaaattattgggaaagtaaatttcttgagactattagtctgaaaatgaccttatttgttgcgggaagtcagggaccccgaacagagggaccacctggagccatggcagaggaacataaattgtgaagatttcatggacatttgttagttcccaaataatacttttataatttcttatgcctgtcttactttaatctcttaatcctgttatctttgtaagctgaggatgtatgtcacctcaggaccactgtgataattgtgttaactgtacaaattgattgtaaaatgtgtgtttgaacaatatgaaatcagtgcaccttgaaaaagaacagagtaggccagacacggtggctcacgcctgtaatcccagcactttggaaggccgaggcaggcggatcacgaggtcaggagattgagaccatcctggccaacatggtgaaaccccgtctctactaaaaaaaaatacaaaaaactagccaggcgtggtggcgggcgcctgtagtcccagctactcaggaggctgaggcaggagaatggcatgaaccctgggggacggagcttgcagtgagctgagatcgcgccactgcactccagcctgggtgacagagcgagactctgtctcagaaaacaaccaaacaaaccaaaaaaaacagagtaacagtgctttttagggaacaagggaagacaaccataaggtctgactgcctgtggggttgggcaaaaggagccatatttttcttcttgcagagagcctataaatggacgtgcaagtagggaagatatcactaaattcatttcctagcaaggaatattgacattaatactctgggaaaggaattcattcctggggggaggtctataaacagctgctctgggaatgtctgtcctatgtggttgagataaggactgacatacgccctggtctcctgcagtacactcaggcttactaggattgggaaactccatcctggtaaatttttggttagaccggttctctgctctcgaaccctgttttctgttaagatgtttatcaagacaatatgtgcaccactgaacacagacccttatcaggagttctgattttgcccttgtcctgtttcctcagaagcatgtgatctttgttctgccttttgccctttgaagcatgtgatctttgtgacctactccctgtttgtacactccctccccttttgaaatccttaataaaaacttgctggtttggaggcttaggtgggtatcacgatcctactgatatgtgatgtcacccctggcggcccagctgtaaaattcctctctttgtactctttctctttatttcacggccagccaacacttatggaaaatagaaagaacctacgttgaaatattgggggcgggttcccccgatacttaagttaactatacacttgaatgattgttggaactaattttctttcagcgtttgaagatactttaatgtctttaagcttccagtgtttctgttggcatattggtcctgatcctgtgaatataagctgcttccccagctccctcacccacaggacactttttggtatcatctttttacccccagtgctctgaaatttcatgagatgcattgtcacagttctcttcatttatcatgaggggtgctcagtggtcctctcaaaggacactcttgtacttaaattctgggacaaatttatttccttattgtgggaagaacaagaatgtattgtgcctgcaaacagtgcttacaaaatataacatttccaaataatcttttaatactggttagtgttcagtgtataaggtattgataagtcaatatttggattcccttatacaattctagattagagaattttaatttacagattattttttaaaactataaaagtgaggaaaggttgcttttagtgaacttaaggctgatatttattgataaagaatgtttacaaaatattgaatctgtttaactcgtaaactagttaagcaagttattgtttttctggaataggcctttttatgtttagatagtatcaagtttaataaactagtaggtttattcttgaaagctaatttcaggagacattaatttacttaatttctttcttctctatttatattgctttgtcctcttgcatgcgtgactgattcttactgtgtgtgctgattaatattggcataggagcagaaaatactactttaagaacaatgtataacctagtccttcagagaagtgaatgtttttaaacaattgtttagttaagtttgagtctagttttgtgaactttttgtctgtttcatctcagttgtaactgtcataactgtacttcttacttgaaatattcattttcaaatgtacgattgtttttggttctaaagtaaaattctggatatgtggtttttgctttatacttttaatactttttgctattgcagaagtaatttttttaatcttcagttctctctagagagatattgttcttttacacaggaaccagccacatgctttcattttggaatgattggaaatagtgatattgggtgtgaatgtaagctgattccccagctccctcacccacgggacacttttggtgtcatctttttatcccctgtgctctgaaatttcatgaggtcaggtccatatttgaaaaggaaagtcctttttcttttttgtttgttttttgagacagggtctctctctttcagccaggctggagtgcagtggcaccatcttggcttgctgcaacctccgcctcccgggttcaactgattcttgtgcctcggccttccaagaagctgggattacaggcatgcatcaccacgcctggctaatttttgtgtttttagtagggaagtggtttcaccatgtcgtccaggctggtcttgaactcctggcctcaagcagtccacctgcctttgctttccaaagcactaggattacaggcgtgagccactgtgtctggccaacatccatattttttaatggcttatgatcacatctctgtaaggcattcatggccctttattttccttctcagagtttttattgaaatataatttatatttagtgaaatgtacactttgataagtcttaacaaatgtatacatacttatagcccgcatgcctgttacgatgtagataggaacatggccatcaacacagaatgttctctcttactacttcatattcaacccctgcctcttctccacaccctagtaaccacagttctaaattcttttgacacctaggtgactacctgttctagaacttactataaatacagtcatatattatgtactctattgtgttcttatgctattttatgaaattatgttttgttgtatatatggattatttgtttcttattaaaatgctgaatagtattcccttatatgaatccaatcatctgtttgttggcaatgtgggtgcttctagtttctagttttagctattacaaataaagttactctgatgataagtggggttttttttgtgaatatttgttttcatttctcttgggtaaataaggagtggaattgctaggtcatatagaaggatatgcttaagtgaagatactgccagttttccaggtctcaatgtgtgagacttctgggtgctccatatccttgccagtgttagggattgttgttctttttaaattttagccattctagatgatgtctattgatagctcattttaattttaatttgcatttatttgatttttttccttgggcttactaaccatcagtatgtcaaaatgaaataaaatatagagatgaatctctaagtttaaaacattttatttgggaagcaagaattgcaattcagggcatactcacacagacctgatggtctttgctgtgtcccaagaacaaagagaaggttaggggttttatttttaaaaagagaaatgttatatattgctctgtgagaaagttcatcgcactagtaaggtttgggggactgacagtctctgagtggtgagtgaccagatgggtaaagccagtcttagagtggcagcaggttgtttcggaagtgattagataaaactagtttcaggttacagcaggcagtttcagcggccaggctggcagaaaattacattcttggagcaatggtgtgtgcccagagtgctttttcctcttggcttcttgactcagttttatttgggtatgacaagtgacccaattcatatgatcaattttcatactatattttcctttgtaaactgtttgttcaactctgcccatttttttatgggttttttatctttttattattctaaataaaatcctttgtcagatacacacacacaacacacacacacacacacacacacaaatgtagtcttcaagtctttggcttgactgttcattttctctttttttctttctctttccctacaagacaaggcctcccgctgtcacccaggctgaagtgcactgtggtcatggctcactgcagcttacctcctgggctcaagtgatcctcttgccttggcctcccaaagtgctggcatgagtgactgtggttggcctgtttattttcttaatagtgtcttttgatgagcagaagtccaatttgtcagtttttaattttatagttagtgctttctggtaatgtctgggaagtttttaccctctcaaagccctcaaaaatatgtttttagaagttgtatagtttttagctattaagttttaggtctgtaatttatgatgaattatattttgtacatgatatgacatggagagtggagcttcaatttttttcatatgcttatctagcactatttgttgaaaaagattgtcccctcattgtattcctctggaacctttgttgaaaatcaattaactatacacgtgtgcatttctttttggaatttctatttgttcctccaatctattatctgttcttactgcaacaccttactgtcctgattactgtagctgtttttcttctgtttttgtctatgcttgttggtgtttctgggtttcccagcttctatcattccaagtctatggtgtgagatagaagaaaactctgagaactcaccaccatattcctcctatcctgaggtactgaaccggtctgcctccttctgtctacctttcagagtctttttttgtttcttcttcttcttcttctttttttcttttcaatctgatctgggaattttagttgtacgtaccaggaagaatagggataaataatctttactcaaattttcaataatttacaccaggtatcctcttgcctcagaaataagaatttctgatttttgttgtttgttttcttgcctttgaatatttatacttaaattttattatggaccatttgaaacctctctcttctgcccttttcttcagtgaagtttaggcttgctatagctccccagtggtcaaacaatgtgtcctaatgcaaacatgttgttcttcctttcttactaaaccgtcatgcactcagactctcactccttcatgtctgcctttagtggctccacttatcttcagctctagatgaattaacttgtcttagtctgtttagacttctataacaaaataccataacatgggtagcttataaacaacagaaatttattgcttttcattgcagactggaatgtccaagatcaagatgctgacagatttagtgtctgctgagggcccactttctggttcatagacctggccttcttgctgtgttctcatgtggtgggtggaggtggtgaattcataagaggaggagggagtgtcctcataagaggacactaatcccattaatgagaactccaccctcacgacctagtcacctcccaaaggccccccctcctaataccatcaccttggggattaagtttcaatatatgaattttgaggggacacattcagtccatagcacaagtcaataaatatttctttagagtagcttttgtcagataatctattaaatactttatgaacaaaactgtctaattgtctttatcagtctagtatggaaacaaaaataattgtgtaccaggagaacatggaaatgtagtatagtataacttacaaatgttgtaggggtgaatgatcaaaagccacctggcattttgctgctggtattcctgcccttactcctctcttagccccagttttgtcactttctggctttggaattggtaatgactcccacaccaggtctgaactcaacatgacatttagtgtctgagcccaccttatcttttaatgtcttttccattacttcttagcaagaactgcccaggtcaggctggtcttcaccccattctcataataagtcccaaatgttcctgtgtgtctttaaccacactgttcctcctggcataaatgtatttattccctttctttgtgtgtatacgtgaagggtggttcagtgaaaaaaaagtgttttgagtcaaacagatcccagttttatctcttacttgctatgtgatttagggaaagttatttaagctctctgagccttactttctctgtttataaacatggaaaaatactgcttttctcacagggttagctaaattaatgtatgtgaacgttccagaagccacaggaactcaaataaattgttgattccctttatttcctgaattagaacttaaggcttagggcaagattcatttcttctaatatttgtctcatcagcagtaaatatgttgagaacagaaaagataccaattagtttattaaataaacatttgactacttactgtgtgccataggtagtgttaaattttggagctcaccattagcaaggtgaacacatgcatatgtaattgaaatacagtatggtaagtgctgtgaagaggtatgttcaggatgttctaggacacagaaaaggagtatttgtggcttatactggatggggtgggtcaccagggaggattcttggagaagtgttgctagtgcttgatttttttaaacagctttattgaggtagaactcatataagatccactcactcgaagtgtataatttaatgatttttagccagtttatgggtttctgcaaccatcaccataatccaaatttagaatgtttccatcatctacaaaatcatgcccaattgtaggcctagtgttaaaggatgagtatgaattagccacgcaaaaatattgagaggaaggctggattcctgggagagaatgagcaaagacagagaagcatacaataacatggtatccgtgtgggtgatatgtctataagcaattttttttttctggagtgtaaacctgtgcgcctgccccacaagttgtgttttagcttccatggacttgagctcagtttcctcatctctaatgtatagttcctgttaccttgttgaactctaggtccttttaaactctcaactcttagattgtcaaaacttcaattaataggaaaagggaatgcactttaaaaaactatagccaaggccgggcctggtggctcacgcctgtaatcctagcactttgggaggccaaggcgggtggatcacaaggtcaggagatccagaccatcctggctaacatggtgaaatcctgtctttactaaaaatacaaaaaaaaaaaaaaaatagcctggtgtggtggcagacgcctatagtcccagctagtcgggaggctgaggcagaagaatggcttgaacccaggagacggagcttgcagtgagccgagatcgcgccactgcacttcagcctgggcgacagagtgagtctcaaaaaaaaaaaaaaaaaaaaaaaaaacaacgatagccaaggccgggcatggtggctcacacctgtaagcccagcactttgggaggccaaggctggtggatcacccgaggtcaggagtttgagaccagtctggccaacatggtgaaacaccatctctactaaaaatacaaaaattagccaggtgtggtggtgggtgcctgtaatcccagctactcgggaggctgaggtgggagaatcacatgaacccaggaggcagaggtttagtaaccaagagcacgccactgcactcctgcctgggcaacaagaacgagactccatctcaaaaaaacaaaaacaaaaaaccaaatgatagccgaaagtcagggcccattaagaaaaacagaattatactgatgcttattgatccttcagtgaaaacttttttgtttttaatattttttttttctggttatgtaagcaatagtgcatattgggtagaaaatttataaaatgcagaaaaacaaaaaaagtttagatcagtcataatcttaaatccagagataattgttattaatatgctgttattttatgcatatatttatatatttaaattgatatgctgtaaataaaattgctttttcctcacatcattaaatattgtcaacatgatttttaatgttacataatttttacaggatcaaaaaacagcttgttcttttttttttttttttaatttgagacagggtctcactctggcacccaggctggagtgcagtggtgcgatctcagctcactgtaacctccatctcctgaactcaagtgatcctcccacctcagcctcccaagtggctaggactataggcgtgtatcactacacccagctaatttttttttattatactttaagttctagggtacatgtgcataacgtgcaggtttgttacatatgtatacatgtgccatgttggtgtgctgcatccattaactcatcatttacattaggtatactcctaatgctatccctcccccctccccccaccccaccacaggtcccagtgtgtggtgttccccatcctgtgtccaagtgttctcattgttcggttcccacctatgagtgagaacatgcatgcgcccagctaattttttgtattgtttttttagagacaaagtttcgccgtgttgcccaggctggtctcaaactcctaggcttgagtgatccacccaccctggccttccagagcgctgggattaaaggcatgagccaccgtgccaggccccttttcatttttttaagtgttagaataaagtctacccttctgacgcttccaagagttaacagtaattaaccgtttcttacatgttttcagaaactgtgtgtgtgtgtgtgactttatagcctatttggataaaccataatttaatcagtattctattgatagcattttagattatcttgttttttgtttttacagtactgcagtgaatattttcttgcatatatctttgcatttttgtgaaagtatatctgaagaataatttcctaaaagcagaattctggatcaaagagaatagatttaaaattttaatagctacgataagattgcttttcaaaaaggatcatgttatacttctaccattagtaggtgttctcgtgagtcttgtttcctctatccttaccatcataatggatcttatatgtgccattttgtactttgccactcttacattagaaaagtgatagctcattgtttaaaaaattataattgaagttgaacattgtttccactcattttttagccacttttctgtgaactgcctgttcacatcctttgtctggttctcttaatttgttgctattttcattaatttgttaataactctttgctttttaaagaaattacctctcccaatttgcaacttttttttttccacatttgcttgtcctttgactttatttatggtctcagaattgtcacttatggcttgtggattttttaaattgtaaagttaacatttaaagtgagtgcaaagagaggccgggcacgatggctcacacctgtaatccgagcactttgggaggccgaggcgggtgactcacctgaggccaggagttcgagaccagcctaaccaatatggtgaaaccctgtctctactgaaaatacaaaaaattagccgggtgtggtggcaggcacctgtaatcccagctactcaggaggctgaggcgggagaatcacttgaacctgggaggcggaggttgcagtgagccgagattgcgccattgcattccagcctgggcaacaagagcgaaattccatctctcaaaaaaaataaaaaaaataaatgagcgcaaagagaaaaagtgattctgatagtatttcaaatgaatatcataatgacattaaagaggaataagaattaatccaagtaactttcaaacgcagtactttgactgtgtacctaccatcctaaagaagggagaaaatgcaaacaaattttgaactcctcttacatttgtcctttgtagcatctgttgtagtaaaactattttgcatgtattttaggattgattaaatgagggttccttcatttcttttagcataactgcagtacaaaaatatagttattatcaatacatgagctgcatataaaattgcatgcatcgtagaatcagtggtctgtaattatatgaatcattaaatatatcattttaattataaaatttaattatgatgtgaactgttcatatgtagttataaagtcgtctttgtaacttatttatagttgtttagtcataaagcaaaatagtaagattttatgttggggagcagtcaaaatgaagcactttagaatgatgagtggttttttttttttaaggaattccatattctactttgagaactctacctctgattttcatttgatttattttttgaatactcgaagatcccagtgctttcaaccctgagaactgaaatgtgtgatgcatggaatatatctcgagacaataaaatgaaagagttttttacaagggggtttgtggagaaaatatttttgatttgtaaatgctgtggtgtttttgttccttggtgttaggtgactctgctaatgttttttctcttggtgcaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggagtaagtgccattttttcctatgcctagatatttttattttattttattttactttattttattattattttttgggacagagtcttgctctgttgcccaggttggagtgcagtagcacaatctcagctcactgcaacctccgcctcgaggttcaagcaattctcatgtcttagtctcccgaatagctgggactacaggcgtgcgccaccatgcccagctaatttttgtgtttttagtagagacagggttttgccgtgttggccaggctggtcttgaactcctgaccttaagtgatctacccacctcggcctcccacagtgctgggattacaggcgtgagccactatgcctgtcctagatatattttaaataaacttccactctaattacatgtaccagctgtcttctggaaacatgtgaaggcagagattcttgtttgacttttctgttctttatttttcagggtctcagtttttgtatattagagttgtattttgggatcttaatctcacaaataaaaatactgagtttccagaaatggaaaagttttctagcggatatttcctgaagtaataactcaaaatgatgtctagaaagatattaagctggccacagtggcttacgcctataatcccagcactttgggaggctgagatgggaggattgcttgaagtcagaagttcaagagcctgagaaacaaaaatttaaaccattagctgagcatggtgatgtgtgcctgtagtcacagccgcttaggagcctaggagattgaggctgcagtgagctatgcttgcaccactgtagtccagcctgggtgacagagtgagactctgtcctctcctccgctgacgccccacccaaaaaaaggtagatactggaattttccccttaaggcatcttacttttcttgggtaggtcgtgttcgctatttgggatacacttttttggaaccttcaataaagtagctatttatcttaagcaaataccatgatacattccatttgaggtcctattcagtagggaggatgaatcatttgagcgtggctttttagtatgttaaaagcaaataaagtgagttatgttaagtattccttattttgaacttcatgacattttaaattgatttgtttttgaagaattacacagagtacacaaattgtatacaacttgatgagtgggtatgcctgtgtaaccactacaaggatctggaaatagagcattatcaattttcttttgtgcctctttaaagggaatcacctacccctcccataagtaaacttcttttattgttgattgatgctgcctgattttaaacttacgcatacttctatttgtgtctagcttcttttacccaatattatatgttaaaagtaaaacttttagacaaactaaatttaatgggttttttttcttttgtgtttttattttgagacagagtcttgctctgttgctcaggctgtagtgcaatagtgtgatcacgggtcactgcaacctctgcctcccaggttcaagtgattctcctgcctcagcctcccaagtagctgggattacaggcacccgccaccatgcctggctaatttttgtatttttagtagagacagggtttcaccatgttggtgaggctggtctcaaactcttgacctcaagtgatctgcccacctcagcctcccaaagtgctgggattacaggtgtgagccaccctgccttgccagtttaacagagtttaattgagcaaagaacgattagggaatccagtagcccctaaaccagaatagatttagagcgactctggggctgccacatggtcacgtaatatttatggacggaaaatgtaaagtgacacacagaaaacagaagtgaggtacataaacagctggattggttatagcatggcattagccttatttgagcagtttgaacagttgcccccctgtgattggccaaaactctgtaattggtacaagagtagattacagtctgtgtacacatccagttaggttacagttccctatgttcggagaaacctttaggccaaacttaaaatacatgaggaggcagctttaacctaacatgtttgttagattgattcatgttattccatgtggcagtaatttgttcatctttgcactagatattgtttcattgcattatatgttagagtttattaatctcttctacttttgttgcttgtttgggtggttttcagtttttgactgttatgaatagtgcttctgtggtgtacatgtttttgtatttctgttatgtttatgcctgggagtggaattgctcatttgtaggccatgtgtatttcagcttcagtagatccctgcaaaacagtcttccagaatgcttgtaccagtttaccttctcaccagcaatgtatgaatattccacttgctaaagcatcatggtattttgtccttaagattcttgccattctggttggtgtggggtacatggtattttagttagagggtaacttaggaaatagctgttatcttttatataatagcttgcaaggtagctagctaaggaaaagaattaggagagttacagatattaaaaaaaacaacaacaaaaccaaactatgacaactctgacatggttggtaaagcaattgggcacatttgtcagtgtgtgaaaaaccagaggtttctgatgcagggaagtgggcccagtggatttggccaccatctaaagatgagggaatttctcagttcaatcctctacttaaaagagtctgcagttcctgctgcagtctccataaagaacttagcagctggtgacaggagagtgaagtgtcataggagaataactgaaacacataaacagtagtgcagttcgtcattctctgagattgcctaaagttataggctaggcagcacttagctggaaaagctagggtaggtaaagtgaacacaggttgagtatccctattccgaaaatccaaaatgctacaaaatctgaatctttttgagcactggcatgacacttggaggaaatgctcattggagcattttggatttcagattttttgggttagagatgttgaactggtataatgcaaatatccagaaaaatctgaaatttgaaacacttctggtctcaagtatttcagataagggatactcaacccgtagtatgttagaggacacgactcacgtgatgaaaggatgctcggtctactttagaaaaggattcattccattagccctctatgtagagcctttcaggtgtatctctaatgtttggtttgcctgaattccacttacacacatatgtaatataaaccctgtttcccctcctaatattgtaaggatggtaactgctatctatttgtccccctcttgtggtcaagagatgtcactgcaacatctctttttgagaagaaacccatttctttgctgggagtgcccaggaggaattggccaagaagtgaaaagctagattagctggtgccaggtggcaccgttttttggttctgtttttagaaagcatatggacagtttgacattaaacaaacatataacttatactgtctctgtttctttggcagctgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggtactgggaatgtgcacttcacttgatggtttttaataataacttcagtttcatttttcgaaggaagaaaaattattgtgaggaaaatttggcctggatcctaagccttattcatttccttgatcctaccagttgcacaaaaatccacccctctccccagcctttctttggtgttctggcatttgtttttttaatatttccttccattaggaggatttcacgttagttgttcatagcttgcagcagccaggactaaaacaaagtgaagtatactggcagcattgcttaacagggctgcattcagaccctgcttttttttttcttttgtttgtttgtttttttgagacagagtctcgctctgttgcccaggctggagtgcagtggcgtgatctcggcttactgcaacctctgcctcctgggttcaagcgattcccctgcctcaggctcctgagtagctgggattacaggcgcctgccgccacacccagctaatttttgtatttttagtagaggcagggtttcaccatgttggtcaggctggtctcgaacccctgacctcagatgatctgccctcctcggcctcccaaagtgctgggattacaggagtgagccaccactcccaggcgcctgcttttttttttttttttttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcgcggttcttagagttagtgcagtacccggtcaatacatggagtggtccaagcaagcttctgttccatctccctgctccagaaatcctagaacagatactacacccaactttagccaaaagaccaagaagcagtaaatgtttaggccccacatgtgaatgctttggtcagctacatgcaactattacgtatattagcaaaatggattttctatttatctttattccatatgtatacaaattaaatttcatacttggaaagaatgtgttttgattgggtatctaaatcaagcaatatgtatattatttaaaagtaaaaagatttcttagaaagcggtatgacttttataccaggataggatgaaagccctgacctgtagcagcatctgtgttccaaattattacattcccattattcagtgtcttggtacctcatcagtttctgtttagagatttgttttataaagttaattgttggctgaggcaggaggatcacttgaacccaggagtttgaggctgcagtgagccatgatcgtaccactgcactccagccagggcgagattgagaccttgtctcaaaaataataataataatacttgttggtcacaagtactttcatgatgagttgttaagtcatacacatgtggaatatatagagagatagacttagttttttcatttagttggttcatacgcaattctagaaggtagatttgatacttaagttttgctgagaaagggcagatatttttgataattgggaaaaccgttacataatccactagattacatgccattatttaagagtatttttggtaaaatgttacttttttatagaaaattaaataaattaggcattgaatttgagtttataactccttagtattatataaatatatttaaacaaatatttgatttttatgaataattggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataatagtgttatttttgtgttttgttattgattttattttatcaatactggataagttacagatttatcataatgccattaaaagattttcacaaaggataaggaatgccaaagtccagatgtaaggaaccactgtgaagtgctgttcagcttagactgcatttacccacagaaactatcagcgttaatttgtagcttgtttcacataattggctgaaagtgttaagtattaaaaacagcaaaaaactactttgtgttcttctgagcaatcgccactaaattacgtcacttaatgcagattgtactaaagacttaaaatcttatgtaatgtttgcaaatcatttgctttagtttccttttgttcaataagcaaaacgattttagaaacccatactttattttttttgttccagctctgttcagattaaggttatacttaaaataatccaaactttaaaatagaaattagatggggatgatttaatggagaataattttcaaagtgtttgtttgggtagctaattcaccctttgcaattacagtacaatatttacacataaaaaagtaatttacccacaactttttggaacatacttaggtacaccaagccacatttttttgtggtcagtcttgtgacttgttagaaaaagcagctggctgcctgtgtagagccagacttacacttggattgtagtttaatttttgtctttttacctttttttttatttttttgagacagagtttcacttttcacccaggctggaatacagtagtgtgacctcggctcactgcaacctccacctcctgggttcaagcgattctcctgcctcagcctcctgagtagctgggagtacaggcacccgccacaatgcccagctaatttttgtatttttagtagagacagggtttcaccatgttggccaggctggtcttgaactccctacctcaggtgatccacctacctcggcctcccaaagtactgggattacaggtgtgcgccactgtgtaatgtttttacattaaaaacaaattcctgaattaatgggcatatttgcttaatatatccatggttgctttgacttctgactgttgagcttttcaattatcatttaacttttggttaaattcacttttgaagttagttttttgggtttgttttttgttttttgtttttagatggagtcttgctctgtcacccaagctgaagtgcagtggtgtgatctcggctcactgcaacctctgcctcccaggttcaagtgattctcctgcctcagcctcccaagtagctgggattacaggcgcacaccaccacgcctggctaatttttgtatttttagtagagacaggtttttgccatgttagccaggctggtgttggactcctgacctcaaataatcctcctgccttggcctcccaaagtgctgggattacaggtgtgatccatggtgcctggcctgtttttaattattttttttattttttgagacagtgtcttactctgttgcccaggctggagtccagtggtgcaattatggctcactgcagactcaacctcccaggatcaagtgatcctcccaactcagcctcccaaagaacttggaccacaggcgcacgccaccatgcccagctaatttttgtattttttgtagagataggttttgaccatgttgtccagctagtctcgaattcctgggctcaagctatctgcccgcctcagccttccaaagtgctgggattatgggtgtgagccactgcgcccagccaagtgtagtcttacatgttagtgtttacagaggaactgtacgacctttgtgcagataaatatttcataacaagaggttcgttattggtcaggttgctgttctcatctccttagcaagggtggggataatggtaaagaaaacttgtgtgtttgattttcttttctcagtatcttctctcttctgaatttgaatgttttaaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcaggtacatggtcttctctacacatataccctctggtactgacattggggaactggggtaattttctattgctgagtcacatgtaaagcagtgaacttgagaagataggtaatggattagcttgaatacgggtcttttcctttcataatttggacagtgtcaatgtataagataacatacttgccctttagcttgtagtgatgtaatttgaatgcggtacagtctttgatgtgggtttataaacaagacctgatgacaaggatccttcattaggggaggaggagcccatggcatctacagttacagagttcgtgtgtagaattttagagatcccagttatttaatcaatagcattattgcttcgttagatcacagacacacatcaaactcaggcacaaagggacctgtcattaattgtttggtcaaagatttagcctgaggatttcattcataaggatggatcctagagagacatgttataggctctgaatctgaaaaggaacttcagggaattgggtagtgtgttaattggtatctttttacgacatacatacttggctttcctttattgctgctcagttggtgctgtcatagagtatatgttttcttttaattgcagttaatgatattttactcaggccaataaaaagggagatgataggttatatttattatcttaagccctctttttggccagtattctgagtcaccataaatcactgtcactgttattagagagtgttttcatttactaaagagcgtttcagtcaggcgcggtggctcacacctttaatgcgagcactttaggaggctgtggcaggaggatagcgagaggccaggagttcagcctaggcaacatagcaagaccctgtctctacataaaaattaaaaattagctgggtgtggtagcatgtatgtgtagtcccagttacttcggaggctgaggtaggaggattgcttgagcccagcagtgagctatgatcatgccactgtactcctctctgggtgacagagcaagattttatctctaaaaaataaagattcttctgttactcattgattacgctttgaaagcaaaatgtttctcagattttagtttgatcattaggatttcaggatctggtaaatattacattgatacttaatattactataatataatagagatggttgtatcatagaagagtcaagtgtgttgtaagagtaagttttaggtaggaaataatttcttgtagtagcttttcagccaacctaatgccctggcctcctagcatatgaacatccatacttaaatgctggctgtgtccaggtatttgtttctggagtgagggctttcaacctcaacccagctttactactgtggtgctcccacttccctcatggtcctcattcattccattgcgtctgttaaaatatgtcaaagtaagttgaaaataaagaatataagatgttttagccgggcatggtggctcacgcctgtaatcgcagcactttgggaggctgaggtgggtagatcatttgaggtcagcagttcgagaccagcctggccaacatggtgaaactccgtctctactgaaaatacaaaaaaatcagccaggtatggtggcacacgcctgtaatcccagcttaccggggaggctgaggcaggaaaatcgcttgaacccgtgaggtggaggttgcagtgagctgagattgtgccactgcactctagcctgggctacagagcgaggctccatctcaaaaaagcaccaccaccgccaccaacaacaaaaaacacacaaaaaataagatgtttaaatcagttaatactgtgatagaaaaaataaacaaatggatggcatcaacttctctatccttttcttgactttttttcccttcagatctttctggtgcttgaatacatgatttaactcatattttaccattttcttcttaaattggctattaactagcaaagactgtgttgtcattactgggtagaattttctttatgtgtccaggattaaaggatatattatgtaatagacacaaataagtgaaatagaatgatagttttaatggttttcttgtaaatctttttttcttagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggtgtgtgcaccctgcctgccacagcctgcctctgcattggctgttgtggagtccagtggtgatgggctcttgtttcctgaacactttctgtgtgtctggagctatgttaggcacactgaagtcagaaattcccatctggtactgtttcatgccaaataagtcagaataccatggtggaaagagcatagtttttggaatcaaaacacctggctttaaattcttgctctgatctagttaactgattttaggcaaattcttaaccaccttaagcactggtgttcttgctttaaaatggatcctcttataggattgatgtgaagattaccccaaatgagataatatatgaaacatgccaggcacgttgtaaatagtctaaagatgtttgccttttcttgacaaggttgctgtcatcagccatattttatagataagaatattaaaattcagggaagttaagtaacttaccctgtgtgacatgattactaattacagacccaagatttgagcccaaatcctgggattttttactgtgctattttgatggaagtaacaatgccgtgtgtgtgtgtgtgtgtgtgtgtgtaattcaagactaaataagaaagttaattacatttgattatttatttgcatgcaatttatcaaacccctgcttgcttttcttcccttgtatctgccctgagctcccaatgcttactagttaatgatgatgacattggagatggggatgtggattaagtattattgaaccaatacaaattagtgaataattaataggcaaaacaataagaatgatttttcaatcatatcttcaaaaaaataattagtgccattattttactctaatgaaataaaggataattgaaaaatagttgattcttcatctttagaaattgcacgtgttgttagtttaagataagaggatatgaaatgcaactaggtgtgtggcatttgctttctaggagtttcttttgaattgtttacatcgagatctgcagggtgggataaaggatttgtctaaagaagaaagattatgggaagtacaaagaattttgacagccctcaaaagaaaactgagagaagctaaaagacaggtgagttattattttgatacctaatgtttataatagaatgtgtttgagtcttttatgtactttatgtactctttttttttctttctttcttttttcttttgatgttgaccagggtggtctcaaactcttggcctcaagtaatcctcccacctcggcctcccccagagtgctgggattacagacatgagccaccacccccagcccaagttctttctgttaagaatattataatgtcacttgaagtgaacttctctggtgggacatttattcactaaaatgtttctagtcctatattattgatattgcagcctggtgtcagtcacatgtttcagtgcaatctagaaagtttttttttttttttttttttttgagacaggatcttgctctgtcacccaggctggagtgcagtggcacgataatggctcactgtagcctcgacctcctgggctcaagggatcctcctacctcagcctcctgagtagctgggactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctagaaagttttgttttaattaaaaatgattttactaaaaaatttgtcatttcctgcttggttatacctgtaaacagggctttctatggatgaaaaacaggctggatggtgacacacctttggggactgctggggaatttaaggcatttagaattagtcagctctttggaaatgtagtgatgagggtcacctggaaggccttgaagatcaggagagattctatttatgtaataataataagagtggcctgcaatacctgatgagtttagggtatgccagtcagacttttgagttccctcttgtttagtgtgtgttgcttggttctgggactgtgagtgtaccagccacagcaatggtaaaatcccagatctctggatcaccttaaaatccacattgcagatcaactgcagcatctaaacagcacatccaaggaacattagttagcccttgcctgaattggggaacatgatagtaggtctctgttgtggttgtgttaaagagacaaagacaacctgaatacttctgtttctttgaggttagagatttgtattaatgtggaggatagctttgtcacacggggcacattcatgggacttttacacgtgcgctccaggatatgtaatgtagcagaagccctctgcgtatttttcttccttctttttcctagctcactaggttatctatctcttgcttcctttacgtgttttttgtttttggtgttggtgttgctgttaaaattttcccttcatgtctcagcctagaatcaggtattagagatggaccactcaggcttcaggggcaaattgtaattgttaatcatatggcattgccagtcagcctttaaatgaagagtcccctgactgacctaggacagggctgatggaggtttggcttttgtttctcttgcttctacatcttgcctaaataaaggaatcatggtatagcagccagaaccaatataagaagggatggattaactttgctttaccgattttcccgatgctatgttttcacgccagctcattaattcacaaaatgcacagaagattctacaaaagtctaatgtatttttatgtattagcaatgcacaattggatattgaacctaaaaaaaaaagagacctaagtaaatggagagataaatcatggatgtggtacacaagattcaatattgttaagatgttagattttcacaaatttcaactttgaggaataaatgacttttaaagacagaagtaatgtaacttatcatattaacagactaaaaataagaaaaacccacaacatcgtatcagtagatgcagaagaagatttagtagaattcaatacttattcatgataaaattcccagcagataactttctcagcctgataaaggacatctacaaagaatctacaattatcatacttaatagtgaaagactaaatgcttaccctaagattggtgtacactgcagggatttctgctgttaccacctctattcagcattgtactggatgttctagccagtgcaataaagcaagaaaaaagacacacatattggagagaaataagtttttattcttggataacatgattatctgctgagaccagcttggtcggggagaccctaacccagtggcactagaggaattaaaagacacacatacagaaatatagaggtgtagagtgggaaatcaggggtctcacagccttcagagctgagagccacacacagaaatatagaggtgtggagtctcagccttcagagctgagagcctcttattgatagcaagccagtgataagcattgttcccatagattatagattaactaaaagtattccttatgggaaataaagggatgggccgaagtaaagggatgtgttctggctagttatctgcagcaggagcatgtccttaaggcacagatcgctcttgctattgtttgtggcttaggaacgcctttaagcagttttccaccctgggtgggccacatgttccttgctctcattccggtaaacccacaacctgccagcgtgggcatcatggccatcacgaacatgtcacagtgctgcagagattttgtttatggccagattctggggggcctattcccaacaattatctacatataaaatcctaaggaatctacaaaaaaagagctaatcagtgagtttagcaaggttgtaggatacaagaccagatatacaaatgtctagtgtatttctttatattagcaatgcacaattggatattgaacctaaaaaaaaaaataaaaagagagagacctaaataaatggagagagaaatcatgcatgtggaacagaagattcaataattgttaagatgttagattttcccagattggtctgtgggtccaaccccaatcaaaatccagacagatggtatttgtgaaaatgaataagctcttctaaaatttatgtggaaatacaaatgacctagaataggtaaacagttttgaaaaagaacatagccggaagattggaggactcatactacccgatttcaagacttactacaaagctgcagttcatcaagatggtatgtactggatagggataacatacagaagagaaagttcagaagttgacctacacatatatgggcaattactttttttttttttttttgagacggagtctcgccctgttgcccaggctggagtgcagtggcgcaatctcagctcactgcaagctccgcccgctgggttcacaccattctcctgcctcagcctcccgagtagctgggaatacaggcgtccgccactacgcccggctaattttttgtatatttagtagagacggggtttcaccgtgttagccaggatggtctcgatctcctgacctcatgatccacctgcctcggcctcccaaagtgctgggattacaggcgtgagccactgcgcccggcgggcaattactttttaatgaagatactaaaataattcagtggggaagggatattcttttcaacaaacagcgctggaacagatgcaaagaaaaaaactttatctgtacaacatatgcaaaaaatagcttgaaatgaatcataaactaagactaaaaaagcttccagaagaaaaaaaaaacaggaaaatatcttactgtccttggcttaggcagtaatttcctaaataggatacaaaacctattataaactataaaagaaaaatttgataaattgaatttcatcaaaaatttaaaaatatgctcttcaacagatattaagaaaataaatatccaagccagaagctgcgacagaatatttgcaaaagcttgtatctgataaaggacttgattttttttttaaagtttacagtttaataagaaaacaaccaatttttaaaaggcaaaaatttgaacaaatactttaccaaagatcatatatagatgacaagcacatgcaaagactctcaccatcattagtcattaaggaaatccagattaaaagtactctgagataacagtatacatcaactagaataggttgctcttggtaatgcaaaatggtgtagccattttgaaaaacagcttggcagtttcttattaagctaaacatgcggttacttaccatagcacccaggcttcccactcctaggtatttctctaagagaagaaagcatttgccctcacaaagcatgtgcgaaatgttcctaacagctctagttgtaatagcttacaactagaaggaaccccaatgtccatcagttggtaaatggataaacaaattggggtacatttattccatggcatgttgctcagcaactactgatacagacagacaagtagatgaatcttaaaagcattgtgctaagtggaagaagccagataatcacactacttactgattgattcagttatgaaactcaaggaaaggaaaaactgcagcgatggagaccaggacgggttgctagatgccggcagatggtggaggagcccaagggcactttgtgtggcaatggaaacgttctagagcatgatggtggtgctggttacttgactttatgtttgtgaacactaaattctgtgctcaagatttacactcctgaccacaccctccctaagtattacaataggtaatttctgtggaagggtaccagaaatggcaagtacattcaccagaattgagtatttttcacagtgcaggcacagactcagatctccatgttatattccaagcccagttaccaaatgcccatccagctagatggttcatctgactgttattgtttcaattctaggaaatgagaaggaaacgtgtagattggtggtggtgtgatttgttgaatatgtgttacatatgggctgactagttcttttttatttgtcttatttgacaggagtgtgaaaccaagattgcacaagagatagccagtctttcaaaagaggatgtttccaaagaagagatgaatgaaaatgaagaagttataaatattctccttgctcaggtaacctaaaatctttttctctcttttgcaagactcttttttgtttttgtttttgagacaaagtctcgctcttgtcccccaggctggagtgcgtcgaagcgatctcggctcactgcaacctgcaacctccgcctcccaggctcaagcgattctcctgcctcggccccctgaatagctgggattgcaggcacctgccaccacacccagctaatttttgtgtttttaatagagacggggtttcaccatgttggccaggctggtctagaactcctgacctcaggtgatccgcctgcctcagcctcccaaagtgctgggattaacaggcgtgagccaccgcgcccagcctgcaaggctcttaatggtcatttaaaaatagtaacttgagaagctctactacagatgtgaatattttaaccaaaattataaagtgattttgagggcctgtgtctgttttatttgtcccttcctttatgttgtgtttgttaaaatgttcagttatggcgaaagaaactaccttatattcagtaatgactctttactgggcattgttctagacgtttaatctcatttagtgtgcacacaggtccgaattataggtcttttccctaatttacagattagtggtacttgttccatattaatgagatcagacttttaaaaatattttaaaaaccgttgtacctgacattacaaagtctggaatccttgaaatgtaagaaacagattttatctaatagttgttgctaataacaccttttagatattttgattttattctttacaggtgaaagtcaattgttggaggcaaattgtcttattagtccttcattgatttaacagatatccctttcgtgcctactgtattccaggcatagagctgaagatgagctcatttctttctgaagttctcaagtcagcctcactttgttctggaaattgccagagtttaaccagaaaggaatgaagttctaggctctgaccacagtgtgtctagggttccagaaactcgtgtggtttccctgaagcccaataggtttcagtccttctgtgtcacctctgaaacatgcgttgttttgcctctcaggagcacatagttttccttgaggagaggatgagtcccagattatatctttgtttcagggtttttcagtctggtgtttgttggaatgtcagctttagtaggtatgcagaggtataggaaagacatctgtgttcaaaaatatttgagcagtactgtgtccttcatctcctggagagacgttctcagcgctgttggtgtttgtgggtagttcattttggcatgtgaccatggtaaataactaccttctcagtacctgctcatttggaaagaacgtccgcacccagctcctcatccccacagccaccttctgttactctcttaagctttgtctgccttgcttcttttctctaggtcagaggggctctctagatcttgggcagatagggattttttccccattcttttaataagactgatgatcttaccaatcttagaaatgcatattgtggtaaagcagaatattgactatttaaatacctttgggccaggcatggtggctcacgtctgtaatcccagcactttgggaggctgaggcgggcggatcacctgaggtcaggagtttgagaccagcctggccaacatagtgaaaccctgtctctactaaaaatacaaaaattagccaggcgtgatggcaggcgcctgtaatcccagctactcagcggctgaggcaggagaatcacttgcacccaggaggcagaagttggagtgagcgagattgtgccactgcactccagcctgggtgacagagtgagactctgtctcaaaaaaaaaaaaaacaaccctgaggactttaaagaggacggtggcttatggaaaggtgaaaaaatttctgtaatgatctttccttcccactgatctgccttaaaggtgatgctgacaccagccagacatctcttggatccttcttttcctagtgaccccatcaaaggtcaccatggccctgtatatgcctactttcctgagagatggggaggcattaagagtgggaagccgaagccagtttcatccctcaagtcctggcttttccctgtgggggcctcacaggggcctttgcagtaggaggatatggggttcctgtgtggcattttgttattgagaaaaatctagtcattcccccaaaataactttaccttttctcaaagaagccttttcttgaccctaatgaaataggatgtttttggttgtgcagtacgtaactcgtgttcagcactcaatggggctcaagaattcagggcaacatgggagaccctaaacaagtgacatttcctggactaaaactctcagagctgttcaccagtgttcattatttcaggagaatgagatcctgactgaacaggaggagctcctggccatggagcagtttctgcgccggcagattgcctcagaaaaagaagagattgaacgcctcagagctgagattgctgaaattcagaggtaaaggaaagccgagggttttgaagcttctgagcatgtttctttaaatataaccataattgttttagctctcagactttcctacaaaagaattaggcatgtgaaattcatcatctttaagtttcttatttatcaggtcctaagaatggtgttatattgagtagagtcctgaaaacgtggtaaatataaaaggaggtcacagacaagcacatccagtagcgtcttcctttgtctctcatcttgcagtcgccagcagcacggccgaagtgagactgaggagtactcctccgagagcgagagcgagagtgaggatgaggaggagctgcagatcattctggaagacttacagagacagaacgaagagctggaagtgagttttggggggaaatagccaaaatgcatactaacttttagaaagttgtagagaccacatatttcccctcagaattgtccttctttttcttggtcaccagctgggaggctgagtagagaggaatttagggggacatctcaccgagagtctgtgggacttgagctaagtgctggccaagcagatggcacctgtgtgtcttcctcaggctgtgaactggagttctgtgactttagtgtgacatgtagacctttctccacccgatgtaaaggcaagcctcacctgactgtgtcagcttgagcagctttgaatgacctagtctctgttcccagagaaggtgaacagaaaaatcagcgctagtgatggaagaacagtctcccgagtctccctgtgggtgaagcaagagacggagtttctcttggcctcagcccgagaagcagcaggtgagagggaatcggcgctaagaaactaggagaggctgcacagtgaagagaaggcagcagagataaaggtctagatcacagtttcccttcttaccccaaataaaatattgtgtccagatattttgcctaaggattgagtgagagaagataccctcttcacagaaaggaatctaaggatagagggacagctctgcatccctcatttgggttcgctcagtggctggtgcgaaccagaactacaccctgcatagaaaagcagaattccacacacagccaccctgcacagagtcctctctgccgagcctgcgggcagagctcagaggcaaccacgaaggttcaaggcagagacccttgctgcggcaggaatgtgctgtgggaggaagccctgcaggtgctgagaccagggttgctggagctcctgttcagaaaggcctcacattggcacctgatgttcttttcttaacattttaagatcgtattaaaactctgagtaggaaaacagaatccagaagtattgtacttggggtgtaggctgaattgctgtaataaagagaataacatagtggtttaaacaagatggtgtctcttgtgtggcaggcggtccagcccatcatcctccacaccacttttttccatgtagggtccaatgtggctgctctgtcttgccactcttagcaggactaagttagcagggaagggatcaaggcatgcccagtcgccaagggcagggtgcatgcgtggcactcggtgcttgcgcttacacctatgcccccttcgcagagcctagtccatgccacacccacgcaggggaggctggcacctgccacagagtggaggccacggcagcagggccgctgctattcctcaggacctaaactttgccgagtacatccagatgatttagaattgatagtaattttctgtagtttgattgagtaggacatttcagaattaccgtaatactattcacaaaagacaaaggatattcacctttgaaacaaatctagttttttatctgatctctaactcccctttctaattgctgctaaaattacttttattttctccttgtttaagggctgttgagaagccagttcaaagttataagttgtctattttaaacactaggatactgaattattaaaataacggttttctgttggcacatggatgtgtttctctctagtaaccaggagcagggtttccagcctcacattctcaggagtcacgtggctcactgtgcactgtgcattcctgctgtgtttgtcttctgtttcacaacccattgacttaaacaaaaccagattcctctgtaggatgcccttgctaaccgcgctctgctcctgagaaatcgtcctctgacttccttaagtgataactgccctttctgtcattccccaagataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaatcgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagacaaacagctgacttctctgttttgtgtagttaaatctataatgttaaatttatatagctaaattctccttgatggaaagtctcaaacgccctgatggggtacatttagcattggggatctggagatactgaggtgtgagacctgaggtcacctcccaagatgggctctagtgctgtgtgatcttttttttttttcactgcagctgtttctgtgaagagcacattgcttgttatgtattaggatatcttaagaacaaacacaccttctgcgtccagccaggctgagcaagatgcagcctgggctttctggagctctcgatggggacccgtgcccaattccatgtgttcagcctcagccctggcccatggttctcatgagggatagaaggaaaagccggagtcaattagcaggcagaggcttcagcataagatcccacagcttttagggaaggtgggcagtgccccctggaatgttctagactagatcccaggagacccaggagacgtgatagcaagcctgggcagaggagggggcagaaagcccttaaatgccacatgtaggggctcttttgcagagcaggaagagtactgctgcccgtcacatgccgggtcctccgaacctgcaaagtgatggatgctcattctctgcattctggtgactttgctgttactagacaagcatgattcaacaggtgttcagttcagccccagcagatctcggacatccgacctctgctcccaccgcctagctcaagtgtcaagtgctgtgaccggacatcgtgctgagctgttcccgggtctcgtgctagaaactggcttctagacaaacagtgcgggtactggaaggaacgtggactttaggcaggaaaggctttttttatttgtttgtttttggagacagagtctcactctgttgcccaggttggagtgcagtggtgtgatctcagctcactgcaacctctgcctcccagttcaagcaattctcctgcctcagcctcccaagtagctgggactacaggtgcacaccactaccatgcctggctaattttttgtattttagtagagacggggttttaccgtattgctcaggctggtcttgaactcctgagctcaggcaatccacccacctcggcctcccaaagtgctgggattataggcttgagccaccgcacccagtgtaggcaggaaagtctgggttttcttcataaccttcaaaagcagtcttgttgaacttcagttttttcattggcaaaatggtggagataatcttgatttccaaaggctgcttagataaataatggctagtaagtacctggcatagggcttttggcgtcatactccaattcattttccctacaggacatgatccgtgacttagtcatcatgttattaacattaaactttatagtgcagagatgagtcggggaagaaagaacgtagcattctttaagatgcaggtttcatttctcagcctcaaggctcagctacagaataa

SEQ ID NO: 12631 - DNA, 15073 bp, Human
tagctagtgttttcaaagttcatctgtgttgtagcatatatcagtatttcattccttttatggataaataatattccattgtgaactacagtatttttttttttttttttgagacggagtttcaatcttgttgctgaggctggagtgcactggttcaatttcggctcactgcaacctctgcctcccaggttaaagtgattctcctgcctcagcctcccaagtggctgagattacaggtatgcaccaccatgcccagctaattttgcaatttttagtagagaaagggtttcaccatgttggtcaggctggtcttgaactccttacctcaggtgatccactcacctcagcttcccaaagtgctgggattacagatgtgagccactgcgcccggcctacagtacgattttgagctccaaaatgattgtctccttcgcaatcatctgctaaacacagacataattaaaaccaattaaacaaacacaaggaaggtgtgaggtgaaatagtcgaaacgtgtgtccccacacatccaaggcagtcctttccacatctggggactggtacccagggtggcgcctagtggtacctgagatgattttagaaaatatactgggctgggtgtggtggctcacgcctgtaatcccagcactttgggaggccaaggtgggaggatcacctgatgtcaggagttcaagaccagcctagccaatatggtgaaaccccatctctactaaaaatactaaaaaaattagccgggtttagtggtgcacgcctgtaatcccagctactcgagaggctgagccagaagaatcgctcgaaccaaggaggtagaggttgcagtgagccgagattgtgccactgcactctagcctggacgacagagtgagactctgtctcaaaaaagaaaaggaaaaaaaaaaaagaaagccaatttaaagaaaatagtaagtgatatttggtgataagaagacttgagaaacgaagttgctaattgaatgactagtgattggaaaataccaactcagaccgggtgcagtggctcatgcctatcatcccagcactttgggaggccgaggtgggcggatcacttgaggtcaggagtttgagaccagcctggccaacatggtgaaaccccatctctacttaaaatacaaaaacttaactgggcatggtggcaggcggctgtaatcccagctgctcaggaatcccaattactcatgaagctcaggcaggagaatcgcttgaacccgggaggcagaggttgcagtgagccaagatcatgccactgcactccagcctgggcgacagagcaagacccagtctcaaaaaaaaaaaaaaagaaaagaaaagaaaagagaaaagaaaataccagctccaagactgcaatttgtcacacttactgtaaggccacggtgtgatttttatctatgtttgatgtggttgcttcaagtactatgctcaccactgaacacttggcttcattaatagacaaaaaccaaattttaaatttgtcccagttttcccaattttgggaagagaggccaaatgttagaccacacacaattccagcggatttcaggccaacaaagccttgatgtgtctagcccacttagcttattaacggactaaaactgcatttgtaattaattccatttcatacagaagccggaagtctctacctgaggctgaaataagaaagggatcctgtcacagaaatactagacacagtaatccacacaaggttaacaaaacagtgggaaatatggaaacaaatacctaatgccccgcctggattcgttcttttaaggttggggcgacagtaggaaaaccacgtgtcacttgcccaagcattcagccttaaagggaatttctccctcagggtctccaggaggcggggaggcggtggctcctccggccccgcccccccaccagcagagggcccgctcaccaccccgtaggccccgcccctgcgtctctgcccgccccgtggcgcccgagtgcactgaagatggcggctgctgtaggacggttgctccgagcgtcggtgagtggctgtcggctggggacaggcgtggagacactggtggctccgggaacgtgcttctcagacaggaccccgcgcttctgggcatgagggccattcgcccttcttggagggtttccgcgggtaacggacccagaggcctccctccgggaaggttccatgcgcctgcgcagaaccgcccttccccactccatcctcgcggtctcttccccgagtccctcctctttcggcgtccccggtccccaggcccatctccacttaaggtcctggccctgattctgccaccgaccctgtgatcttgggcaagcgccttcgcctttctcagactgtgtacttaagatggaaagaatgatgcctacatcaaggcgttgctgtgaacagccccttaaatactggataaaaacgcgcaaagtgctaaaaaactcacaaaggctttccctcccaatcccactcccgcgtgtttctgctgctgtttcctgcttaactgtgggcaatgcgtcgtgctcttttggtacacggctttctctggtggggttcaacacagcccctttcgttctcctgagtcattttgaacattaaagttgagcaaaccggcagagtgcggtggctcacgcctgtaatcctagcactttgggaggccgaggcgggcagatcacttgagcccaggagtttgagaccagcctggacaataatagtgagaccttgtctctaaaaaaaaaaatagccgggcatggtggtcagtgctcctggggaggctaaggtgggaggatcacttgagcccaggaggtcgagactgcagcgagccgagatcgcgccactgcactctagcctgggtaaaagagcgagactctgtttcaaaaaaaaaaaaaaaaagttgagtaaacatgtcccttgagcctttaacagactcccagaggctgaatttggctcttcttgtttacttgtcgctggtgctggaggggccttgtttttctaaggaaaaccttgaaatggtagaacatactcagcagatagtgctgggaaaagcctgcacaagtcccctggcttctgaaccctgtgttgctttaagcgcatggagtttctgattttttttttttttttttttgagacggagttgtcgcccaggttagagtgcaatggcgcgatctcggctctgcaacctctgcctcccgggttcaagcaattctcctgcctcagcctcccaagcagctggaattacaggtgcccgccaccgccgcctggctaagttttgtgtttttagtagagatggagtttcaccatcttggccaggctggtctcgaactcctgacctggtgatcaacccgtcttggcctcccaaagtgctgggattacaggtgtgagcaaccgcgcccagccggtctttgtgttcttatagttcctctccaccttccagtctcctaggagaaggaagcagaagggagtgttaagaacatgcagatccaatccatgctcttagagtttggggtttgctatttggttcacaggaacagggacagctgaaaccaccgttggcacgatgccctttcagccttcagtcaccagtccaggaaaactttctaataaaaagtttctctttccaggttgcccgacatgtgagtgccattccttggggcatttctgccactgcagccctcaggcctgctgcatgtggaagaacgagcttgacaaatttattgtgttctggttccagtcaagcaaaattattcagcaccagtaagtgttatgtcatgtcttggctggagccaggtaaaggaaaaatgaaccatcgtctctggacaggggctctgaaccctggccaaacgttagagtcacctgggagctttcaggaacacagcactgcccccgtcccaccccagacaagttagtctgtggggtgagaccaggatgtgccgggtgattctaacgtgcagccagggttgagaatcactgaggcaaactgcccttgtcacatttccatgttggttgtcagagtttctaatccactgtgttgaggagggtgttactgggagctcagatgccttctgagtctagtgtgtctgaagagctgtgagtggtgggcagcctgtgggggacctgagagggcagctgctctaagattcaaacctgtgtaatggccccagctggccacttaggaaccagacctgcctaatggtatctgtaatctgagtgaaatttagctgtttcttgagatttacactcccttctctaggatatgggctttgctaagatcagcctcagataatgagtggtatttgaaaataccttgtctagatttgactagcctttgaaaaagcccgtatttaatatgtaatggtttgtggggatatactttagtaaagcctttgtttgtgggcaaaatgttctaagagctttcgcaattttactaccctggagcttcaaaatatttctagtagtgatgtgataccacaggcttaaaactttactccactggtttcgaatcctcatccccagcagcgcctcctgtttctgttcatggcggtgtcaggcattttgacattggaactactctgtcgctcattcctgggtagaagcaagtccttttcagttttgacacatctcttgcatccattcctttctgttctttctgccccatacctcccctcaatacgtctaagatcactgaaatcgaggctgggcacagtggctcacacctgtaatcccagcactttgagaggccaaggcaggcgaattacttgaggtcaggagttcaagaccatcctggccaacctggtgaaatcccgtctctactaaaaatacttaaaaaaaataagccgggtgtggtggtgtgctactggaatcccagctacttgggaggctgaggcaggagaattgcttgaacctgggaggcggaggttgcagtgagccgagaccatgccactacactccagcctaggtgacagagcgaaactctgtctcaaaaaaaaaaaaaatcactgaaaccacctcctaacatgtctcccccttcctcctgctcctctttccctcctgccggactaatcttcctaaaaacccccatctcagccaggcactgtggctcacgcctgtaatcccagcactttgggaggccgaggctggcagatcacgaggtcaggagatcgagaccatcctggctaacacggtgaaaccccatctctactaaaaatacaaaaaattagccgggcggggtggcgggcgcctgtggtcccagctactcgggaggctgaggccggagaatggcgtgaacccaggaggcagagcttgcagtgagctgagatcgtgccactgcactccagcctgggcgaacagagcgagactccgcccttgactctgttatctttcctgctaagaagacccagcagcctagtatttaaggactgttgcaacatggccttcaaccattcctgcctgctgcctgctcttcactccgtacccttagacactctctgttctcattagactgccacacgctgctccacacacatgtcctgtcttccttcctgctgtttcctacatgccatctgccccatcccatctagacttgacaaaatctgaaccatatttaaaatccatctctagtctcatgtcttccttaattctatccctactttgtcttcctctttttagtttctgtagcacttggaattgaatttgtgcacaatctaaaactatagaaggagaaattacagttggccctctgtatctggattctgcatctgtggttggttgaatcgaaaatattgggagggaaaaatggatggttgtgtctatactgaacacaaagtcttttttcttgtcattccctaaacaatacagcttaacgactatttacgtagcatttacgtcgtattaggtattatgagtaatctagagatgatttaagtatactggagggtgtgtgtggattatatgcaaatcaccactttatgtaagagacttgagcatctgtagatttcgatatcctagaaccaatccccccacaggtggcaaaggatgactgtgcctaagatgtacagttgaaccgaatgttttgatttatactaagcactttatactactaattaattatgagaagtttaaataaaatcataggtgcttgacatagcaaatgatgaactccatatgagtgtgggttttttttcaggttcctcatgccatgcacctgctgtcacccagcatgcaccctattttaagggtacagccgttgtcaatggagagttcaaagacctaagccttgatgactttaaggggaaatatttggtgcttttcttctatcctttggatttgtaagtgtaatttctatgatgctttcgtgtcattctgagagcaagcacatatcctgttcccgcactgaattgtctatccctagatacccttgtgaaaggaaggattctttctgaccctttatcactgatggccttgttgattacagctgggatctgtagcttgtttacaagtgataaacttcgggggtgggataggacagctttctttatagtacacctctgtgctctggagcactgcttccctaagccagtctatgaaaaagttttcactggtctggggaaaaatgagaaaagtaggcataataaaatgatttttttcaaaaagcaactttattgaactgtaatttttttttcttaaaatatgtgttccctttccccattttttgatacaattcctaaaaataaaaaggtgaggggaggtagtagtacttttgccagcacaacactatagtccagtgaggatggtaaaccattttgccttttttacccttagcaagttgaactagttgttagaccactaattgttaaaatccttgtttttaaatgctctaatgagaatttctatcctttttttccagcacctttgtgtgtcctacagaaattgttgcttttagtgacaaagctaacgaatttcacgacgtgaactgtgaagttgtcgcagtctcagtggattcccactttagccatcttgcctggataaatacaccaagaaaggtatggcattgtacccctagcttttgctcttataaacttgcttggaagaatctaaatttctagctatgctgctggactatcaagatcaaattacgcaagggttgggttttttttgttttttttttttgagacggagcttcactcttgttgcccaggctggagtgcaatggcacaatctcagctcactgcaacctccgccacctgggttcaagcgattctcctacctcagcttcccgagtagctgggattacaggcatgtgtcaccacccctggctaattttgtatttttagtagagacggggtgtctccatgttggtcacgctggtctcgaactcctgacctcaggtgatccgcccaccttggcctcccaaagtgccggaattacaggcatgagccaccacacctggcctactcaaggtattttttttattattactcttccatgtctatgtttgagaaaattagcctttaaaagaatgctttaagaattagaaaaagcagccgggcgtgatggctcacgcctgtaatcccagcactttgagaggccgagacaggtggatcacaaagtcaggagatcgagaccatcctggctaacacggtgaaaccccatctctactaaaaataaaaaaaattagccaagtgtggtggtgggcgcctgtagtcccagctactcgggaggctgaggcaggagaatcgcttgaacccaggaggcggtggttgccatgagccaagatcgcaccactgcactccagcctgggcgacagagcgagactccatctcaaaataaataaataaataaataaaataataaagaattagaaaaagcatctgtagtcccagctactcaggagactggggtaggatgattgcatgagcccaggagtttgaggctgctgtgagctgtgattgcatcactgcattccagcctggtgacagcgagactctgtgtcttaaaaaaaaaattggaaaaggtctatagtattagccgggtgtaaatcttccttctgctcctttctagctgtgacctggaacaagttacttaggtttttcttgcctcagtttcctcattttgatagtgtcttctccagggtggtttcgaggaggcagtaggttaatagagtaagcagtgcttggcccgttgttgaattactgttacctatcgccgttactgttggtctcaaacattgtggtacgtggtcaagaatgttgtgaggccacacattctaacagtcatgtttgcattttgattagaatggtggtttgggccacatgaacatcgcactcttgtcagacttaactaagcagatttcccgagactacggtgtgctgttagaaggttctggtcttgcactaaggtaagatcctgtttctgatgaacttaagattatttttcatgtttagtatcattctgcttcttaggggatttatgtagaccttggtaaagcatttttaaaaccagaagatcctggctgggcatggtggctcatgcctgtaatcgtagcactttgggaggccaaggcgggaagatcacttgagttcagaagttcaagaccagcctgggcaacatagtgagacctcatccctattatattaaaaagaattaaaatttataataatcaatccttaattttagtctttaataaacactgataaaatgcctcctgcaagggttggcggtctctcagaaatgctgagacatgcatgtcccctccaccaccttgggtctctttctgaagaaggctggctgcgtcttgaggccacactgctccatactccctaactatgtgggagccacttccatggggacacacacctgacattgaagccatcagactctgcagaaggggggactagcagggtaagaggtagtctcttggaatggtgaccatcttcagccctggaaccaaacaatccttggtttgagtttttcttttttttaactcagctacttaatagctgtgtgactttgggcaactgatttgatttaaccttgttgagccccagttttcccataactaaaatgaggtggtacgtcacaggtgggtgtgaggattaaatagtgacacagctagagtttttagcatagttactggcagcagttgttaggatttctgccccagaacatcatttctatctgtattcagtcccttattaaacctttattcctttgagtgtgaaaagctttcagtcctcagcagccccacattcaaacataaccttcctgggagggatgagaacttgggtcttagaattggcatcttgaagtctgctgagaataggagtgaaggagggatagggcagaacttgacctccaggaaggaagagaggggatccccctttgatgtgctgtgcctcacagttttgctgggggctggtcagcttaaagccagctcacctggccgggcgcggtggctcaggcctgtaatgccagcactttgggaggccgaggcaggtggatcacgaggtcaagagatcgagaccatcctggtcaacatggtgaaaccccgtctctactaaaaatacaaaaaattagctgggcgtggtggtgggcgcctgtagtcccagctactcgggaggctgaggcaggagaatggcgtgaacctgggaggtggagcttgcagtgagctgagatcgcaccactgcactccagcctgggcgacagagcaagactctgtctcaaaagcaaacaaacaaacaaacaaacaaagccagctcacctgcctgtcttgtaggtgacctctggcctgctctttcttgggttacaccttgggttttagcgctgagtggcatcttagagtttgggcctttttttcctctctttttttttttttcttttcttttcgagacggtgtcttgctttatcgcccaggctggagtgcagtggcgtgatctcggctcactgcaacctccacctcccgggttcaagcagttctcctgcctcagcctcccgagtagctgggattacaggcacacgccaccacgcccggccaatttttgtattcttagtagagatggggtttcatcgtgttggccaggctggtctcaaaactcttgacttcgtgatctgcctgcctcggcctctcaaaagtgctgggattacaggcatgagccaccgcacctggcagaccatttttttttttttaaactttaaagagattatcaaacgaatgcctaggtctttcagaattgtcaatggccagagaaagggtactggctatttttctcctacggtccctttccctatgagaactcactaattttgcagttacctctgtacccgttttaatattgagattaacaagagagagaagctgagtctggcttataagataaagacttttgggagtctatgggccctgctctgtcccagctctgcctcaccttctattggtggacttcagctggctgcaccctctgggaacagtttcacctcaaaccccaggctcccagtgcctgacccagggagggagaagcatcttttatcctgagttttctctaacctgccttttccatgagtgattgatacctgaaatttccacatccttttaagacagactgttaaaacctgtaggttaaataaccggacacagtgacacacacctatagtcacgctacttgggagtctgaggtgggaggatcagttgagccagaagttcgaggctgcagcctgctgtgatcacacctgagaagagcactgcactccagcgtgggcaatacagtgagaccctatatttaaaccaaacaaccaaaaaaacttctaggctaaacatatctgcatctgtcacagtaacaccaacacagaagataaacacagaccactgtggtagcgtggttcatctcattacatgctgctacatgattaaaagtgatgggcatggttttctgttttgcatagacttagagcctgtacattctttctatgaagatttttcccgtgggatttccccccatttacccaataattcattcataataaacagttgttgaacctagataaaatacacctctgtctcttcccatttgcctataagtttcttgccaagatgtgatacagcagctcaaagaatgcttgccaagtcactaatagtctttgctctctctagttcagtgactttccgatactgtgtaacattcagggcactatgtgaacttgtaagtgtgaccatactgcatgttttatggtgacctggtccagtactgcctttgttaaagcatctgtcatcagtaagagatgataagttttttgcacaacagtgaaaaccccacctttaagcatatgattacgcttaataaatattttattaaaaggagaattaaagacctaaaagggaagaagttagactgttctagttctggtactgttgaggcactgatgaggataaatgatcatgcagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacggtaggtttttttccccaaaagcagtgaggtccatgttctctcagcctcgagagctattgacctgaaatatccacaaaagggagcccactcttgaagcaagcgtgcagatgatatgcaaatgggtgaagctgctgtggggtagagggggtggggtggggagccaggaaccaattatcagagacaggcaggcctttttttttttttttgagacggagtcttgctctcgcccaggctggagtgcagtggcgctctctcagctcactgcaagctccgcctcctgggttcacgccattgtcctgcctcagcctcctgagtagctgggactacagggcgcccaccaccacggctaattttttgaattttagtagagacggggtttcaccgtgttagccaggatggtctggatctcctgacctcgtgatccacccgccttggcctcccaaagtgctgggattaccggcgtgagccaccgtgcccggcctagagacaggcaggccttaatgaaactttcatctttatgttttaaaggaaatctttaaaagtttaaagaactttaggttaaaaattgggagattgccactcacttttgggactattattatggtaaagtcacagttacctaattaagcttttgtattttcagatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagtaactgttggatcagcttattttgggctctcctttccttctcagattatcaacaaacatttattgagcatttacctcaggggccacaaagagaataagatgctggttccgcactcaaggaactcggtttaggggcaagacagatagggaaacattttctcgttgtttcagtaaatccttgagtgcctaccccgcaccaggtgctgttttccaggcacaagagcgaacaacggacaaacccctgcttttaagctcttacattctagaggggaaacacctcatacatgtagtaaaagtagagtgtttggaaggaaaataatgtggagtgaaactgctgaagcggagttgtaggtgttctagatggggttgtcaaggaaggccttaagggagagcctctctggatcaattttctcattgtaaaatgaggacaataattgtacttatctcagggttttgatgagcatcgagggagagaaaacgcgtagaaagtgagagtattacggggataagagacttctaggcagagggcagggaaaacacaaaggccgtgaggcaagagtgggctcagagcggatgcagatttactaggaggccggtgactatggctgtggtgggggtcccagagtgccttttggccaggccaaggactttaggttctgttctggggtggggaatgtcaggaaggatttgaaaagaagagtgacatcaacttgttctaagagaatcactctggctcctttgttaagacgacatagcagtccaaagtggggaagcaggccagcgggctggctttgtgacatcctggagggtagagacaacagaatagaacagcacgctacatactgcactggtgcttagatggatttctgcggcataagggtagaagtggagggggcaccttactcaactcggagggtcagggaaggcttcctggaagaggagataaacccctggaggttaagaaaagtgagctaggcaaactgagcaaatacagaagcagagtcatacaggcctgaaggacgccatgagccaatttcctgttcctggaggcgcagggcaagggaaggaattggcccgctggaggttaatggccaatactgagcacttctgagggctcagtgctgtgttagggatgttttatctcctttgatcagaaacaaaaccctgagataggtacaattgttatcctcattttgcggatgggaaaatagacttcgagatactgacttggcgagggtcacacaactagatgatgtgctgggtcccccagtcctggactccggaggccccctgaacgacctaggcacacttgtggcttccgtgaatttaagtgcacacagcccccgcctggccctgtgctggggaagggcaggtgggaggaggaagggaaggcaggtttttctttacaaatggtacctatttggtagtcaacaaaaggaactggatttgccccaacactggaagaaaaaaaaaaacaacctgttgggctgagggatagtgcactgtgcccagggccctatacttggtttgatgctctggtgttactctcttgaaattctcagtaacatgaataaggggcaccgcatttgacattttccctgggctgagaccatgatgcagccggcctgactgcgcaacaccatgcacactggaattcgtgggccatcggagggattttcgagggtaatgaccaggggtagggcgcggcagaagcgcagggtgaggttgcggacggcctcactcacaacctttccgggtcttcgcattaggtactgtgatgacgggttccgatagtgaccccttggggcctggagacggcccggctccccaaaggtgcggagcagggcaagcagggttgggaggacgtggcccgtgggagagctgcgctcgccggaacagtgggcgcgcaagggccccgaggcgctgtgacacgggacgtcgggcgcgcgggcctggggcgggaactgcgggtgcgcgcg

SEQ ID NO: 12632 - DNA, 44120 bp, Human
  misc_feature (1)...(44120): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagcaattctgcttcagccccccgagaagctgggattacaggtgctgccaccacacccggctaatttttgtattttttagtagagagagggtttcaccacgttggccaggctggtcttgaactcctgacctcaagtgatccgcccacctcggcctcccaaagtgctgggattacaggcatgagccaccgcacctggccaacaactcaatgttgaagaaagcagaattggaaacgacctaacttgcaggtcatgacattttacatcagtcattcttttcttgtttctgaatgtaaaccaaaaaggcttaaccaagacttactaaatacactctcactctttcactttaaggcaatttattccagtatacttagagttgggaaaattgaaatactaatttctaatatgactttgtcaatttaatttttaataaaatgttttaaatatttattttcatgaaattttgggctgcagatttaactaattcaagtcataaaaacttgcattgcattatacagacctctccccacttactccaacttgacttttgtctacacacggctggtggcaacaattcacagccactgccaaagaccagcctctctggtttcacgtgggcaggtccatccctgatgctgcactcaccctgggggcactgaactatgaagcagtgaaaccaccaaggctgcctctgagagctgccaagtgctacatcgggtaagcaagctgcctttcacttgtcaatctttaattagtggacaaggggctcccatgcaatttgggacacgggcctgctcacaatgaggtctactgatggcacccctggcttctgcagtacataacaagtgcagccttacacagtggctctactcttgggggggatgaagcatttatcagtgctacacactgtaggtgttcagtgcaagaaaaaacaaattctgtgattcttcattaagtgtactgaacttaatgttaaaatgtatgtactggactgttaataactcatatcacatataaaggataccctccttcaatatctaaagaagtccttaaatcagtaagaaaaacaacagccattaggaaaacaggcaaaggctataaacatacagctcacaggaaaggaaattccaatagcttaggtactggaaataatgctaaacccttctcataagggaaacgcaaattaaaacaaggagattctatttttctgctgtgaaactgacagagatccaaacacctgagttgcactgctgagggtttggggaaggccacttcccacgggagctgctggagatagcaagggcagtgggctgtagaacagctgagctacagctatcaaaattatccccctagacacagcaattacacttctgtaagtttttctagatagacccatacatgtgcaaaatgacatatatacaaatgtttactgaggaacaatttataataataaaaaggggaacaacccaaatacctattaactgaagactggttaaatccacggcggtatctctgcagaggatactatcagccatcaacaggaatgaggcagccatacttgtgaaatggaaagatcttcaaaatacgttgctggggagccagggaggaacactagggtactaaacagtgtatacagctggctccattgtatgtgtgtaaatatatgcgtctgcctgaacatacctgaaaggacattcaagaatcttaacactagttcggggtaggaaggagatcaacttttcactatatacccttttgttccttttaagtcctaaaccatgaaaatgttttacctagctagctagcaaaatgaaaaaaaaaattactttattaaaacatttacaatgcaattaagaaagcacaggttgtctttgaaggatggggtcctaagagagttcatttctagctttatgacattttaactaaaacatgtattttatgataatcaagtgaatattaaagtataaaaaaggaatttattattattattattttagaaatggggtcttccactgctacccaggctggagcgcagtggtgcaatcatagccactgcagcctccaactcctgggctcaagggatcctcctgcctcagcctcctgagtagctgggacaattaaaaaaacatttttttggctgggcacggtggctcacgcttgtaatcttagcactttgggaggccgaggcgggtggatcacgaggtcaggagattgagaccatcctcgctaacatggtgaaaccccgtctctaccaaaaatataaaaaaaattagcatggcatggtggcgggcgcctgtagtcccagctactccggaggctgaggcaggagaatggcgtgaacccgggaggtggagcttgcaatgagctaagattgcacccactggcactccaccctgggcgacagagtgagactccgtcaaaaaaaagaaaaattttgtagagagggtccccttatgttgtccatgttggtcttaaacttttgaactcaagtgatcatcctgtcttggcctcccaaagtgctgggatggcaggtgtgaacgcctgagcccagctcttctttaatgaaaaattttaaaatgtcatcagtaagtgggaaattactaaatgatgacatatacaatggtaggcactgtgactgtcatggaggatgtctgagatacattaatgaatttttcaaaaggctgcaaaatggtgtgtatagcaggatcccattttccccagacaaaatcagctctgtgtgctcacctaggtgcacatggacacagaaaaatgtcagcagggccgggcgcggtggctcacacctgtaatcccagtacttttgggaggccgagacaggtggatcacctgaggtcaggagttcgagaccagcctggccaatatggggaaaccccgtctctactaaaaatacaaaaaattagctgggtgtggtggcgggtgcctgtaatcccagctactccagaggctgaggcaggagaattgcttgaacccaggaggtggaggttgcagtgagccgagattgcgccattgcactccagcctgggcaacaagagcgaaactccgtctcaaaaaaaaaaaaaaaaaaggaaaaaggaaaaatgtcagcaggacacagcacaactgtctacacactcggttatccccctagggaataaaacctcaggggccaccagtagaagggatgacagctttccctttctgcactgtatacacaatctatgtgtactgtttgaaaaaaccatgtacaagcactttgttttaactttgacatgaaaacattaaacacttttttttgtataagaccagctatgggagctcacacctgcaatcctagcacaggagggtgaagtgggaggactgcttgagcccaggagtttgaggctacagtgagctatgatcacaccactgcactccagcctgggtgacaaggcgagaccccatctcaaacaaacaaacaaacaaaaccacacatttaaatattgaacactgaagtttccagagagcagaactggccagctgaaactgaccacagagggcccttgcacttgtctgcagcatcagcctccctagatctccgtctcagtcccactgagaaatcagctcagcctttctctcctattgtctttgccccatttggcagtccaaagcccagtgtcactggcatggcaggccctatggctctgcagaggggccgggctaggcagatgcctgctgtgtgcttgcagcacaccccgtgggcctggccactttagtactctcaggtggccgtttccttgtgtttttcacaagccgtagacagcatctagtatgtgactgttctcttacaaacaggggattctcttcttcctgcccagctgtgttgcacagtgaatcctagctgactgccttctcttagtaggcgagaaaatggtcaccgtccttccctaagcccccaccaacttctctccacccctttccccacccaacctagcaggcagcacctggcaaaactacaacataggtattgggaggaacaagctcggggctggtccacactcggtgctagaactgtcacattttacaaaggaaagacccagggcagctgtcaaaatagcctgggacctatttcattacaatagcagaaaccaacaactgaaaatagtaggtggcttttggcaaacatagaaccccaatcaatcagacctgagctagctctaagtggacggagatgctgaacttgactccctctgcagctcacaccatttacccagcttcctcaatatttatagcatgaatagccatgaagttttctgtgctcttgatgaaaggaggaagctggtgacttctgaaaaatattttgccactgtctcatagcaacagatgttccagttaaatatttgggagtcgtgaactgaacatcttctgtactgatacggtgtgatgttagtcagtgactccagacagttagcaggaggctgccaactctaagctttttggcagtggggctgcaacaggtccccagggttttctctgagtcccccctctggtttcgagctcacaatgggtgatggagtaagtgtcaagggtctgtgcactcctgccccctcttctagccctgaatctggaagaaaaagttagaaatacagaaagaggctggaagaacgtttacctttctggtgcttcattcttttcccacaaaactttccaacaatagagtaggtatgactgctatgcaaccagcaattcattacagaagtttttcttttttttgagacagggtcttgctctgtcgcccaggctggagtgcagtggcgcaaacaccgctcactgcagcctcagcctcaacctccctagctcaagtgatcctcccacctcagcctcctgaatagctgggaccccaggtgcacaccaccacgcctagctaatttaaaaaaactttttgtacagagggtcttactatgttgcccaggctgaccttcaactcctgggctcaagtgatctacttgcctcagcctcccaaagtgttgggattacaggcattagccactgcccaactgggaagttttctttttttttttttttttgacagggtctcactccatcacccaggctgcagtgcaatggctcaatctcggctcactgcaacctccgcctctcaggttccagtgattctcctgcctcagcctcccgagtagctgggattacaggcactcatcacgcctggctaatttttgtattttcaggagagacagggtttcaccatgttggccaggctggtctcgaactcctgacctcagatgatctgcctgtctgcgcctcccaaagtgctggaattacaggtaactttcacttttaaaagtatacactactaatgtaagtgagtgtttcctaaatcatttcaaactctatttggaaatggaatgacactggtttattgtaatttaccaactctaactggaacaatatggtataaagccagtgaggatggatcatctccagttcacagacaattctgcctcttttactggagaacgacttaaaaactatttagctaaacaatatagaatgtttatacattctggatacttctccattctccataatatgttattttaacaaataagcatattcatttaaacaagtcacaattcttaactcaaaatggtgtcaacttgctaaaattcctattaaagacatatcatgttagtacaacctgttgaaaacttaaaacattctgaatcaaaaatagggttgcaagtcagatgaagcaaagatgcaagaagcaatttcggggacagtttttatgtgccaaaggtcatttctaacatttttgaaggcttacagggacaattagataactaaatgggcaccataggtctgtcttaatttgtcttaatcttcgtgatcccatttgtcaacagctagaaagaccttacactctcccaatgttcaattcaaataaaccaaagaaaactcacaattgctaaagtggcagctgtgagaaactagcttctcaccacttcaatagtttgtgatgcactcatgtcataaagatcagttcatggcttcgactctctcttgagacctggccaggtcctggctgcactgcgttgactgctggtgggtgaggcctcctcggggcacccatccagactgggttgggtccctcagttgctgccaggcctggggcagactgggccggggccagacagccatgacctgctgaaaaccttctccatgaaagctgccttttccgtgaccacacctttgagacaactgatatcttttttttgacagagttaaggcatgcaaaagcatatgaaaaataatatgaatctctacacacctactacccatttaagaaataaaaccggccactggtacatgaagccctgtgtaacaagtgtgagtgtgaacttactcaactatgtagaattatatacttttttcctattttatctcaaaaagcagtaatgggtgtggcatgagtttcggctaaccacccttcccctggggaacagtgcagcgtgcgctgagttgcattttaatgtcctgccttccagctcctctatgcgtgagtcctggcgtgatatgtgtgcaggtttctctgttttacgctgacaatttacgtcagtgtagaatagaagggccaaattcagagctgttcttacatttcctataaagtagttcttaaagccctgagtctctcataaaataagcattcagttgctacgtttctttgaaaagtttaatttcaggcaaaagtgcagcaaaaactacgctctcagacactgctggtggcattaatccaattggaagtgtgtaaaaagggcttaaatctcttcactctttgacccagtaattttgctttttgagaatctattctgaaatcaaagtcagaaacagacaaatttaagtgaatcaagatgttcaatattccttttaagagcaaaaagctgaaaagaaacagcttcctgattattggccattataaagttgcataaagaattaattacacattatggagctattaaaaattatggattttagaaactaaatgtgaaatatggtttataatataatgttcaatggaaaaagatataaatgataccatgattacaataatgagagtcagcaaaaagaaacaaaggtgaaaaaaatacctcagtgctgacaataattacactaagatgatgaacatacagaatttttttttaactctagttttaaacttttaagagtgtggttatattagtttttgctaaaaaaaaaaagcaaagtttaaaaagcaaagcaaagtacaaattaaaaataaatacgaatcactcaggatggtggggagagctcccttttaaatatattaaaagcatatattcccctttatgagacaatgtcagctgtgtcacctgctgtgcttccttttttggatttagttgccagaaacccagagctaaaattaattctcagccacagctgagctcacagttgactctgtgttgtaaactgctacatttatgcctgtcttttactgttgtttcatatccttctttgaagaaggtatatattttacatatgtaaaactttaagatcttttttatctataaaaattcacagatatgcttgtaactgtttcccaatctcaggaaggactcctgcgagggaggcaggcagggagggaggtgggttttcactgtatggcctttccagctacgcaccatgtgcacacactgcctatcaaagaagaggtgtgatttctaaaaggtgtattagttggaaatacatgaattgtgtctggtaaagcttactgagactacggtagactcagccaactataattcagactcaagaaatcttagctgtccgctcgctcagattctcaccaaaaatccactgaacctcaaggagaagactgggcagaattctacaacaagtgggggagatagggccatttcttctcgcagattcttacaggggtctgtgaccccaagatgcttggggggggtccttcatttcagatagtaaaatgaagacccccagagaagggaactgatgctgccagcgggcacagagctagggtcagctgctcagtttccctctcccggtgcggtgctctttcttcctggctatgttaactctgtgacctgggaatgtggtccagaaagaagctgtggctgctgagtctatacctacttagtaagtgagttactcaatgctgatctgtataaagtaggatcgtcctttttcctttctcacaatacagaatattaatgttatccaagtcaggtctttattacagtactcagagagcagtccctctgaattgacaaggatgacactgggcaagaggagctctcagacaccccccgtgggcatgcaaatggattcagctcttctggaggccaatctgcaatctctatgtgtgagcatttctgcagaacagattccttgaactggaactcttggatggaaattattgatttgctcaatctactaagtagttctctgaacagctgttattttcccaaacaccttcaccaacactaggtcttagcagcttctgaaatactggccaatctggtgggagaatattttgttttaattccctcttgcctctagttagtagtaaattttgtccccaggtatttatagcttttattacagttgtgaataggatgtgttccccagtgattattgcttttaatgtgattcatctgttccagtttgcctgggaccctggcagttttagcactcaaagtctagtgtcctggggaacacctcccagttccaggcaaatcagaaagattggtaacctgatcgcaaaactattaatttctgaatattttatcttgtgtctggctcccttactgaagtcttgtaagtgctagtcatttttcagctgatagcctatctggaaactccaagagaatcatttcatcaacaaataacacttttgtcttttcctttacatgatttgcattttttctttctctggtttttgtgcactggctaaagccttcagaacatggaataattgtagagacaatggacatctgtttcttatacctaattctgctgggaatgcttctaatgtttcaccagggagtgtaatgttgctatgggtttctggtagataatctgtaaataaaggaagtttctttctacttccagcttacatagaagtttttttgtcctctacaaatcaggaacacatccaaaactttatcttttttttttttttttttttgagatagaatttcactcttgttgcccaggctggagtgcaatggtgcgatcttggttcaccccaacctccgcctgctgggttcaagtgattctcctgcctcagcctcccgagtagctgggattacaggcatgtgccaccacactgggctaattttgtatttttagtagagatggggtttctccatgttggtcaggctggtctcaaactcccgacctcaggtgatccgcccgccttggcctcccaaagtgctgggattacaggcgttagctactgctcctggcttccaaaactttaatcttttttaaaaaattgtttcctgctgggagtcagaaaaaaaacccacttttttgggtcatctattaagatgttgtctttaatctattagtagacttcttaatgttgaaccatccttgcattcctgggatgttgctagtatttctcaaacacttattttgtactagacattctaagtgtttatttaatccttacatctcactaagaggtagccagtcccacttgtgatgaggaaattaagtcacaagtaagttaaataagtctaaggccacatagtgagtggaagggccaaaatttaaacccaggggagtctggcagcacagccagactcctaaccattacactgtctgcctctcagtcttacttggtcacaatgtgctattaatatattttttaaaaaacacaactgcatttgatattctaagtattttattttggatttttgcatctatatttttaagtaagtttgatatacagctttcacttgtatgttctagtagaagctacctagcctcataggaaatgttgggaagttttccatcattttctctctggaatggtttggataatgggattgtctgttaccctctattaaactatctcttcctggtgccttttgagaaaggggttggaatgtagatttttcatgatgtatttgattcctacaccatagtgcttttaagccagaatcagtcttcaaattcttcacattttcttggaacacactgcttttcacaggtattggaaatatgtttgattgagtgaggaatttttttttttagcaataatgtcaatagatatgtggtctctaacattaaaataggtgggaaacttccaaatctgccacctatcctgtaggttctacttgataacactaatggtaccacttcatgtaattttatataattttcttcagaagtctgcagaaagatatgttttactatcattttttaggtggaagaagcaagaaaaaaaggatttacctaattctgataaaaccaatataggaaccaaaaacaaatggcaaaataactttataatgatggggaaaaagaagctaatgtctaaaattgtttcttggtttttgtttttttgttttttgctatttttgagatggagtctcgctctgtcacccaggttggagtgcagtagtgcaatctcagctcactgcaacctctacctcccgggttccagcgattctcctgcctcagcctcccgagtagctgggactacaggcacgtgccaccatgcccggctaattttttgtatttttagtagagacagggtttcaccgtgtcagccaggatggtcttgatctcctgacctcgtgatccgctcgtcttggcctcccaaagtggtgggattacaggcatgagccaccgcgcctggcttgatttttgttttttaatcaagaactaccagtagaagaatttcatttagagatatagaggttccttcccaccaaaaaagtcaagatttaaaaaaaactgttccttgtgatgaacccagctagggatgggaggggtggggctgggaaccactgatttccattcacactttttctatgacacatgatgctttaaatctggcatataaaatatttgatttaaaaaaataaaagaagaagaagaaagtgagaaagatggaacctaccaaagatgaagttgtcaggccggaaaagctgcccaaaaggcccagaccgcacgctgtccatggtgcctggctctaagtccaccagggcggccctgggcacatatttctgagctggaggagaaaagaaccacccacaagagttactttcaggtttctaaagtaattgacttccccgtttcaagtcccaccagttctagctgcctggaatggatcaaccagggtcttttcagaaagggtacaggaactttcttagaatcacagaattggctgggcgcactggctcatccctgtaatctcagcacattgggaggctgaggtgggcagatcgcttgagcccaggagttcaagaccagcctgggcaacagagcaaaaccctgtttctaaaaacaaacaaacaaaaaaccaagaaaattagctaagtgtggtagtgtgcacctctagtcctagctactctggaagctgaggtggcaggatcatctgaacccaggaggtcaagactgcagtgagccatggttatgccactgtactccagagtgagaccttgtcttttttttttttttttgcgatggagtctcgctctgttgcccaggctggaatgcagtggtgtgatctcggctcactgcaagctccgcctcctgggttcatgccattctcctgcctcagcctcccaagtagctgggaccacaggtgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccctggcgtcggggcagcggagccgacgtggcccgcggggtcccagcgccgcgcccgggagcattgcagccgcccgcgcccagtccagccaagccgggacactgccctggggttcggcagtggagcttttcagggtctctgccccctgccccccaccccccggtcgcaccccgggcacacgttcttagggcctcttcgtcctggtgtttccgtctccggagatacagaggccattcctctccgacgactcccacccctttggaaccgggtttagctaaagtgactacagggctggatccgaaaatgaacacctcctgcgccgggtctatgcagcctactcctcgcgcgttagcgaagaaatgcgcttcggcctgggagggcgcgccagagtccgtcttcctggccagttttgtgtggtggaaaggaatgactgctgatgccggccgggtgacttggattttaattctagctgttttcagttagctctgcgcttcagcggactcctctgttaacggaaaaggttatcctaggggagcctttcagcctccaaaatgcgggatgctctggcctctgcagtcagaatgtgcatgcatcagggcttttgcggaagtttcctcacgtgaacgctgcaggctgggaccaccggggtagcctctgcgtcccctcccaggcccgtagaaacgccgcacatgaggaagcgacgatgttctgtaatttgcactggcactttctttttagacagatgaaaactttgggaaattcctaattgtgtgtgtgcatgtttgtacgtttggaagggagtggagaacttttaaaagtttttcttctggagttttgcaaatgtttccaaattgaggaatttttttttttaacccttgggtccccgcctccccactgctctctccaccccagtgctgctcctcggccttcttgtgggtccccacacctctttaaacagccacacgcccagggagcagatgaggaggccacagcccagcccctgcgctcccatttcaaactatgagcctgagattaatcagccaccttctcctgagtcctcaacacccttatttaggctgtttgtttccattgcttaattattgactccaacgagtgctaccttaacccatcctgccggcccgaagtctagtgtggggagcccgagagcggagggcctgtgccatccctggaagaacccttcctccagctttagtctctctctctaagaaatccagccatcaagtggtttaaaagaaagtgtctactttagaagctttggtcgtttgctgaaatagccaccctttcagtgctagcccttgggctggaatttaagtccaggggtctgatcgagccagaaagtaggtgtcagcgtggcttccggaagtccgttgtcacttggatttgacaagggacaagccgacctgctggtttctgggctcctgctcgctgtgcgctctgcgctgtctgcagggattggtgcccgcggagtgcgctttgtctggagaaactcagtgctcgaagagtgaggagaccgggaggaaaccttccccctgcaaagcttatctcccttccctctcatcagaggcggggccccgcaagacacaagggatttccccgcagaatgaaccaaggcctccccaggacatggggacagttctgctgtgcaaagcctgaattcacgtttctttcctaaagtggctcccagtctctctgcagccttggcctctctttgaatcccaaccctgacttccctggtgtctgttggccactcccttctgggagccggcaggtgaaaccctgacctgtgagcccggcctggggctctccaggctctgggccccctaccctcccgatctgtggccctcactcctcctgggcgaggctgtttgtgacgcggtgtgtccaaatgcacacaagccgcaaaccaaacttaaaaaagcgtagaggacacattctcttctcctaccttaaaaaatacaccatggtatctggaaagccaggttccagtttagaattctcaggctaggccgggcacagtggttcacgcctgtaatcccaaaacttccaaagctgacatggcaggattgcttgagcccaggacctcgagaccagcctgggcattatagtgagacccttgtctctacaaaaagttaaaaaattagccaggcatggtggtacatgcctgtacccagctactccagagtctgaggtgggaggattgattgcttgaacctgggaggtggaggttgctgtgagctgtgatcatgtcactgcactccagccagggtgacagagtgagaccgcgtctcaataaaaataaaataaaataaaataaaaaagaaatcggtagacttcttgggctcctcgttgatttgcatcagggcgtggaagtgcgggggctggtctcagcctgcagtcctcactttcaacacccgcctttctccccacctccaattctgtcccacgccgagatgggtctccagtacatgcctgtggacacttcagtcctcagccactcacagccatcccaggccaccctgcgggaagaaggggccctaggagtaggtttggggaggtctgggcagggactcctgaggtccggggggctgaggtgccatctaggagctgtgggctcatcccagtggccctgtagggagggggcaggcaaggacaaggcccctcacctgggtcgaaggcagtgatggcgttcatgacttggtgctctgggcgagccacattacccgtgcactcctgtctgctcactttcctcctcctcttgcccgtctcttctgtgccttagatcacagtcttgcttctctgaacgcctccttctgtttcatgcatgtgtagagaggattccgggctcactgcccagatttgaatgctggtgtttacacacacctggaccgtgggagatggctgatgagtgtttcttcctctctcgcccttttctgggctgcaccaaggaataagacaggagggtctcgtcctccccaaatgctgagaagtccctggggaaggggacccggaggggccaatggggctcttgaactaggctggtaatggccgtgagtggtgttattttcaactaaacccccaaatctggaaaaatgaatgacatcagaccctggtgtttttatgtgacgttcctcttggtagataaaatatggagtttctccagaaagaagtggatatttcacctgccaactgtgcagggagaggcagaggccgggacaagaagtggagagtgggagggtgccatggggaggctgggaaggctggggtgccccagtgttgactctctctaggccctgggagttgccacgtggacttcaaggactggaacacacttcctgctccccactgcctcgctggggaagggaacctgcggctcccagcagcaagccaggcaagcaggcatcagttctgagttaggctgagaataagctctcctgctatctggcgccttcagtgaagcgttgtcagaatttactctctgcaggttctcccggaaagagcagccatggtcctcctgatctggtgagtgggcacaggggccagtatcgatgggtggatgaatgtaaccatgatccatggtgttcttaggtcagtcggcctgagcagtcttggttacaaatgggggagtcaaagtttataaaggcggcctggggatctgctaaacactagactgtgtttgcgcagtcaagttaaatgtattctcttgggttctaattcttttgcaaaataatatttcgtgcttgctttggcagcagtatactagaagtggaatgatacagagaagattaacgtggccctgcacaaagatgacatgcaaattcatgaagcgtttcatatttatttatttatttattttgagacacagtttcactctgtcgctcaggctggagtgcagtggtgcaatcttggctcattgaaacctccgcctcccgggttcaagtgattctcttgcctcagcctcccgaatagctggaattacaggcgcacatcaccacacccagctaatttttgtattattagtagaggcagggtttcaccatgttggccaggctggtcttgaactcctgacctcaggtaatcctcctgcctcagcctcccaaagtgctgggattacaggtgtgagccacagtgcctggcctaaaaaaatttttttttttttgagatgcatttcatgatcttggaaaaaggacagaagtggatgccagtaagcaaaaacactgtcacccaaacagctactgggtagactttttacctacaaaagtacacgccctacttggctgttgacttgtccattttctttttttttttttttttttttagacggagtcttgctctgtcacccaggctggagtgcagtggagtgatctcagctcactgcaagctccacctcccgggttcacgccattctcctgcctcagcctccggagtagctgggactacaggcgcccgccaccacgtctggctaattttttgtatttttagtggagatggggtttcaccgtgttagccaggatggtctcgatctcctgacctcgtgatctgcccacctaagcctcccaaagtgctgggattacaggcatgagccactgcacctggccaaaattttttttttaaagaaaaacaatatttcacatagagtattaaaataataatatttgatcaaccagagaaccatgctcacaggccaaatggctatgagaggagcctgttctagagagtcccagggagtgcctgggacagggacaacccagcatagtacaaggggctctgggaagctgcaaagtgcggggctgtcaggtcagactgctggggtgggcctgactctagagtcatgtgctttatgacgggccagtagttcatatgactggcctcggtgcaccttgagaccctcagctgtaacgtggggtcccagagcacccaacgctgagggtggtgtgtgaaacaggcaagacaaccctcgctggaggctgggtgtggaccacaggccctccctacatctgcagggcccagggtaagtatgcagatgggggcccacagggcacatgactgtgtttaaagttatggaatattactaatagtatgttttattttcatgctttgacaaacatgtactttcatgtcactctagtaggctaggtttgaattgagaacttcttgatgggtcgttcagaattctctgctgatttggaccacgttggagagctggccccagccctcaaactgatcctcttatctttagcaactcctgtttgcaccatggggccctgtttgaacacagtgaacatctggctctatacgtccaagcggttaccctccctgagctggcggggtcacacatgctggtggtgaggcctgctgcagggaggctggtggggcccacatcccttggtgcaggcccagggctcagagagttccagggtgggtgcccagagggaggcctacaacacagaggcaaatctccttggccttgcacgaggctcactctgcggggaactcatgctgggggagcccgacccagggaccccctggcttgaatcaaaggctgacagtgcttccaagtgaggtggggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacaggcctggtgggcatagagttccagctaacttccaaggagggacagggcctttccaggagagaggagtatgcaacctattccacttttggcaaagcccagcaggggcaagctggctcctaaagtgggaaggagagtgtctcaaatgctaacaggctccatgaacaacgtgtgtgtgctcgtcccaccattcatagggcctggaagccccagacatgggaacccaacccttagcagctcttttaccagggcctccactgggctttggtgagaggggcaggcgtgcagatgcggctgctatgctcccccagctgagctcccttgcagggccaggccactccccacagtgccaggcagagtgtgatggcctggagggtgccctagggcactgagaaagcctcaggcccaggctcagggggcctgaccaggagcaagactggaccaggagaacctggcatctccccagcctccaccaggagttaaacactgaatgccaagccagagcatggagggaggcctcctctggggccagccaagcagggacaggagagctgaggatggaacaggagcggggagaacccctcgccccacagacacccacacaatgcagtactgtgctgcgataagggggaacaaagcactgacgcgtgcgagacaggatgagcctggacagcagagtgctgagtgaaggatgccaggcgcagggggctgcatgctatatgagtccacttctatgaaaggagcaggacaggaagcagagagaaagtagaggaggggccgtcagggcctgggtagggtcaggaaagtggcaggtgcaggcgaggatagtgaggtttctttttgggtgatgaaaatgttctaaaattgattgtggtgatgggtgcacaaatctgtgactacattaaaaaccattgaatgctttaaatgggtcagttgtatggtaggtgatctcagtaaagctcttaaagaaaaacaatcatctgacagcccagagtcaacataaataaagcccagggtcacagcggccactgctggaggggattttgcctctgagggtaactaccaccaccataagacccaagcccagctcaccactggccagatgaactccaactctcacactgacgtgatgtccatacaagacaagaggcacgcccatttccaggcatcaatatcattcatcccaatctcttccgtttttctctacaaaggttataggaaaaggcaagagaaaacccaacctattgttaggagacagagcaatcggcagaaccaaccccaggcctggcccagatgttggaactatccaataggactttaaaacaactatgacaaacatgttgacgatctagtggaaaagtggacaccatacgtgaacagatggggaattgcagccaagatagaaagtataaaatgcatggaagagattttaggaagtggatgacggcaccacgtggaagatgggaggacacagaggtgttaggacggtcagttggctcttggtattcttgcggcagttgtttcaggatctcctttggatgccaaaatccaaggatgctcaagtcccttatataaaagggcttagcatttgcttctaacctgctgtatactttaaatcatctctagattacttatacccaacacaatgtaaataccatgtaaatagttatgctgtatagtttagggaataatgatgaaaaacaaaggccatatgtgttcagtagagatataattttttttctgggtatttctgatccacggtcagttgaatccatcggtgtggaacccgcagatacagagggccagctgtgctgcaagagtggatgatgacagggaaggcatggcagagctttctcattcaaagagggtcttggtaaggactttgagttgcagtcatgatgattataactgttagtagagaagaagttgagaagtgaggcacaagtgacagaaatatattttaacgtctattaaaatccttctaatgaaagctctctcagtctagcatctttccagtctgtctggatgggacatacctgaggcacacagaaccttccagcacggggctgagcatggggctctgggcagggccagcctcatctgtgggcacagggatgcttgccagcccctggatacctctggatgggttcctggctctaaatgatcttcctgtccctgagaaccatggcatcttgacctctgtcattaatgacagatttctctgggctaagggcactgttggagaagggtatccttctctctgataacatatgccaggtgacactcagcttgctctgacaatgagggaaaaggtttctccaactcaatggggctgggattggaagacccagcaaagctggcctgtatggggggacttggaagatttggggaaaaaaggagaagagagaatctaaagcaaaaggcaggctcttctaagaaaatcagcctaaattggtggttttcacttttttttacttgacctataatttcaaatatattagtgattcagtacacatgtacacatcacacacacacgaatacaagcctcacaaaataaatttagtatgtgctatgtactctgatattttcttttctagcatatcccagtttttaaatgctgttacaatttcccaaactgatttccaacagctttactcaagggtcatttacataccaaaaacctcatccatttctagtatataagaggaattcaaaaagttcatggaaaaatggaattaaaggataaaaagaaaatataagctttatttctcaatataaatggcatcaagttcaagacatttttgtcaatgatgatgtgccacttagtccatctgtaaagagctcaggctcctgagaatttaacgatgccaatgcagtgttttttacattgttaactgaaaaaagatggatgccctttacagattttctaagattaggaaacaaaaaggagtcagaaggagcccaatcaggactataatgtggatgcctcatgatttcctgttgaaaccctcacaaaattgcccttctttgatgagaagaatgagcagagatattgtagtaatgcaggactttctagtgaagcttcctgggcatttttatgctaacagtgtggctaatttttctttcttcctttctctttccttcctatccttccctttctttccttccttccttccttccttacttccttccttccttccttcctccctcccttccttctttcctccctccctccctccctctctctttctctctttctttcttcttttttgagggggagttttgctcttgttgcccaggctggagtgcaatggcgcaatcttggttcactgcaacctctgcctcctgggttcaagcaattctcctgcctcagcctcctgagtagctggaattacaagtgcctgccaccatgcccaactaattttttttttttttgcatttttagtagagatggggtttcagcatgttggccaggctggtcttaaactcctgacctcaagtgatccagctgccttggcctcccaaagtgctgggattataggtgtgagccaccgtgcccagcccagtttggctaatttttcaaagcactcccataataagcagatgttatcctttggtcctccagaaagtcaacaaacaagttgccttgagcatcccaaagacctgttgccctgacctttactcttgactggtccactcgtgtttggctggaccattcccatcttttggtagccattgctttggttgtgctttttcatcaggattgtactggtaaagccacatttcctttgttacagttccttaaagaaatgtttcaggatcttgatttcatttgtttaaaatttccatcagaagctttgcttttgtctgcagctgatctggacacagtggtttccactgagtggaaagtttgctccattctaatttttcagtcagaattgtgtaagctggaccaattgagatgtctatggcataggctattgtttctgctattagtcattgggcctcttcaattatggcatgagaaagatgaattttttcctcaaaaatggatgtggatggccaggcacagtggctcacacctatagacccagcactttgggaagctgaggcgggcagatcacgaggtcaggagtttgagaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagacggagtctcactctgttgcccaggctggagtgtagtggtgtgatctcagcttactgcaagctccgcctccccgggtccatgccattctcctgcctcagcctcctgagtagctgggactacaggtgcctgtcaccacgcctggctaatgttttgtatttttagtagagacggggtttcaccatgttagccaggatggtcttgatctcccgaccttgtgatccgcctgcctcggcctcccaaagtgctgggattacaggcgtgagccatcgcacccggccttgcattgagctattaatgtatgcattacctcacatacttatttttttgtgacgagaacactcaaactctattctcttagcaagtttcaggaacacgatacactgttactaagcacagtcaccatgttgtaatagctctcaccgacttattcctcctattactgaaattatgtttcctttgaccaacatctcaccaccccatttcacctcttctaagatggtagtgagcatctatccatgaagtacacgatgaagaataaatatttgtgtagacagttgagcgcagcaagtccggtttgtaacacatgtgacctgacacctgtctcatgctaacaggctggttgtcttgttgtacagcagttcagcatacggggggcatatcccactcacagctgtgatggagtgcttttccctgcagagcgtgacccttctgccttcagcgcgttttagtaggacgggctctgagtgaggtgatggaacccttgggttagtccctgatgaacctctaactagctgtgtgatctctgagcctcagcgtcttcctctgcaacaccggggggttgaatcaagccacatgtgaggatcccaaactcctgggctgccccagagccttcttgtcacatgccccaacatgatcgtggaccttcatcctccacccaccccagcctggcccctggtcttgaacacacgcttgcaggggctgggggctgaagcaggagccgagaggaggggagagaagctccaggatgggcagggggagccaggtgagaaccaactctggaatctcccaacccgagactcagggtaggggcaggggaagtaaggaaaggcaccctcaccctgggatttttgaaagcagcagaagcaggacaactctcttacttggggctcacatatttgaaaatattcttttattacctttggggctcacatgtttgaaaatgctcttggggcttacatgtttgaaaatactcttttattacctttccattaaaaagtaattcatgaggttgggcatggtggctcacgcttgtagttccagcactttgggaggctgaggtaggcagatcacctgaggtcaggagtttgagaccagcctggtcaacatggtgaaactctgtctctactaaaaatacaaagattagccaggcgtggtggtgggtgccggtcatcccatcttcttgggcagctggggcatgagaattgtttgaacctgggaggaggaggtttcagtgagctgagattgcaccactgcactccagcctgggcgtcagagtgagactctgtctcaggaaaaaaaaaaaagaaggaaaaaagtaatagatgataatagatgagtcttgtaagatgaaaaaattttggagatcggttgcacaactatgtgaatatgtttaatgctattaacctatacatgtaaaaatgggtaagatggtcaattttatgagagagagatatagagatatatgagatatatatgatataataatatatattatattttatatataattttatatataattattatttttgagatggagttttgctcttgttgcccaggctggagtgcaatggtgtgatcttggctcaccacaacctctgcctcctgggttcaagcgattctcctgcctcagcctcccaagtagctgggattacaggcatgcaccaccatgccaggctaattttttttttgtatatttagtagagacagggtttctccatgttggtcaggctggtctcaaactcccgacctcaggtgatctgcctgcttcggcctcccaaagtgctgggattacaggtgtgagccactgcgcccggcatgagatttttttttttttttgaggtggagtctcgctctgtcgcccgggctggagtgcaatggcaccatctcagctcactgcaacctccaccacctgagtttaagtaattctcctgcctcagcctcctgagtagctgggattacaggcacgcaccaccatacccaactaatttttgtatttttagtagagacagggtttcaccatgttggtcaggctggtctcaaactcctgaccttgtgatccacccgcctcggcctcctaaagtgctgggattacaggtgtgagccaccgcgcccggcctgatatgtttttttaaccagaattttttttttttttttttgagtcagagtctcactctgttgcccaggctggagtgcagcagcgcgatctcagctcactacaacctccatctcctgggttcaagccattctcttgcctcagcctcctgagtagctgggattataggtgcatgccaccatgcatggtgtcaaactcctgacctcgtgatccgcccgcctcggtgtcccaaagtgctgggattacagacgtgagccaccatgcccggtccttaaccacaattttttttttttttttttagaggcagagtctcgctctgtcgcccaggatggagtacagtggtgcgattttgtaaagggggaaggggagtaatagacaagcttcacaaacattggagaacactgaagagtaaccaaagataacacagatacagctctatgctctgcaggccgtattgctcacacccttcctccagggactgtcttgacggtttcatttgcagtattctccgtccccttcaatgtgactccgtagtgtctagcccttgcggttgtcagagcacagaaccctcctgctaatagaggggtggctgggatgagcgcgtctcacagctctgtggcttaacttgggctctgccacacgggaacctgggggatgtaactgtaaccgtatggggctgtcgggtagctgtgtgctgtgtgtaagtctcgtcctgttgctgtcctgcacgcggcaggcatgtcacatgtttggcggcatgcacaccacatacctgcaccaatagtcctgaagctgtaggagacagttctgaaactgttttgttgagggccactgggctattaaaagtaaaggtcacattaagtaaaatattgatctaagtgattatttgatttggaaggttgttgttttgtgtgggatttttgggatagagaaggatatactcattcaccttttatttacaatcaaacaagtatttaccaagatcatgtaacaaacaaaataaatgttccattctgtgttagtgagaagaaaatagagggcaggatgcagagaaaagggaagaggcccagagaagacaggccactgtgtttacagggggcagaggctgtggggggatcgggagggcaccttcctgtgggtagcaccctgctcatctttccctgtggctccgccctgtgccctgtgccctctgcactgcccaacctgcttacagggagggcctgggagttcaagggccttctcgaccagaagcttcaggtcagggtcacaagtgcgtggcgctgtttggttctgttaaacacaattttggtgtttaatgacgatttcttgatttattcactcttttcttccataaatattgagcacttgccatgtcccagacactgtgctaggtgctgattgtaatccttatgaatatttagtaacatctgaaacagacaaaaataatcataataattattgtaacttatataatcatatgatactatatctatctatctatctatatttttttctttttctttttttttttttgagacagagtctcactcttgtcacccaggctggagtgcagtggtacaatcttggttcattgcaacctctacctcccaggttcaggtgattctcctgcctcagcctcccgagtagctgggattacaggcaccagccaccacacccggctaatttttatatttttagtagagacagggttttgtcatgttggtcaggctggtcttgaactcctgacctcagatgatccacctgcctcggcctcccaaagtgctgggattagaggtgtgagccacagcgcctggcctatttttcttttgtatatttaatttttaaatataataaaaggcagggtctcactatgttgcccaggctggtctcaaactcctgggatcaagtgatcctttcaccttggccagagtgctgggattacagccgggagtcacggcatccagccaatattattataataatttataaaattgttccaggaacaaatagtgactgccatcattcttactattacatggattggcacattttcttcctgtccatactgaggatggaagtgctgagaatgaatgcgggaaactgctggtgagggcaagagggcagggtgtggaaggtgcctagcaaggaatggcagcctgccttccaccagggctgggaggctcaacagccaacagtgagggcacccgtgctccagtctgcagggcagaggggccctgatgcaaccctgcagggggcaggggcagactttgtgcaacacagctgaactggcacaggttctgggaaacaggatttcccaggggcaccctggtgacttctgccttctcttgccttgcaggccagtggtttccaggaccatgcctgtggtgagtccagaaagtgtgtgcatgcaggccaggatacagctttgtgtgacacagattttataagtcagaacttgcatctgttgattagttatcttcctctttgctttgtgatggcattcatggaaaagccataatttcagtggaccccactcagaaccttgacctttggctctagtcacagaactttgttcccctaggcttcagaccctgcctaggtcctccagacgagccctcccaggacctggagtctctccctgcagcccccacttcttgtttcctgctctccccacagctgctacctccatccttggtcccagacttccacctctgtcctctgcttggaccctgctctcgtgcccatccacctctgggacttctgcccttcacctctgaaaaaaccctcgcctggctgggtgcggtggctcacgcctgtaattccagcactttgggaggccaagacggatggatcacgaagtcaggagatcgagaccatcctggctaacatggtgaaaccccgtctctactaaaaatgcaaaaaattagccaggcatggtggcaggtgcctgtagtcccagctacttgggaggctgagacaggagaatggtgtgaacccaggaggcggagcttgcagtgagccaagatcacaccactgcactccagcctgggcgacagagcaaaactcttgtctcaaaaaacacaaaaacaaaaacaaaaacaaacaaacaaaaaaaaaccaaaaacaaaaccctcgcccacttccctcccctccttccagccccttccccatctctggatcttttggatatgctcatctttcttcctgcctttcctgccaccagctgaactgttgcataatgaacagctgccagcaaagatatctaaagctgtgctgcactttctcagttaaaagcacaagtggaaagttcattctttttttgaggtatttttacccctgtggattggtttgaatcaacttaatctgcactgtctgcacttccaggctaggatgagccaatgtgctctttttcaggtcccagattccaggtgggcaggatatcaccaggccagctctgtgagagctgagcgaccgcctcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattcctgaggttaaagaggacacctcctgcgtgttgtgcataagtactcagtgtgttactttctatgccaatgccctaagcgagtgattgtgaatggagagactaggacggcagaaagcttgccttgcaggaggcacccagaatattatgagaggaggacccagaatattatgactggaataaggaaaaattgaataatgcatgccttagcaaagtggctctctctaggcttttctcagagtttaacatattataaattagaatggcattaaaaaatagaatcagaatggtttgcacctgattatgatcggccaggtgtttgcctggattccattcctagtcagtccccgccggtctagttaggaaccgagctttgtagcgagtcctaggcttggtcttgcgtgctccttggaaggaagggtggtggtgggcagggaggtggatggctgggtcccccgggcctttctcttggacaaggctgcagctcgtcctctctcaggctccagggcggggagggcaccttctttagctaacagccttgctgggaaagttactgtgatcatgtaggtaaaaacgcattgtcaaccgcaaacttccagacgaaagtcctgtgaaattcttatcgtctgttctggacagtggcgcgagggctatttggagagttgaactcagtgtgagcccagcacgccccgccccagctgtctcagctgcacccaggaatcctgcggtggccactccccgctccagctggccccgtgatgcagaaaacatttttccccacccatcccagcaacgctcacccttccttactaagtcacatttgtgcctgactcccaagaatacgcttcacgcccacgcatggaatcaagggggaaaccagcagatccgcgctgtgtcccttgcctggcccgggcacctctcgcgaccgcagtcctgtccagggcggacatcgttcacgttcttacagatgagggagccgagtctgggagaggccaagagacgtgcccgggcgcacatttggcccccagctgcttacagtagaaacggggccccggagctccgctgggtatctgctcggcagggcgcccccgcctgcagctgcagcggactcggtcagaacctgattcaacgggaggaaccacgttgtccaaagctcattcctgggaggggagttctgcccaggcagacagggggtcaccaggctttccttgtcggatgagatttttctccctgggcgacccccaccatcctcgcctcctcacctggcctctgctgggaggagcggctgggtcggcagcttgggctggccactgcctttacctgagcgcctgcgcctgggtcagcctggcaggcagcagcaggccaaggaatgcccctgcagggaggtgcggccggacagctgacgcccgccctgcctgtgccggctgttccgaggacgccggaatgtggagtggggaccccaagagggagtacgcctctgcaccatcacttgggggagcgtggggagcccgcgtccttcacctccagggcaggcggaggtctgggcgcagggcgggcgggagcacggtgcatagcctgacaccgctcattcgggctgagctggcgcagctcacctggctgccagcaccgacgccgcatgagcgctctgcggccacctgcatccaaagaaagcctcgacggcttgccatagggaagccctgcgggtcttgagctcaccttgaggaagccctgagcagtcaggaggccgtgccctccggaaaccctggcagccctggtcgtccaagtgacagtctccagagctgtggttaaaggaagggcttggccgggatcatgcctgtcatctagcactttgggaggctgaggtaggaggattacttgaggccaggagttcaagaccagcctgggcatcacagtgagatccccatctctgaaatatatatatttaaaagaagagcttcattcacagttccctgggagggaggaagcatttaaaaaaaatcaatcaattggccgggcgcggttgctcctgcctgtaatcccagcacttcaggaggccgaggtgggtgaatcacctgaagtcaggagtttgagatcagcctggccaacatggtgaaaccccatctctactaaaaatacaaaaattaaccaggcctggtggcaggtgcctgtaatcccagctacttgggaggctgaggcatgagaatcgcttgaacccgggaggcggaggttgcagtgagccgagatcacgcccctgtactccataccactgcactccagcctgggggatagagcgagactctgtctcaaaaaaaaaaaaaaaagaaaagaaaagaaatcaatcaataaaacccttttcattatagaacattaaaaacatacccaaatcagagactaatgaaagcccatgtatccatcacccaacttcatctgaaacagatcttaacaactgtgcctgtttcttaaagaaaagaaacaaaagggtgtattagtatctgagttatagtaaatgttttcattcactcttttcaggaaaaaatgggcaaataaatggtcaaaccttttgaagatactgtattgaactactcttagccctttctttctccttagtgtgaaaattaaagggtgtacttcccaagcatctgtgcttgctatatgcccagccccatccaggctccaagctctttatttttatttttatttagagatgggggttttgctatgttgcctaggctggcctccatctcctgggctcaagtgatcctcccacttcagcttccctagtagctgagactacaagtgcttgccaccacgtccggccccatttaaaaattagagtgaatatgcaaagcttgaaatagacaatttggcaggtgcagtgattcacacctgtaatcccagcactctgggaggctgaggcagatggatcacctgaggtcagaagtttgagaccagcctggccaacacagtgaaaccccatctctactaaaaatacaaaaaaattagccaggtgtggtggcgcatgcctatagtcccagctacttgggaggctgaggcaggagaattgcttgaacctgggaggtggaggttgcagtgagccaagattgtgcctctgcactccagcctgggtgacagagcgagactctgtcaaaaaaaaaagaaaaagaaaaagaaaaagaaaataaaagaaaataaccaatttgccttttcagctttggctctgcagcctgcctgttgaggcccagctagtcttactctagctcccagcttgccagacacatcagtagattcttcatgccacttaagagatatctgggagcaaataaaaagtttatggagtaaaaaatctgatgcgattccaggtttacatattttgttgcattatacaacactttatatatatattttttgagagtcaagggtctctctatgttgcccaggctggtcttgaactcctggcctcaagtgatcctcccatctcagcttcctgcgtagacttcaggctctccagtggtaattgaataagatgataacccccataacccaggcactccagaggcctggctgacccagcacgcccgaggaggcacctgtggatatggtctctcccagtcccggaggggaggaggaccaggtgggtttgtcttcttctctacacccccaggatcttagaggtggctttcagagagatcccaaggctggtcacaaagggaccatcagggttgccccaaggccagccctgcctccctgggggaccccccaggtggaacccattctaacatcccctgttcaacagctgcacccgggctgcctccctgagccccctggagtggtcactctgaagggggctccttccatttgtcgtggtcttgttgaaagattgtattgtcatttaacatttctgcttcacactgacagagactgcagggaaataaaagaagctaatgaaagaaatacaccctgcaggattggggcaggttcagggcagagcattggagagcccagtttgtggacttgagaggactctacatgttggcttgtggaggaagtggggtggggtccttttggggaaatgctggatcaagcacacaggcactgccctgcggtagggaagctggacaggagggattaaaaaaaaataactcaagaggacagaactataacctgtgggtagaagttttagggacccagatatttgtctgaaacctccccagagttagctggccatggtggacctgtagtcccagctacttgggaggctgaggtgggagaatctgttgagcctgggaggtcaagactgcagtgagctctgatcatgccactgcactccaacctgggcaacaaagcaagactttaccttaaaaaaataaaacacaccctaagacagacaaaactgcacaagttgaacgagctcctgttgcaagggctgccatatctcagtgttcaagccaaggatggtgaacagcacggggatcttggggagaagggtttctgtgcaccttcataacatctgagactcagctcccaaccctggcacattttatcctttgaggagagagatgatttttttcctaaagtaaaatatcatttggagtaaatcctggtgaattaggtaaaggaataagtcaaagcattactgttaattcttctgttaggtataggagtgagtcaaacctttcaggtttttattgtgtttgtgtggcaggtagcggagactcactgggccggtggcgcaggggtaaaagaatttaccaagacagttgtaggtaaagaaaggcagatttattagagaaagtaggaaaatgtgttgcaaggttgcagtgggcagaatcagcagaagaggagctgcctgccaggagaccaaggctggctggggagtttatagaatggaacttgagctgactgataactaacttccatttttctatcagcctaggtgtttgataaattaaggtgtttgttgataagcaggaagcttgtgagctctgtacgttatctgctcaggagggccacatgtcctggaccataaagaaaaacagacccacagcatgtctgtttcctctctttgtttatctgtcctggaccatggaggaagccagacccattgctcatctgctttatctctttgttttcacctggtgccaccaacctgactcctttttcctcattgggactctgcagattgcatggttttctttcttttttttttttttttaaaaaaaaagagatagagtcttactctgtcacccaggctggagtacagtggtgcagtcataacttactgcagcctcaacctcctgggctcaagtgatcctcctgcctcagcctcccaaagtactgggattacaggtgtgagtcactgtgcccagcctttgtaagtttgaggtctaaccacataccaatgaggcaggtgttggtatatggcttgaaagtgatcctgccttagttgtcttcccacatgtcattcccatgagctgtgtgtacagttgtgtgactgtgcgggctgggaagtctgaaatctgcagggaggctgcaggctggagccccggaagagctgatgtcgcagcgccacccgcagggctgtctgcgggcagaattctttctctaaggggatgtcagttttttctctgaaggccttcaatggactggatgaggccactccctaatgggcaacctggagggcatgtgctttacgtaaagtccacagctttaaatgttagtctcatcttcaaaaatatctttcacagcaacatcgggattggtgtttcaccagaaactgggtgccgtggcctggccaagtggacacgtaaagtcaccatcacgagcagtaacatcacaatggctgggtgcgtggggggctgtggaaaaaacactgctttttctctctgctttcactctcaatacagagtatttcaccttagggcaccgaaatgcgtggggatttctctccacagacaacccgttctccagcagacaccagctgagtgtcctctcattcaattcaactctgacacagtcctcttggagacagcatcaaacaccacgggctgagagctcagtcctcaaggctgccctcacttttcacgcccattgcaagccccaagctgtgacaaatctcagttcccctgatccccggcttgggggtggttaatttgctagggtagctcacagaactcagggaaatcctttctgtatgtttagccttttattatgaaggatattacaaaggacacagatgaagacactcatggggaaggcatgtggggcagggcgtggagcttccgtggtctccctggacaccacgatctcagagcctctacgtgttcactctctggaagctctttgagccctgtagcttggggatttttctggagccttcattacataggcacaattgattacctcattggccactggtgattgattcaaacttcagctcctctcccttccccagaggttgggggatgtggctgaaagtcctgaccctttaatcacagggctggttccctggcaaccagcccctatcctgaggccatgcaggagcccaccaagagtctcctaaaatgatgctcctggccaggcgcgggggctcatgcctgtcatcccagcccttctggaggccaaagcaagtggatcgcttgagcccaagaatttgagatcagcctggacaacataaggagacctcatctctacaaaaaataaaaatgattagccaggcatggtggtgtgcagctgtagtcccagctacctaggagactgaggtgggaggatcacttgagcccaggaagctgcagtgagctgtgatcacaccactacactccagcctgggtgacagagcaagatgctgtcttgaaaaaaaaaagaaaagatgcccccataacccaggaaattccaaaggatttaggaattctgtcagccattccaatcactcaggagattacagattttaggagatctatgtcaggaatgggggcagaggccaaaaacgtattttttattatatcacaatatcacaggggtcctggtaccctggcctggccttggagtggcagggagaacctggctcccagcagtggtggcctgaagccttcttgcaggtgggctgggggagttgccgcagtgaccttcacagactggcctccgacagtcatagccagtgggcatctcaggggaggcctgggtgggacacaactccccatagtcggagtgtgtcccccactgccttggcacatgagcccctggggcatgaagtgggggagaccactcagtggagtggaggctcagaataaaaggcactgcactgatcatcagattttaaaagcaatagctcatgcccataatcccagtcctctgggaggctgaggtgagaggatcacttgcacccaggagttggagagcagcctgggcaacatagtaagatcctgttgctaacaacaaaaaaaaaatctaaaaaaaaaaaaaaaagatgatgagctgggtgtggtggtgtgcacctatagtgtcaactacttgggaggctgaggtggaagatacatttaaaaaaatgttatgttggccaggcatggtggctcacacctgtaatcccagcactttgggaggccaaggtgggtgcatcacctgaggtcaggagttcaagactagcctggccaatgtggtgaaaccccaaaaatacaaaaattacctgggtgtggtggcacgcacctgtaatcccagctattcaggaggctgaggcaggagaatcgcttgaacccaggaggcggagtttgcagtgagtcgagaccacaccattgtactccagcctaggcaataagagcgaaactccatctcaaaagaaaaaaaaaaagttatgttgattttgccacaatacaataaaatcttggggaagacagagctctcctcctggcccactgggacttgagagctggctgtcagagctggagggcaggcaggtagccccatggcctctgctgctggagggggcctggtaattctagcaaggaatagctgtccccgtggaggtgatggtagagaaaggtgctggccacagttttctttccctacaatttataacacaggagggagtgggagccaggagaccctgtgtggggacagtgccatcctgggtggaggcccacccccacatgtggcttgatgagccgcccccacctcatcacatgaggagaaaggagaacttccctttggggaaatggacccccgttttagaatcctagtcctgaagaggcctacgccatggctttgagctgggctcctgacctggcgggtggtgacagtttccttggggtgcaggagaagggcaagctgtggctggccagctgaaaagtgctggctggaagagggaccgtgtttacatttttaaaatctgggccaagaaaatctgtctgggaatggagttcctggaccaagtcgattggatcctgattttatggatgaagacagtggtttgggctgtgaagtctggtcactacaggtgattttagccagagtctgtctctggccatgagatcatggctcttagagcatttcattctgatgtcctcagttcatcccaggcctgcactctgttccctgctgctggcagaaagtgctccttgaatctagcctacggatcatgtggcagaaacacaccaggacgcatgcgcgtgggatgctcatggcagctacctgtgtttgtgcgcctgaaaaagaggtcataggagtgacgtccaggtccatgtagtgactgcaggagcatgaaacctgggctcatgggaaccatttctttttttctgaattgtgattctagaagtgaataatttccaattcgagctcttctgcttggccccatcaaagacacacagacgaacactcagcccctgaagggacacacacgccaccctgggggttcagctgaaggcttaggtggaggcggcatccaggcctcacagggtccaggccctgagcccgctggagtgccttggctctccccacccaccctcacctgcatggggcacatcctggtctgagctagcgggctaaatgcagatgatagagaaactaagatgagaacgagaaagtgtcacatttggagtgcctgtcacctaatccgaaccagagacaagacagccacgcctgctgggacccttcccctaagggagtgggtttcaattccaccagtctcctggccaagggcccactgaagactttgacaatagcaaaaccaacctttgctgcctcctccctgaggcctggagcctccctgagggttctgcgaagaggctgctctgtcccgggccactccgtgaatcatgggcacaggagacagggcggcggtggccgcagctccttcagaagctcccaaatgccaagaggtccttctgaatgtcctccccttt

SEQ ID NO: 12633 - DNA, 36907 bp, Human
tattgtgaagagcgaaagaacgcgaaagaacaaggcttccatagcgtggaaaccgacctgagcaggttgctgctgcgggctaacgggaatgggtggggggcagggggccagcttttacacccttgtttgtccctgcccatttgccatttctgtcctatcagagtgcccttttttcaatcctccctgtgattggctacttttagattcctgcattttacagagcgctgattggtgcattttgcagagtgctgattggtgcattttacaatcctcttgctagctacagagggctgattggtgtgtttttacagagtgctgattggtatattttacaatccccttgctaggtatagagcgctgattggtgcatttcacaatcctcttgtaagacagaaaagttctccaagtccccactcgacccaggaagtccagctggcttcacctctcatcttctctgtgctttcttgaagcccttttaactaaactctattatgatattgctgggctgggtttttcttacatgacagttctccagagccgtgaacagtgcctgcatcagcaaaactgtcttataaacgcaaactcctgccctgaacagtgcctgcatcagcaaaactgtcttataaatgcaaactcttgccttttggggtagagtgcaatagagtttccctcttcctcctgattagaaggataccttaaaataaaaaaataaaactttagttatattgtggcttaaaaacatgtttttttcctaattgtgtgtttccttgggatgattgggtgaaaggtgctgacggagattaatgacactgaaaaaggtgagcacaacttacaatgaaaaagaggacatttttgtggcgcagccagtgaaaagggggaaattcaggaagctatgagaggcctatggggggacctaacctactctagggaatcagggaagacctcaaaggggaagtaatcttaacactgaacagtatttttttttttagacgaagtttcgctcttgttgcccaggctggagtgcaatggcgcgatctcggctcactgtaacctccacctcctgggttcaagcgattctcctccctcagcctcccgagtagctggcactacaggcgcccgccacgacgcccagctaatttttgtattttagtagagatggggtttcaccatgttggccaggctggtcttgaaaccctgacctcaagtgatccacccacctccgcctccccaagtgttgggattataggcttgagccaccgtgccggcgtgagtaggaattttacagagatttgaggaggcagagattgaggactaagaaatcattggaaatttgaggcagcggcgatatgataaagttctggtgaagaatctaagattcaaaaattttgaggatgtgaattacagaactgtccagaagtggttgattttttgggggccaagcatcagggggctcgcttataaaaatcatatgttctaatttttttttttttttttttttgagatggagtctcgctccatcgcccaggctggatcgcagtggctggatctcggctcactgcaagctccgcctcccaagttcaagcaattcttgtctcagcctcctgagtagctgggactacaggcacctgccaccacgctcggctaatttttgcatttttagtagagacagggtttcaccttgttggtaagactggtctcgaacccctgacctcaggtgatccacccgcctcggcctcccaaagtgctgggatgacaggcgtgagcgactgcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagcagcgcagcaccgattcctctcgggctcttgggcgctgctctgaggtgaggagcccgctggaggcgggagagctgggggagggggcgcggcggcggcggcggcgggagccctgcgtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaaggtgtgctgattggaggaggagatgtgtggaataaattgggaaaggggacacggagggggaggggcaggcgtttgctgggcctgactctggaaggggaggagctgttaggataagtagggcggagatcccgagaatatttctataaggtatgtaagaaaaaaggggaaagcaggccgcccttgcatcctgatgggtccttacagtggggaggctgtaagaataatgtgcgaagaaaggatggaatacgcttttttcagttttccaggtttcctactaccttcactccatgattcctttggggagttaaaaaagtccaagtgcagttcttgctttgattcaaaattagttccgtacgtttttgtgtgggatcgtaactggtctcacaaaggtgatgaaattgtaaaaatatgtagatgagttaatagttgaggaacggcgtgaggtagtgagagattgtgagatcgtgtgaggtgcgagaaattgggagacataggaaaattatgtgagattgtgaggtaatatttgtttcgtgggcccttctgtttttagccagcttttccttgttggaaaatttgaatagagtgagctatattttacctctttttttttttttttttgagaagagtcttcctctgttgcccaggctggagtgcagtggtgcgatcttggctcactgcaacctccacctcccggattcatgcgattctcttgcctcagcctcccgactagctgggattacaggcacacgccaccacgcccggctaatttttgtatttttagtagagacggggtttcaccgtactggtcacgctggtctcgaactcctgacctcgtgatcctcccgcgtcggcctcccaaagtgctgggattataggcgtgagccactgcgcctggccatattttacctctttttcaaagtttcaaatgagggtttttcataaattggtgttacatttagacgtgttggtttaacgcaattgaggtggaatttacaaaaagttcagctataatcagttatatactagaacccctagcccagggtaaagtagcctcctcaattgtgttaagagtcacatcagcagtttggaaagattgtgaaaggtccaaggctttggaatagattcaggaatacaatggggaaattaatgccggtgttcctccctaggtgccttatagacttttatatgaaagtggtgtgattgaaaagcacttgtattgaaaccggtggcaccttaatgaagcttcacgggagtggaggacctgaagtcgtttacggttttccctgtggtgatatttttcttcaatggctgctgtatcctaaattgtttctcattaaaaaaataaatagtagggtcgggcgcagtggctcaagcctgtcatcccagcactttgggagtctgaggtgggcggatcatgaggtcaagagatcgagaccatcctggccaaccaacatggtgaaaccctgtctctactaaaaatacaaaattagctgggcctagtggcgcatgcctgtagtcccagctactcgggaggctgaggcaggagaatcgcttgaacccgggaggcagaggttgcagtgagccgagatctgcaccactgcactccagcccgggcaacagagcgagactctgtctcaaaaaaaagaaaagatagatgataggtagatagatggtgtgtgaaataaatagttttgaatgtaaatagaagcctagtggtaagtaagttaccctggtcttctgcatttctgaatacaggatacctataacttacaaactatacctctaaagaaagatagcactcattcttgtgcccattttaaggactaggaaaatgtttctctttgttgttcacaccatttgaaaataattcattaaattttggcatcctctagtggtttatctagcaaaacctcccttttttaaaaaaaaatcctatctgcagtggtgtaagagattttgcattagatttggtagattttcacttcataggttctttccacgaagagtttctggtgtagaaggctaattgctagtttatgggctcccataaaatggggccatactggccccgtctctactaaaaatacaaaattagctgggcgtggtggtgcacacctgtaatcccagctacttgggaggctgaggcaggagaatcgtttgaacccgggaggcagaggttgccatgagccgagatcgcgctattgcactccagcctgggcaacaagagcgaaactctgtctcaaaaaaagaaaaatgaaaaaatggggacgcacctcttgttcattagtgcctggcacatagtaggccgttcagattgttgatgaatgaatgatgaataggggagctttgagatccattctgagaactcagccaaattaatgtgcatagtagtttgcttgtcctgtgtctgtgacatttggcagagttaagctgttgctttgccatgtttgtcttagcctcagttagtttctttttgtttgtttgtttgtttgtttgttttttgtttttttaagacagagtgtcgctctgttgccaggctggagtgcagtggtggcatcatggctcactgaagcctcaacctcctggacacaagcagtcctcccaccacagcctcttgagtagctaggactacagtctcatgccaccatgcatggcttcttttttgtggggacagtctctgttgcccagaatggttagcttcagttttgtactcactctggtactaaatatagaaaaggtatacaggctgtgcaactggccgttttaaatacctcaggcctcagattctgggttttgtcagcaagcaaatagcttgaatatatctgttttaaaagaatcttgaaaaatcttctgtgtcctttgtattgacctgagcaataatttaccagtagcaatgtctgttgaaaaattgaatagcctttccaaggttatttggagaagttactcagatatggacaaaatttagatcttgtcaatatttgcatagaataacttgtattaaatctttcctgcctttagcatttatactttgatgaccagaagggggcaacctaatttgtctgtgaaattgtgccttttaaaataatagttgacactttgagtgcgtaacagaactatggtattaattttttttttttttttttgagacagagtctcgctctgtcgccaaagctggagtgcagtggcgcgatctcagctcactgcaacctccgcctcccaggttcaagcgatcctcctgcttcagcctccggagtagctgggactaccagggggccccgacaacgcccggctaatttttgtatttttagtagagatgggggtcttgccatgttggccaggctggtgttgaactcctgacctcgggtgatctaccctcctcggccacccaaagtgttgggattacaggtgtgagccactgcgcccagcctatagtattaatttttaactgacaagaatggtgtatccttatggggtacaatgtggtggcgtttttttttctttttttgagacggagtttcgctcttgttgcccaggctggagtgcagtggcgcaatctcagcttactgcaacctccgcctcctcggttcaagtgattctcctgcctcaggcctcctaagtagctggaattacaggcgcctgccaccacgcctggctaattttttgtatttttttagtagagatggggtttcatcatgttggccaggttggtcttcaactcctgacctcaggtgatccaccctccttggcctccaaagtgcagagattacaggcgtgagccaccacgcccaacttgtggtgggggtttttgaacttttatttttctcacataaatagaggcagggactcactatgttgcccaggctagtttcgaactcctggcctcaagtaatcttcccacctcaccctcccaaagtactgggattacagacatgagccactgcacctggcccactgtggtggtttttgtttttcttttctttttttagacaagtcttgctctgtcacccaggctggagtgcagtggtgcactccactcagctcactgcagcttacacctcccgggttcaagtgattctcctgcctcagcctcctgaggagctaggaatacaggtgcacaccaccatgcccagctaactttttttgtatttttagtagagatgaggtctcaccatgttggccaggctggtcttgaaatcctgacctcaagtgatccacccacctcagcctctcaaagtgctgggattgcaggtgtgagccaccatgcctggccactgtggtgttttgatacgtttccaatgtagtcataattctggtctagctttctaaccacttttattttatcttaaattcacctttgaaagatagcttgaggtatctctgtgtccatactaacatttgtagactcttgtggcctctcaacccaaaaatctgtgtcaaaatatccatgtcaacatactcaaggggttttccaagtttcagaacacatctcagataaaattcaaaatgtattcgcacaccagcattctagcctttgatcctctggaattcaagggctggtgttcctttaaaaatgaaactcctgactgggcgtgatggctcacgcctataataccagcactatgggaggcctagatgggtggatcacctcaggtgggaactgaagaccagcctgaccaacatggagaaactccgtctctactaaaaatacacaattagctgggcgtggtggtgcatgcctgtaatcccagtgactcgggaggctgaggcaggagaactgcttgaacctgggaggcggaggttgcagggagccgagattgcaccactgtactctagcctgggtgaaagagcaagactccatctccaaaaaaaaaagaaactcctgctaactgtgtgtggcataagttcttgttttctgcttagtcaagttttccatctggaaagcatttgcttcgcaaacagccacagcttacagactacaagcagtttagaaacaagactaccacctgaatatactacacatgccttcacctgccttttgatgattggtatgtagttgctgattctttcaacaaaaggtacttctttcttgttttctctttagggcttatggatcagatttatcttgctgcttattcccttaaaagcttatagctttggaattctattccctgatgcttctgagacagtcatcctcttttttttgagatggagttttgttcttgttgcccaggctggagtgcaatggtgcaatctcagctcaccgcaacctcagcctcccaggtagctgggattacaggcgtgtaccaccatgcccagctaattttgcatttttagtagagatggggtttctccatgttggtcaggctggtctcgaactcccaacctcaggagatctgcctgcctcagcctcccaaagtgctgggattacaggcgtgagccaccgcgccccacctgagacatccatctttattgtccatatagggttcaacaacttgttcaggttccagacctacctttaattgtatgtgcaagtaaaaatagaaacagaatgctttgggaaccccaaagaaaagagaaatattatttagctaggttgggtaggcttcatggagaaagtagcatttttaagctgggtcttgaagaatggataggattttgactgttggccctgtacaggagcacactactttcttttttctttctttttttttttgaggcagagtcttgctctgtcactgaggctggagtgcagtgtcaagatcttggctcactgcaacctctgcctgcctggttcaagtaattcttgtgccccaccctcccaagtggctgggattacaggcatgcaccaccacacctggctaatttttgtattcttagtagatatggggtgtcaccatgttggccaggctggtcttgaactccaggcgtcaagtgatccacccgcctcgacttcccaaagtactgatttataggtgtgagccaccaagcccagtcaggagcacacttttttttttttttttcctttgagacagagtcttggtccgtcacccaggctggagtgcagtggcgcgatctcagctcactgcatcctaaccccgttttccggattcaagcaattatcgtgcctcagcttcttgagtagctgggactacaggtgcgccatgctggctaattttttttttgtatttttagtagacacggggtttcaccatgttgctgggctggtctcaaactcctagcctgaaggatccacccacctcggcctcccaaagtgctgagattacaggtgtgggccacagagcccagcccacactttttttttttggagacagagtcttgtcctgtatcccaggctggagtgcagtggcacaatcttggttcactgcagccttcacctcccaagttcaaggaattctcctgctttagcctcctgactatctgggattacaggtatgtgccaccacacctggatgatttttgtatttttactagagttggggtttcaccatcttagccaggctgatcttgaactcctgacctcaagtgatccacctgccttggcctcccaatgtgctgggattacaagcatgagccactgcgccctaccaagcccacacttcttttttttttttttttttttttttgagacagagtttcactcttgatgcccaggctggagtgcagtggcacgatcttggcgcatcgcaacttccgcctcccaggttgaagcgattctccttcctgagcctctggagtagctgggattacaggcatgcgccaccacacccagctcattttgtatttttagtagagatggggtcatgttggtcaggctggtctcgaactcctgacctcaggtaattcgcctgcctcagcctcccatagtgctgggattacaggcgtgagtcaccatgccgggcctaagcccacacttcttaatacttaatagatgagcaaagctatggaggaaacataggatatgttcaggttgtggccaggttatagtctttgacaggaatgtagattttgtgagggaagaagggacataattagtctggaataagaaccgaagaatataagtgttacactgacgactttggccttttgttttaaatgggaggaaaccttgtagaaaatatttcctattcagtcagctccagcccaaactggtttatatgtgtcacattgcctttgtttacaacagttcctgaagccaaattgccctaccagtacaccttttcaaatgctagtaaagcctggtttcaaactcagcttttcaaaatgtttactgatgccctcgccagttcttcctccaacctcctatagtgcgtttatggctactttttattgcttatactgcttttggtaattatgtatgcttgccatttcggactctcacttgaacttgcattgtttacctttttgtaaatttttttcgagacctgtcttctgtgtcttttttttttttttttaattttatttttgagacagagtctcgctctattgcccaggctggaatgcagtgtcgtgatctggcctcactgcaacctctgcctcctgggttcaagcagttctccctgctttagcctcccaagtagttgggtagctgggattacaggcgcctgccatcatgcccaactaatttgtttctttcttttcttttcttttctttttttttttttttttttgagacagagttttgctcttgctgcccaggctggagtgcaatggtgtgatctcggctcactgcaacctctgcctcctgggttcaagcgattctcctgcctcagcctcccgagtagctgggattacaggcatgcgccaccacgtccggctcattttgtatttttagtagagactgggtttctccatgttggtcaggctagtcttaaactcctgacctcaggtgatctgccgacctcggcctcccaaagtgctgggattacaggcctgagccaccatgcccggcctaattaattaattaatcttttagagatagagtctcgcagctgggtgcggtggcttacgcctgcaatctcagcactttgggagtctgaggtaagtggatcacgaggtcaggagttcgagaccagcctagcaaagatggtgaaaccttgtctctactaaaaatagaaaaattagccaggtgcagcggcgggcacctgtaatcccagttactcaggaggctgaggcaggagaatcccttgaacccgggaggtggaggttgtgagccaagatagctgcactctagcctgggcaacagagcaagactccctctcaaaaaaaaaaagagagagagagagagatggagtcttgctgtgttgcccaggctggtctgaaactcatggccttaaccactccacaacccttgccttggcctcctaaactgctgggattacaggtgtgagccacagtgcctcgctaattttattttttttttaatagatagtattaaaaggtagaagatctggtcgggcatggtggctcagtcctgtaatcccagcactttgggagggcgaggcgggcagattacccgaggtcaggagttcgagaccagcctgaccaacatggagaaaccccatctctactaaaaatacaaaagtagctgggcatggtggcgcatgcctgtaatcccagccactcgggaggttgaggcaggagaatcacttgaacctgggaggcgaaggttgtggtgagtcaagatggcaccattgtattccagcctgggtgacaagagtgaaactgcatctcaaaaaaaaaaaaaaaaaaaaaaaagatctggctgggcatggtggctcacgcctgtaacctgagtactttgagtggtcgaggtgagtggatcacctgaggtcaggagttcgagaccagcctggccaacatggtgaaaccccctctctactaaaaatacaaaaattaggcctggtgtggtggctcacgcctgtaatgccagcactttgggaggctgaggctggtggatcacctgaggtcaggagtttgagaccagcctggccaacatggtaaaaccccgtctctactaaaaattcaaaaaattagctgggcatggtggcgcgtgcttgtaattccagctatttggtggggctgagacaggagaagcacttgaaccctggaggcagaagttgcggtgagccaagatcatgcccccgcattctagcctgggcaagagtgagactctgtctcaaaaaaaaaaaaaaaaaaaaaaaaagggcatggtggcgggcacctgtaatcccagctacttgggaggctgaggcaggagaatcggttgaaccccagaggcggagttctaaagtgagccgatatcacaccacttcattcctgcctgggcaacaagagtaaaattccatcttaaaaaaaaaaaagctagaagatctgcagttatgaactttgatagccattaactgactagatcttcaacctaaacgggttaaaagagggggaaagaaaatggaatggtaaaaagaactagatggaaaaaggaatgaagtaagaagtgatatgcaaaataattgtcatcttctccctgcctcccattccctcagtctagtcgaggtctttccacctggccatgtttcttttcctcagataaagcaagctcattctcaccttaggactttcaaaccaactattccctaaccttggagtgcttttcttattttggctgagttgtctccttgtagttcgggtttctgtttaaatgttattctaaagaaatttgctttgtaacatttatcagtaatattttcttgtttattgtctgtgccatgctttgcaaacacatgtgtgcacacactcaatagtgctcactcacttgtctgcactagaataataaggtctaagagatcaaggattttgtctgtcttgtctaccccatttttccagcaccttacacgtaataggtgcccagtagataattgttatgtgaatgaatacaataggagcatgttcatacagagttaacccagtctggggctctagggaaggaattctaaggaagtgacatttaagctaaggaaattggttaagtgaaaagttgggcaaagcgcaaggtaatgatgattgataggtgtaggtgcaggggccttcagctcaaatgcccacagataatgatgtgaagagatagattttcattttgaaatcactggctagtgttgaaaatgaattggatcaggagttatccattgcaagagatgatggtggcttcgaatagagcagcagcagtggggctagaaaaaagtatgaattggaagatatttaagatataaaattaccaggatttagtgagagactggatatggaggatgaggaatcagagctgattcccatatttttgtcttgagtacagcaaaagctatatgaattctgagactgtttatttaattgggtgattggctagaaaaaaatatatacatgtaaataaaaactgaggttgaaatcacaatcttcaaagtttcttaaggaactttactgtgtggattaccaaaactgatttttgtacttacataggtcatcagaaatcttaaaatttttgtcacaaatagccgggcgcagtgactcgtgcctgtaatcccagcactttgggaggctgaggtgggcagatcatgaggtcgagatcgagaccaccctggccaacatgatgaaactccatctctactaaaaatacaaaaattagccaggggtggtggtgcacgccctggaaggctgaggcaggagaattgcttgaacccaggaggcggaggttgcagtgagccgagatcatgccactgcactccagcctgggtgacagagccagactccatctcaaaaaaaaaaagtcacaaataaatttcgttaaaattttctgtttgtatccagaatttacttcctttctttactccttggaaggtaaattccttttgccatttatttatttatttagagacagagtttcactcttgttgcccaggctagagtgcagtgacacgatctcggcccactacaacctccacctcccgggttcaagtgattctcctgcctcagcctcccgagtagctgggattacagatatgtgccaccacgcccagctaattttgtatttttagtagagatggggtttcaccatgttggtcaagctggtttcaaactcttgacctcaggtgatccgcccacctcggcctcccaaagtgctggggttacaggcgtgagccaccgtgcccggcctccttttgccgtttattacacaaactttgtaactttattctcctccctgggctagataaatggaaaagcaaaagaaattcctgcacttccggtatatgcaatgtgatttctgtttctggcagctcttctgtctcagtcctccagaaataaggtcttggtttctctgttttgtagttcttggttcattcatagtagccatatctgggttcttcttgagtgttttctggaactgctctgctgtttggagaaaccaagtcatgaatttcagccagatctgtaggacaaaaatgttgttttctcattgacttttctcagtgcactgggtttcagagagctatctctgaatatatactgctctagtagtgtataatgaagaagtagaatgtatgtgcaaatatataaatagataattaatgccaggagtcataaaagctaacctctcagggccgggcatggtggctcacgcctataattccagcactttgggaggccgaggcgggtggatcacgaggtcaggagattgagagcatcctggctaacacagtgaaaccctgtctctactaaaaatacaaaaaaattagccgggcgtggtggctggcgcctgtagtcccagctacttgggaggctgaggcagaagaatggcgtgaacccgggaggcggagcttacagtgagctgagatcgcgccactgcactccatcctgggcgacaaagcgagactctgtctcaaaaaaaaaaagaaaaaagctaacctctcagttatcgcatgagggtcattaagtctgttttacagatgaagaaactgagttatatagtaactatacgtgactacctataaacataaagttgagaggtcagagaagtgaaagatattaggggccaaggcttggaatcgtgacagttgtgctttgcttattgtcctggtgtttgattaaacaggtctttcactgagaagcagaccacataggaaccctaatcatgcttctggtgctcctgttacctttcttctggtgaaagggatgctgaggatcttttaagcagtgcccttccagtttcattgctgtacaacaaaggtctagactggatggtgttgaatgtgatatagaggaggttttgttttcaagcacatcagttgttacttcccttactgcttcatcgttattctaaatgtgatggagaaaataaaatgttcaccggcattctagcgaactatgagaactgatttttttttctttttgaaacagagttttactcttgttgcccaggctggagtgcaatggcacgatctcggctcaccgcaacctctgcctcccaggttcaagcgattatctcagcctcccgagtagctgggattacaggcatgtgctaccacgcccggctaattttgtgtttttggtagagacgagatttctccatgttggtcaggctggtcctgaactcccaacctcaggtgatccacccacctcggcctcccaaagtgctgggattacaggcctgagccaccgtgctgggccccgagaactgatttatgtctgcagtaatgtgtgtaatttcacttgaggaatatggtttttgccaatcctcttacagcagtagcttttatccaagaatgttcatcaaaatcacctgtggagctttgaaagatgcagatgcctggccaggcgcggtggctcatgcctgtaattccagcactgttggaggccgagatgggcggatcacgaggtcaggagatagagaccatcctggctaacacagtgaaaccctctctctactaaaaatacaaaaaaattagccgggcgtggtggcaggcacatgtagtcccagctactggggaggctgaggcaggagaatggcgtgaacctgggaggtggagctttcagtgagccgagatcacaccactgcactccagcctgggcgactgagtgagactctgtctcaaaaaaaaaaaaaaaagatgcagatgccagcttttaaaattgagctatgaattaattactcttgattcagatttatgctgttcctggattccttgggatactataaacaagttttggggttttttgttttgttttgtgttttattgagacagtcttgctgtgtcgcccaggctggagtgcagtggtgtgattttggctcgctgccaatgtcaaaacagcattcttcattataataaaggaaaccatacaatggaatactatggcagctgttagggatggagatctttatggaataatgtcaaagatacattgcattgtataaaatggtaaactggtgcttgcttaagcagcacatgtactaaaattggaacgatacagagaagattagcatggcccctatgcaaagacgacacacaaattcatgaagcagtccatatttttaagtatttttttaaaaaaatcaaaagtaagaaatttttatttatttatttatttattttgagatggagtctcgctttgtcgcccaggctggagtgcagtggcgtgatcttggctcactgcaacatccgcctcccgggttcaagcgattttcctgcctcagcctcctgaatagctgggattacaggcatgcgccaccacgcccggctaatttttgtatttttagtagagatggggtttcaccatgttggtcaggctggtctcgaactcctgacctcgtgatccacccacctcgacctcccaaagtgctgggattataggcgtgagccaccgcacctggcaacaagaaaaataaattttttttttttttcagacggaggctcacactgtctcccaggctggagtgcagtggcgcgatcttggcacactgtaacctccacctcccaggttgtagcaattcttctgcctctgcctcccaagtagctaggattacaggcgcctgccaccacgcccaggtaattttttgtatttttagtagagatgggggtttcactatgttggccaggctggtctcaaactcctgaccttgtgatccgcccgccttggccttccaaagttctgggattacaggcgtgagccactgcgcctggccacgttatatatttttgtaattgaatgttaatatatgattttaattagaaaaaattaactgctttaaaaacaccacttcctcatgtattcgctgtggagtggggtctaggcatctgtatttcttcttttttctgttttcttttttttttttttttttgagactgagtctcgctctgttgccaggctctggagtgcagtggtacaatctcagctcactgcaacctctgattccccggttcaagtgattctcctgcctcagcctcccaagtagctaggactacatgcgtgtgccactatgcccggccaatttttgtgtttttactagagacagggttttgccatgttggccaggaaggtctcgatctcatgacctagtgatctgcctgccttgacctcccaaagtgttggggttacaggcatgagccactgcgcccagccttttttaaaattttttttgagatggagtctcactctgttgcccaggctggagtgcaatggcatgatcttggcttactgcaacctccgcctcccgggttcaagctattctcctgcctcagcctcctgagtagctgggattacaggtgcacaccaccacgcccagctaatttttgtatttttagtagagactggggtttcaccatgttggccaggccgatctcaactcctgacctcgtgatccacccacctcgcctcccaaagtggtgggattacaggcgtgagctatcacacccaggcaggcatctgtatttctaaactccataggtgattctgattctcatagaggtgaaggttcttgactcagagttcgctttcctctgaattcttttcttttttttttttgagatggcgtcttactctgttgcccaggctagagtgcaatggtgcgatctgggctcactgcaacctctgcttcccaggttcaactgattctcctgcctcagcctcctgagtagctgggactacaggcacccgccaccacgcccagctaattttttgtatttttagtagagatggggtttcaccatgttagccaggatggtcttgatctcctgaccttgtgatctgcccacctctgcctcccaaagtgctggaattacaggcgtgagccaccgcgcccggccatttttgtttatttattgtttttttctttttcgttttcttttttttgagacgaagtctcactctatagcccaggctggagtgcagtggtgtgatctaggctcaaggcagcctccgccttctgggttgaagtcaagtgattctcctgcctcaggctcccaagtagctgtgattacagatgtgcacgaccacgcccagctaatttttgtattttttagtagagacagggtttcaccatgttggccaggctggtctcaaactcctgatctcaggtaatttgcctgcctcagcctcccaaagtgctgggattacaggtgtgagccatcatgcccagccctgaccaacattttaaatgcctcaccttggcatttagctagaaaccctactggtttagtttcttaggtctgtaggtgttaccatggcctcacatttataatttggtttttcaaactggcaagaaatcagaatcgtggaagttcctagcatagcacttcatagttcatgtttatggtggcagccaagagctgtggccatactggcttcttgaagccttctcgtaccctttcacagtacaaactatttcaaaccaaaatgaaatgcctaagcttgtgtctgttatgttactgccttctgcagtcaagtagcattgttgcttctttacattttctagctcctcagtgcaggggtggagggtgggtgaggaaaatcacaacagtactctttctcttaaaattgagctatgaattaattactcttgattcagatttacactgttcctggattccttgggacactgtaaacaagttttgggttttttttgttttgttttgttttttattgagacagagtctcgctgtgtcacccaggctggagtgcagtggcgtgattttggctcactgccaatgtctgccgcctgagttcaagcaattctcatgccttaatctctcgagtaactgggactacaggtgcatgccaccgtgaccagcctattttttttgtatttttagtagagacgaggtttcgccacgttggccaggtttttcttgaactcctgaccttaggtgattctgccctcctcagcctcccagagtgctgggattataggcgtgagccaccgcgcctggcctggtttcttaaaattgacattttctcagtagttctctctctagtctgcttgctagatgtttaacttaaaaaattctacactatgtagcacttgtcaatttaaaagactcaaaagactgctggggcattaaaaacccagctttgtttctgtctgcaggtttaataaacaatgaataccttcatattccagaaaccaattaaaaatcattgttttttttttttaacagagccatacctttcaaggtcttttctgagaaaaatcattaccagtcactttcttatttaccagtgacaaattgtagggaggagtcatcttaagagacctctgtgtcctttccttatacaggctggagggatgttaccctgtaggtttttggctagctgctagttttatgtgttcaacagggcatttagcctagccttgctagatggccttactgaagtgcagtgcttcgtttaattgtgtgaccttaggtgatctatttcatctaaatttggtctatttgtgaggcagagataacatctgaatggcttatctcacaggatggttttgaagattaaatgagataatgtggtagcactttgtaaactgtaaagtataatgcaaatgtaaagtattatttttctaggaatcttcaaatgtagcagactcagcaaatgtttaggtaaaaattatggcaatgctagatttctttgtttacaatattgtgatataaaccatacgagttggctaagtaggacaactgaggatctcaaactgaggtttgagtacatactgtaaaaccatactcccctatttgtagtccagtcaactcagttactagcttcaactagtaactcttgagagtattggtttttttttgtttttttttgtgagacggagtctcgctctgtcgcccaggctggagtgcagtggcgcgatctcggctcactgcaagctccgtctcctgggttcacaccattctcctgcctcagcctcccaagtagctgggactacaggtgcccgccatcacgcccagctaattttttgtacatttagtagagacggggtttcaccatgttagccaggatggtctcgatctcctgacctcatgatccacccacctcagcctcccaaagtgctgggattacaggcgtgagccaccatgcccggccgggagtattgtaaataataaatgagtaggcagggcgccatggttcatgcctgtaatcccaacacttggggaggccaaagcgagagaattgtgtgaggccaggagtttaacagaagcttggcgcccggcacagtggctcacgcctgttatcccagcactttgggaggctgaggcgggtggatcacgaggtcaggagttggagaccaggctgagcaacatggcgacctgtctctactaaaaatacaaaaattagctgggtgtggtggcacgcacctgtaatcccagctactcaggaggctgaggcaggagaatcgcttgaactctggaggcggaggttcagtgagcatgatgattagcaccactgcactccagcctgggtaacagagcaagactccgtctcaaaaaaaaaaaaaaaaaaaaaaaaaaaggaaagaaagagaagcctgaacaacataggaacaccttgtctccaccagaaaaaattgaaaaaattagccaggtttggtggtacaagcctgtagtcccagctacttgggaggatggcttgagcccaggaggtcgaggctgcagtgagttatgatcaggccaccgtactgggcaacagagcgacaccctgtgtctaaacaaaattttttaaataaatgagtaaagtgtttgtaatagtacctggcacataataagcactcactattattagatacttcagtgaaactttgcagataaacatggctggttgaactacatggttctactccttttgaaaatctcacacaagtaatggtcaaaggattttttttttggaggggggatggagtttcgcttttgtcgcccaggctggagtgcaatggcgcaatctcggctcactgtaacctctgcctcccaggttccagcgattctcctgcctcagccttccaagtagctgggattacaggcgcccaccaccacacccagctaattttttggatttttagcagagacagggtatcaccatgttggtcaggctggtctcgaactcctgacctcaagtgatccgctcacctcggcctcccaaattactgggattacaggcgtgagccaccacgccacctggccaataagaagatttttaaagagacaagaaaaataggaaaaagacaagtagagatgtcagaaaacagctggaaaactagttactgaccagaaaaagctaaaaattaagtaggactggatttaggaagagccaagaaggtacaacaaaccagtttgtgtcacaggattctggaaaggccactaggtacccctgacaataggggtgcaggtggaatttacaaagtggtaattgaccaggcatgatggcttacacatgtaatcccagcactttgggaggctgaggcgggaggatcactggagtccaggagttcaagaacagcctgggtgacatagtgaaaccctgtctttaaaaaataaataaataaataaaaattaggccaggtgcagtggctcattcctgtaatcccagcactttgggaggctgaggcaggcagatcacctgaggttgggagttcaagaccagcctgaccaacatggagaaactctgtctctactaaagatacaaaattagctgggcatggtggtgcatgccaataatcccagctacttgggaggctgaggcaggagaatcgcttgaacctgggaagccgaggtggtggtgagctgagatcgcgttgttgcactccagcctgggtgacaagagcgaaattccgtctcaaaaaaaaaaaaaaaagataattgtgtcattaaaaaaaaataaaattacctggcacagtggcttacgcctgtaatcccagcactttgggaggctgaggtgggcggattacttgaggtcaagcgtttgagaccagcctggccaacatggtgaaaccacgtctttactaaaaatacaaaaaaattagccaggagtggtggtgtgcatctgtagtcccagctactcgggaggctaaggaagaggatcatttgaacctgggaggtggaggttgcagtgaactgatattgcgtcactgcactccagcctgggcgacagagactccatctcaaaaaaataaataaaattatagatcatttttccttttttttttttttttttttttttgagatggagtctcgctctgtcccccaggctggagtgcagtggcatgatctcggctcactgcaagctccgctacccgagttcacgccattctcctgcctcagcctcccgagtggctgggattacaggtgcccgccatcacacccagctaattttttgtatttttagtagagatggggtttcaccgtgttagccaggatgggctcgatctcctgacctcgtgatctgcccacctcagcctcccaaagtgctgggattacaggtgtgagccaccacgcccagcctctttatcatttttttaaagacagtcttgcttcctcacccaggctggagtgcagtggcacaatcacagctcacagcagcctcaacctcctgtgcttaagcgatcctcccagcacacccagctgattattttttgtagagatggggtctcactacgttgcccaggctggtctcaaactcctgggctcaagcagtccttctgcctaggccttccaaagtgctggaattacaggtgtgtgctgccgagccctgacctctctactgattttgacaaatagctttcttgaaaccctagagaactaattgtaaacaaaaaaacacgttgggaaggctggctgggaatctccagtaatacagtatctctggatgtagatgctctgggatgagccagtaaagaaagctcaggaagaagcggggatctgttttctatattcttcttatttgagttgctcttaagacagtacttaaaaagtaaggaaagggccaggctcagtggcttaggcctgtaatcccagcactttgggaggccgaggcaggcagatcacctgaggtcaggagttcgagaccagcctggccaacatggtgaaatcttgtctctactaagagtattaaaaaaattagctgggcatggtggtgagcgcctgtaatcctagctctttgagaggctgagacaggagaatcgcttgaactcaggaggtgaaggttgcagtgagctgagagtgctccattgcactccagcctgggcgacaagagcgaaactctgtctcaaaaaataaaagtgagtaaagatcgaagtcatgagaatgctttactttagatttccccatttgggcgctttctttacctaacaattatgccattctatgactgttcctctctgaggccatgctaattaatgataaagggaggataagcttgcagtaggtagagatcagttagaagctatgctgaccctttcggctcatagcagaaggatcaggtggataatagtcagtgctgttttattttttggccagatctcatgccagtaatcccagcactttgggaggtcgaggcaggtggatcgcttgagcccaggggttcaagaccagcattggcaacatggcaaaaacccttctctaccgaaaatacaaaaattaggcagtcctcataacctggtctctaaataagcaaataaatagattaaacttttcaaaaagaaatgctatttatttttctaagacaaattttatatatatatatatatatatatatatatatatatatatatatttttttttttttttttttttttttttttttttgagatggagtctcgctctgtcaccaggctggagtgcagtggcgcgatctcggctcactgcaacctccgcctcccgggttcaagcaattctcctgcctcagcctcccgagtagctggcactacaggcgagcgccaccatacccagctaatttttatacttttagtagagatggggtttcgccatattggccaagctggtctcgaactcctgaccttgtgatctgcctgcctcagtctcccaaagtgctgggattacaggcgtgaaccaccgcacccagccttgtagatggactctaagtgcattctgtctatacatgccagttttacagtgtttagaaaacttaatgattacactaagtaagcttcctttcctaaggatgctaggaataaccagtttaacctcaaattggtattattttaaactcaagcggagacgtaactcttccttgtcttggattacctgccatccaggtaattctttggccagttttgttgatcaattttgtttcattgatacagtgccatctactgacaaaaattggtaatcataaggctttaagtctgtcagaagtcaaagagttgggtccgggcacggtagctcatgcctgttaattccagagttttgggaaaccaaaacgggcagatcacttgaggtcaggagttcgagaccagcctggccaacatgctgaaaccccatctctactaaatatacaaaaatcaactgggcctggtggcaggtgcctgtagtcctagctactcaggaggctgaggcatgagaatcacttgaaccctagaggcgtaggtgagccgagatagcaccattgcactgcagcctgggcgacagagggagactgtgtccccctcccccaaaaaagtcaaatttggatgaaggactaaataaaatagatttataagggactaaaatttcaacactggaaaaacccttagatgttacctagcttgatgatgtattttataaaggagtaaactcagattctattatctttgataactacagttctgttttccccacacttgttttccaaatttttacagggttccagtttagagaatttcatgatcattctggcatttttatgactcttccttagtttttagaaataaattggaggccaggtgtgatggcttatgtctgtaatcccagtaggaggctgaggtgggaggatcacttgagcctgggagtttgaaacaagcctgggcaacatattgagaacttgtctctactaaaaatttaaaaaattagccaggcatggtggcgcacacctgtggttccagctactcaggagactgaggcagcgggatcacttgagcccaggaggtcaaagctgcaatgagccataattacttcactgcattccatcctaggtgatagagtgagacactgtctcaaaaaagaaaaaaagttgtaaaataaactaaatacaataagttaacaagaaatttgtgaatcgtaagttcaattcagaaaagactgcataaagaacaagagaacatggctgggcacagtggctcatgcctgtaatcccagcactttgggaggccatggcgggtggatcacttgaggtcaggagttcgagaccagcttggccaacatggcgaatccctgtctctactaaaaaaacaaaaactagctgggcatggtggcacacacctgtagtcccagctactcaggaggctgaggcaaaagaatcacttgaacccaggtggcggaggttgcagtgagccaagactgtgccactgcactccagcccggctggagtgagactccatctcaaagagggggaggtgcggggccggggctggagctgggttcggtggctcacgcctgtaatcccagcactttgggaggccagcacgggtgaatcacgaagtcacgagtttgagaccagcctggcagcttgaccaacgttggtgaaaccctgtctctgctaaaaatacaaaaattagccgggcgtggtagctcacacctgtagtcccagctactcaggaggctgagacaggagaatcacttgaacccgggaggcagaggttgcagtgagccgagattgtgccactgcactccagcctgggctggagtgagactccgtctcaaaaaaaaaaaaaaaaaaaaaaaaaagtccaggcacggtggctcacgcttgtaatcccagcactttggaaagccaaggcaggcaaatcacgaggtcaggagttgaagaccagcctggccaacgtggttaaaccccgtctcttctaaaaatatagaaattagccaggcgtaatggcgggcacctgtaaaaccaactactcgggaggtggaggcaggagaatcgcttgaacccgggaggcagaggttgcagtaaattgagatcacaccattgcactccagcccagctcacagagttgagactccgtctcaaaaagacaaaaacagactgggcatggtggctcagctctgtaatcccagcactttgggaggccgaggcgggcggatcatgaggtcaggagatcgagaccatcctggctaacatggtgaaaccccgtctctactaaaaatacaaaaaattagctgggcgtggtggcgggcgccggtagtcacagctactcaggaggctgaggcaggaaaatggtgtgaacccaggaggcggagcttgcagtgagctgagattgcaccactgcactccagcctgggggcagagcaagactccatctcaaaaaaaaaaaacaaattcaaatccagtactttgatgaaaaggaaaacttggaataggagaaagtatgagtcagagagtaatatgtaagttttattgatatgtgcacatttttaggaggactgcttttcttttttttttgagacagtgtctcactctgttgcccaggctggagtacagtcgtgcgatcttggctcacgactggctaatttttgtatttttagtagggacagggtctcgccatgttggccaggatggtcttgaacccctgacctcaggtgatctgcccgcctcggcctcccaaagtgctagaattataggtgtgagccactgcacccagcctttcaatttaatgcaatattttagctaccgtgctcttttacaacggtttttttgtgaagatggagtcttgctgtgttgcctaggctggtcacacactactgggcttcaggaattctcccacttgggccttccaaaatgctgggattgcagatgtgagcctgcacgcctggccctagctaccatgctttatggtaaaaggagtattgggagccttttaaaattaccaagaatgggtataaaagttttaaatggatacacaagaataaagaagtttgctgtgaaggccaggcgtggtggctcatgcctgtaattccaacactttgggaggccgaggcaggtggatcacctgaggtcaggagttcgagaccaacctggccaacacatagtgaaatcccgtctctactaaaaaaaaaaaaaaaaaaaaaaccaaaaaaaaaaaaaacaaaaattagctgggcttggtggcacacgcctgtagtcccagctgcttgggaagctgaggcaggagaatcgcttgaacccaggaggcggaggttgcagtaagccgagattgcgccactttgcattccagcctgggcaacagagcaagactccgtctctcaaaaaaaaaaaaaaaagtttgctgtaagattaattggggctgttttatgagctttctggctggacatatcagaaaactattttgtatcgagtgtgagaagaagcctaacacttactataagcagcatacaatattatcacctgtcatgtccctggttttcttaccatccagatattatctaaccaataagagtgctccctaatgccctttttatttcatttatcattttagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagagtaagtttcactgacacaggtaaatgtagccaccacgtgtttatcaggagtctagagatgtatgagacctccagtgctatgatggatacagtgtgactcagtccccaccttcatggcttattgtttaattaggaatatggcctactgcttataatacaaagcagaatgacttctttttaaaaattatttcttttgagacgaggtctcgctctgtcacccaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgttgggactacaagcatgagccactgtacccagcccatagtgattgctgagaaacagttttgtgtgtggctatagaccaatttaaattgacaaataaaagtcatttgcctttgaaggaagccagtttcttagctttctatttatactaaaaagcttccccattccccaagaatttcagcttttccatagacatctgaggtcttgtcctcttacgattatccttagtatgagtatacttatttgagtgaaagtgtgacttgctgtgccctctggtttcagtgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagaggtaagaatagaagtaagaatttttactagcccacaattcaaactactgtcaaagtagttttgttctgcttcttccctgatattagcagctgtctcttcttagtcctgaaatcttaggtaggctaatgcctacaaagtgagagtgtactgtcatgaagccacatgatctcttactttttatccatggtacaggagcagtaaatggaaaacttgctggggacagatataagggcaagtgaattcattcttgtaaaaaatagttttcaatatttaatcattaaaggtgtgaggtggctattttgacttaatcagtatcttaaagtaagttgttttttgagagtgaagagatagttgtaaacattgattttgcttgggctgtatgtcccttttcacatagggaaaatctcatgcgcttcagacattgatgaataatcactccaaaggattctaacagctctcttacttgagccaaggtattggtgaaatattggcaaaagagtttgtgattgggccgggcacggtggctcacacctgtaatcccagccccttgggaggccgaggcgggcggatcacaaggtcaggagatcaagaccatcctgactaacacggagaaactgggtctctactaaaaatacaaaaaattagctgacgtggtggcatgtgcctgtggtcccagctacttgggaggctgaggcaggagaatcacttgaacctgggaggcagaggctgcagtgagccgagatcgcaccactgcactccagcctgggcgacagagtgagattccgtctcaaaaaaaaaaaaaaagagtttgtgattacattaatcagagacacaggaatggttccagtctggataatagtcccatatagataaaattgttctacccatcttgtttttacagtcagaaaagccacgaggctttgctcgaggtttggagccggagcggattattggagctacagactccagtggagagctcatgttcctgatgaaatggtgagtcggccagtggctctgtgtggttgttttttttcttctcccattggtttcatgccagaggaaaagagctggaccttcgaaattccaatcacccaagtgtgaaattgttaagatggcatagtccttcgatagtgaccctcggcctgactgccaccctggactcatgagttacaggtaggagcccttaggaatcttgggtctttgcccatatttttaggaggtgggagacaatctagagtggaaagagtgtgggaaggaattacatttcacttctgtaaataaagggggagaaaatgaaatgtgattggaccaccctctccttctaccacctccttaataaagatgaggctggccccagaatcagaaattctgctaaattctcagggttaggaaagaatctgtagttcttccttttgtccttaattgttggatccctttcaatttgtgcagattctacaattacaggatcagccagcaggggtcagcaaggctccttaactgctatcaagcatagagcaagcctgcttttttccattatgagtataaataccagtgatagtaatactccatgaaacagcctaatgaagatagttatcccaacaatctctgtaattttcctactctgtcaaaagaaggccattcttcctatttcttgctcattctccccacaaagtggatctcaatgattgtatttaaaatttggaaggaataattctaagccattgccaatgaaggcagcattctagaaactttgtcctttaaaacacacacacacacacacagtctatggagctttgtccttttgtcagtccagaacttactctgaaactcgtgtctgtactaattatcctcttttacagtatggctggaggggcctaactttagcaccactgaaagccagagtcacaactaactaacctattctcttctatgtattccctaggcagttactggagctgcccctcttttagctgatttattgttaacctataagagaaaagttcatttttaagatgctgcttattgggtgggagaagttatactgtgagttactcagtttagctagaatatactttttctgcatgtgaccagtgtgagttacagtagtatctccatattgcttaagattgtactcctttggttgactcactactgtctttttttttttttttttttttgagacagtctcactctttcgcccaggctggagtgcagtggcacgatctcagctcactgcaacctccgcccctccgggttcaatgattcttctgcctcagcctctcaagtagctgggattacaggcatgtgctaccacgcctggctgatttttgtatttttcatagagatggggtttcaccatgttggccaggctggtctcaaactcctgacctcaggtgatccacccacctcagcctcccaaggtgctaggattacaggcgtgagccactgcacctggccgactcactgctgtctacaggttaaaactggatttgattataagacaaagtacattttaaaaagttattttactggagaatagagatttttgtatatttctaaaagtagtaaatatttctggggagtgaaatgactaaatttaactcagagggtgttgttcagctgtcagcaaatggcagcatgcttcagattcccatttccctcccattctcttgggtccattgttcaaaaacatacattatcagcttactcttctgctctatgggactatgtggctctgatttcctgttattaaggttctagagatttggggtggtgctttgtcagagatgtcatcaggtgtctcctgcttgctttacgctactgcttctgtctaggacattcctaataacctgaagataagagtttgttttttttttaaatgagacagagtctcgctctgtcacccaggctgaagtgcagtgaggcgatctctgttcactacaacctccacctcccaggttcaagcgattcttgtgcctcagcctcccgaatagttgggattacaggcgcacgccaccatgcctggctaatttttgtatttttagtagcaacacggttttgccatgttgaccaggctggtcttgaactcctgggcctgcccaccttggcctcccaaagtgctgggattataggcgtgagctactgctccctgcctaagagtttactcctaattcccttataatgtgtatgattttcaaattttgaaaacttttttttttttgagacagagtctcactctgtcgcccaggctggagtgcagtggcatgatctcggctcactgcaagctctgcctcccagtttcacgccattctcctgcctcagcctcccaagtagctgggactacaggtgcctgccaccacaccaggctaatttttgtatttttagtagagacagggtttcaccgtgttagccaggatggtctcgatctgacctcgtgatccacctgcctcggcttcccaaagtgctgggattacaggtgtgagccactgcggccagccacttgaaaacattttaaaattcagaaaactacagctccctcattttctactcccgatgttgaaacatcatttcaaagcacctggaagttatgcgaggatagcatttggaagtgtcagtgtaattacgattatgcaaaaagtgtccatcttcatttgctctggccaatgccagatgtggtatttaatcctattacgggccgggcgaggtggctcatgcctgtaatcccaacactttgggaggctgaggcaggtggatcacctgatgtcaggagttcaagatgagcctggccaacatctttagtagagatggcaaaaccccatctctactaaaaatacaaaaattagctgggtgtggtggcgcacacctataattccagctattaggggaggctgaggcaggaaaatcgcttgaacccaggaggtggaggttgtggtgatccgagatcatgccactgcactccaggctgggcaacagagtgagattctgtctcaaaaaaaaaaaaaaaaaaatcctattacaaagccaagatttctccatgggttcttatcagctgggatatggcttttggaggagtgtggtaacttctcttccctcagagaatctaggtatcctctcttccctcagagaatctagagagtcatgctttttggggccttgcccagatgttcagatgtgattggttaagtccattgacctggcttttgacatacacgaatccccagagggaattttcaacaggagagttaactctgaggatgtcacttgacatacaattgccagtaaatgctgcttgggccacgttttcattgttccctagcctatttttctaaaattaccatttttaaagcactgtcccctgggttatccaacttaggatagaccaccagcacctggtctcaaagtctctctttgctttattctgcaggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaatgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctgatttctgtcttaagtcttaccaggaacccttcttgccttataggttcagcctgttggaaatggcttcctcacttgaatggttttatttcttgaacactgtaggcttgaaaatctagtgcctggcctgaatctttaagtggtcacaccatgttaatttagtaaatacttactgggcatttatcagttgctgcagaggttgtaaagatggtcgcatcatgctgtcttcagtactgccaaaagtttattgagcactctgacctgatagcacttccaaactatggtatatttggaaacatgggtttttaagttaggtttagatcctgcctatggtatgtaatagattatatgaccttggctaaaatctacttctccaaaattttccaggaatttggccctgtgtttgcgcactgatttaaaacgtcattttctgcctatgattttttttttttttttttgagatggagtcttgctgtcacccaggctggagtacagtggtgtgatctcggctcactacaacctctgcctcccaggttcaagcgattctcctgcctcagcctccagagtagctgggactacaggcgcgtgccaccacacttggctaatttttaaatttttttagtagagatggggttttgccatgttggccaggctggtctcgaactcctaacctcaggtgatccacctgcctcggcctgccaaagtgctgggattacaggcatgagccactgtgcctggccttggacttgcctttatttttttttatttttttttttttagtcttgctctgttgccaggctggagtgcagtggtgcgatctcagctcactgtaacctccgcctcctgggttcagcgattcccctgcctcatcctcctgagtagctgggactacaggcgtgcaccaccacacccggctaattttttgtattttagtggagacagggtttcaccatgttggccaagatggtcttgatcttctgaccgcatgatccgcccgcctcggccttccaaagtgcgggattacaggaatgagccaccacatccggccaacttgtcatttttgtaacagacataggatttccactgagaacaaatcagtgtaacagttgagtactactcactcgtgcaaagcatttgtttaaaataaactgatgtgtagataattttttcagaaagcctcctcaggaaagttctcaggagacataagtggagctggggagccttactgaaggtctgggtcacagacaggccttcccgcacagaggtctgagtgtgtgccctggtggtggttgacagtagcacagcagtcggtagctaattaagggagtttaagtggaggtgttctggttctgttctgcaccatcagatgcactgaaatgaaactacagccttggtttgtatcccaaatggactgctagtcagctttggtcttaacctttggaactgactgacttgtcatttgtggcattcctgagctgttgtaaaaactgtatcattctcccccagagaaaacagtaatactgataggcatgcagtgaaaactgagttgaagctaggtagtcacaattttgttattttcaaaagccaattggcatattactagatcagtagtttaaggatcaacttttttgattgttgaggccacaaattcaaactgttataagtaggcacaacaaatcttaggtcagcttgagaaagtattcagagaatatttctttgttttttgttttttcttttgagacagagtctcgctgtcacccaggctggagtgcagtggcacaatctcagctcactgcaacctccgcctcctgggttcaagcgattctcctgcttcagcctcccgagtagctgggactacaggcatgccccactacacctggctaatttttgtagttttggtagagatgaggtttcaccatgttggccaggctggtctcgaacccctaacctcaagtgatccacctgccttggcttcccaaagtgctgggattatag

SEQ ID NO: 12634 - DNA, 15575 bp, Human
  misc_feature (1)...(15575): n = A,T,C or G
ggcttggctagcaaaagatggccttgttatgtaaataatgcccctcaggtaatcaaaatccttgtctctctctctcttttttcttttgctggctgttttttctttttcctttttttttttttccagctgtgggtatttagccaattcatgagaccttgttcgccataatatgaaactttccttcagatttgaccaagtcaaatggagttggtccagtccaatggggaaaagacagaagcaacaaaacaacaacagaaacaaaaacagttaagcaagggaaacaaacaatcaagcaatttatacgattactgcacgctctaaaagtagggagaaattaagaccagctggttgttaaccctaacttctagtcatggggcccaggctgaagaccgctctctaccatcctagaagcggggaaatctcaaacttgccttccctgccggacacaagcgaaactccagaaaggagctgcctgcttgccatcatcatggaagccagaaaactcaccttccttgttggaagtgagtaaaacgcagaaaaggagctgttcagggaaatcaagcttagatatcaaccaattgtgggagatcaggagttctctggaggtggggagctcccaggcctcagcaaactgtcctattttggagggcaatcaagatcgctcaaggccggcatggtggctcacgcctgtaatcccagcactctaggagactgaggcgggtggatcacttgaggtcaggacttcaagaccagcctggctaacatggtgaaaccccatctctactaaaaatacaaaaaattagctgagtgtggtggcacatgcctatactcccagttatttggggggttgaaacaggagcatcgcttgaacccaggagatggaggttgcagtgagccaagatcatgccattgcactccagccagggtgacagagcaagacccaccaagcaccagtaggagacttgtcaaaggtcagggccacctccacccagggtccctttcatgagtctccaatctgtaaatcaaaaagaatcaaaaagattgagacaggactcaatccatttagaaatttatttcgccagggttaagaatgcacctgggagacaggtctgtgcttttctccagagatgactttaggtgtcagtatttaaaggagaaaagcaagctggaggggaaagaaggaggctatggccacattaccaaatccacagtttgtaagagaagaggggcagatagggaagtagccaattatgtatttgtcttgatctcaataaatcggcactttacataagataaggtgaacatagagtagcgacctgtggagatatttaacttttttttttctttctgttgtgaaggctggagtgcagtggcgagatctagtctcactgtaacctctgcctcccaggttcaagcaattcttgtgcctcagcctcctgagtagctaggattacaggcacgtgccaccacacccggctgatttttgtatttttagtagagacgggatttcaccatgttggccaggctggtttcgaattcctgacctcaggtgatccacccgcctcggcctcccaaaatgcggagccaatatttaacctttcatctgaagctatctgcttaggaactaaaggaaaggcagtttcttacatgactcagcttttagcttaattctttttcttttggcatagtgagttgggggtcccaattttttattttcctttcacgaaactgaggacggaaaggggaagtggaaagagggaggaggagtgggttgtgggaaaggcaggaggaagctgccaaagaagaaagcttggccagattccacctcccttctgacagcctcagtggcctcaagccaggggggtgggtcctggcaggagggaggggggggtgtagccagccccagggccccattggctgcccagaggtgccagaggaataaagcccaggaccaagtagcccctgggaccattcagaagactgtccacccgtcctcagccccctctcttcgtgggctatctactcagttgatccctccctcgctggcttggctctgactcctgctcagacccatcacctttgccgggtaagtggccccatcctcagtcccacctcaggactggagtgtcccgggctagcctgtggtttcccaggggaagagggagacatagaaagagtctgtcaaggctgggcatggtggctgatgcctgtaatcccaacactttggaaggctgaggtgggagggttgcttgaggccacaagttcaagactgagctgggcaacagagtgagaccccccccaatctctacaaaaaaaattttttttttttaagacagaggtctcactctgtcacccaggctgaagtgcaatggcacaatctgggctcactgcaacctccacctcctgggttcaagcgattctcctgcctcagcctcccgagtagcttggactacaggcgtgtgccaccacgcccggctaatttttgtatttttagtagagatggggtttcaccatgttggccaggctggtctcgaactcctgacctaaaaaaagaatttaattagtatagtgtggtggtgcacacctgtagtcccagctactgggaaggctgagttgggaggatcgctggagcccaagaggtcgagtctgcagtgagcaattattgcgcccctgcactccagcctgggtgacacagcaagaccttgtctcaaatttttaaaaaacagccatttgggcctaaacactgagtttgtgtccagttctgtgcctcagcttccacatctgtagaatggggatgagcatagcgccttcctcctcaggtggttgtgacggtgaaaggatgacctgcacttaaggtgtccagcccagatttcataatagttcatatcgactgagcacttactgtgaaccaagtgaaagggaaggtggcttccgactgccggagtgggcagacagcggcttcagggctccctccctcctcctccccgggcacaacctcttctgaagtcttgcgatccttggggcagggatccttggggcaggctggatgcagttaatggatgctcacttcacggaaagccgcggcagagggagccctgtccttttacctgaaggcatcccatggcaccgcctgggacaaacggcgagagaggcgccccaaacccacctgaaaagggtcttcgtggccggctcctctgactcccaccccgattgtccctgaggccaggccttggtgacctacaccggcctttaatgtcaagtcagtcggtgtggtggctcacgcctgtaatcccagcactttgggaggccaaggcaggcagatgacttgaggtcaggagttcgagaccagcctgcccaatatggtgaaaccttgtctccactaaaaatgcaaaaattattcgggcgtggtggtgcacgtctgtgatcccagctactcgggaggctgaggcaggaaaatcgcttgaacccagaaggcggaggttgcagtgagccgagatcatgccgctgcactccagcctgggtgacagagggaggttctctaaaaataactaaataaaaaccgggatcccattgtttggggattaacctccaggagctgaaagttcatgccgatttggggatgtcctgttttgaagtttgccccagtctctgatttttattcgagagatccagcggagagagggtgtctgttcaagttcccctcccaggccccgaatgtcagttaattcagatagacaaggggtgacctatttaggggatgctaagtctggcggggcagttggaatccccacccctcattctccctctgaccaagggatgtctggctcattctgggagcgggggatggatgtccaagctaggagtgcccaggacagggggctggacaaggtggcattggagatgggtctctggctagccacccttgcctggccttctgggatggtggagggagggggaaccagagagccccttggccatcgtcagctgatctcttctggcccggcccaagttgaggagaatcaaatcctccctgagactctcagcagaaggcaggggagatgggaaggctgggtgggtggacgtggctgtggctagaccccgggccaccccagctgcttcatcccccagagcccatccagaagcaggagcctgagccacacccatgggtcgcagagagagcctgagccctggagccagctgcccgagttcaaatcctgcctccctgcctcactcacagcgtgactttgggcaaattatgttaatattccccttcctgttgctgtgtaccaaactaccccaaaatgtgacttaaaacaacagcaagccaggtgctgtggctcatgcctgtaatcccagcagtttgggaggctgaggtgggcagaacgcttgaggccaggagttggagaccagcctggccaacatagcaaaaccccatctctactggaatgaatgaatgaatgaatgaatgaatgaatgaataaaatttaaaagctgtgattagtcactgctataataattatgacaaaattaataattatgaaagagcttttcctaactgaatattgggcttcccaaaagttaggttattttgtttttttttaaataaatatttattgaacatctactatgagtcaggcattttgctgggtcctgggatcgtccatttaagccaagatacttggaactgcatgtcagaagagccagctgccaggttgtttttgtttgtttgtttgtttgtttgagacagagtctcgatctgtagacgaggctggagtgcagtggcgcgatctcggctcactacaagctccgcctcccgggttcacgccattctcctgcctcagcctcccaagtagcttgtatttttagtagagacggggtttcaccatgttagccaggatggtctcgatctcctgacctcgtgatccgcccgcttcggcctcccaaagtgctgggattacaggtgtgagtcaccgcgcccagcccaggttttttttaaatgtatgcatttaagtaagtaatagaggcacatggtaaaacatcaaactgtgcaaaaggtgggtgctatgatcccgagggccagctctcctcagaggccccaccctggccagcctgtcatgcatgtttcctgaaatgctctgtgcacatggaaacatgtggaacaaaacaaaaaaaaattcaaataaaaaaattaaaaaaatatataaaagaaacatgtggactatatgtgtgtgtggatggattgtgcgtgtgtgtggatggattgtgtgtgggagtggatcgtgtgtgtgtggatggagtatgtgtgtgtggatggattatctgtgtgtgtgggtgtccctgaatttttcacatagatagatagactattcttttttttttttgagacacagtctcactctgttgcccaggctggagtgcagtggctcgatcttggcccattacaacctccacctcctcggttcaagtgatgctcctccctcagcctcctgagtagctgagattacaggtgcctgccaccatgcctggctaattctctttcttcttcttttttttttttttctcaagacagagtcttgctctgtcacccaggcaggagtgcaatggcgcgatctcgctcactgcaacctccgcctcctgggttcaagtgattctcctgcctcagcctcctaagtagctggggttacaggcgtgcgccaccatgcccagctaattttttgtatttttagtagagacggggtttcaccatgttggccaggctggtctcgaacttctgaccttgtgatccaccagccttggcctcccaaagtgctggtattacatgcataagccactgtgcccggcctcacctcatgcattttgaaagctccaaggtttgagtgttctctcttcagcctcccagcaaatgtgtgagaggtcaggagtggagggtgatccctgatagagctgaggccaaggcgtgattacctgtctgatgtcacatggtgagtaggtggcccacttgcgattagagcccaggtctccaggatgctctctcgtctgaggccttgcttggcttgctgggaagcgaaggaagggatcactctggcagtgctggcaccggggctagctctcctaaccctctgggtttccttcctttctcccaggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagagggtacgggaccgggtcagcattatctgggcaggggtggcaggtcctccttcctcaacagggcagggccagtgctgtgtgaaattaaaggcgttgtaggataagcctactgactccccgcaaggactgagcgtccaccattagggcttcctctgtttgaggggtgcccttccaggagggttccttgggactgatcccagagccatcagtcgcctattttcctccaccctttcctgagccagtctctttggagatgggaggtgcagtctcagacaagggtagaacaaattctgagtgaaggaaacgtccgtgtccactggaatcctggcaggtattccaggtggggaggaagagcacaggcaatgactgggaggtgggcctgagtgcctctcctgttgtctccacagtgggccaagcaaggctgtgcacattttgtctgctcctcgggtaagtgatctgcttccccatcctgtcctctgctgtgtgtcctgggatcagacactctgcttctctgagccctggtttccccagcaatgtgccactgaaaacaatggcagcagccaccaatttggaattccagggggaggccagcagtcgcccagggtggggaggtgaggggggaactccagagcccccagtagagggtacgcagtcctgcctgggctcccagatgctcccgcactgacacgctctccacccccgaccctggcagcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgaggtgagtgccgacccagggcaaggaagagagagggcgcctggtggctggacagggtgccccctgtgcctcaccccctcctatctcccctgtggctttgcagttattggatgaagccttcgagctggccaaggccctagcgaagaacaacccgggttgggtctacattcccccctttgatgaccccctcatctggtatgtggagttcaaggtcacttggtgggggtggcagccactgccctatatcactgggcaggcattgctatgatgcacatcatcacgtcctcatgcacagcagctgcacatgtgtgcgcacaccaccatgtagaagcacacttaggcggggcacagtggctcacgcctgtaatcccagcactttgggaggccaaggtgggaggatcacttgaggtcaggtgtttgagaccagtctggccaacatggggaaaccccatctctactaaaaatacaaaaattacctgtacttggtgacacacgcctgtaatcccagctcctagggagactaaggcaggagaatcgcttgaacccaggaggtggaagttgcagtgagccatgatcacgccactgcactccagcctgggcaagagagtgagactccatctcaaaaaaaaaaacaaaaaaaaaaaaaaagaagaaacacacgttacacccaggtgcagcagcaagtgcacacatgtcaccaaatgcccattatccacggctgcacatgcaacacacccaaggctgaacatgcaagcacacagatgcccaagtgtctgcagttgagtcctcctggaagcagacttggggacaaaggtttcagggaaaggagtttatttgggaggtgattcagtgggggagtggggaagtaagccagggaaggaagggggctttgctgtttcttttttctttttctatcatccagtccaaaatgtcaggaagggggctttcaaaggcaggtggccgctgtgggtggctagagcttaatccctcggggaccctgggagccagtgcagaaggcgcacagcagtttcccgccccctgggagaaggagcaggggagtttgtacaccgactcgtagccattggttgagggctgccttaaggggctgccatctcctgactctgtttgcaggtagctcaggtggccagagaaggtcctcaggcagagacacagatgctggcagctagaagccaaggttgggggtggggagggaactagctccaggccccatcagctgggataaggccggtgcaaacctgagctggtgtctccaggaagcctagccctgacctgccaccccctctccccaccctccagggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccaggtgagcagctggggtgcctccctcgggtgtccagcaagcactggggagtcccccttagggctggctttgagatagatcctgatgtcagcctgtttcacagatgagacaatggaggctttgatcgcttgcccagggccacgtccagtgagtggtacagcttggactcaaacccaagtctgtgtgactccaacatgtcacacttcctcacgtgaaaagcctcatatgaggctgggcacagtgacttgtgcctgtaatcccagcactttgggtggctgaggcaggaagatcacttgaggccaggagttcaagaccagcctgagcaacatagagagattcccacctctaaaaaaagttttttgttttttttttaaattaactgggcgtggtagcacacacgcatagtcccaggctaaggtgggaaggattgcttaagcccaggagactgaggctgtagtgagccatgatcatgccagtgcactccagcctgggtgacagagcaagaccctgtctagaaacaaagaaaaaggaaggaagggagagagggagggagggaggaagggagacttccccaattactcctatagaaacattgctattatagaaccttagattggtcttttgagatgtttttcagacttctgcattctggtaattgactgacctcccagccccccagacccaggactcatgactcaaccgtatctgatgacaagtgccccacctggagggggactcaccccatattccccaacctcagcactactgacatttggggccagatcattctttggtgtgagcggcagtcatgtgcactgcaggagatcacgttacatcttccagtcctgtgcatagcagccgccnnnnnnnnnnnnnnnnnnnnnnnnnnnnnnnnnnnnnnnnnnnnnnnnnnnnnnnnnnnnnnnnnnnnnnnnnnnnnnnnnnncgcatgaaggaaggaaggaagggagagagggagggagggagggaaagaaggaaggaaggagaaaggaagaggaaagaaagagagagaaagaaagaaaaaaggagaaagagaaagagagaaagaaaaagaaagagaaagaaagagagaaagaaagaaaaaagagaaagaaaggaagaaagaaagaaaaagagagaaagagaaagaaaggaaaggaaaggaaaggaaaaagggagggagggaggaaggaaggaaggaaggaaggtctcataggaatcatttactgagtcctctgtggcaaggttttacatacctcattactttgccaaccatttactgagcccctattgtgtgtaagacactggctgatctggggagagagtggtgcataaacacaagtcttgctcctaaggagttcatatccaagccccaaacctttgatagtttgtttgtttttgtctttgttttttgagacagagtttcgctcttgttgcccaagctggagtgcaatggtacaatctcagctcaccgcaacctctgcctcccaagttcaagcgattctcctgcctcagcctcaggagtaggcgtctgccccaacacttggctaattttgtatttttagtagaaatggggttttaccgtgttagccaggctagtctcgaactcctcacctcaggtgatctgcccacctcagcctcccaaagtgctgggattacaggcgtgagccaccgcacccggctggtagatagtatttaattaggattaggttttgaccccattacacagaaggcccaaataacagtgacttaaatgagattgaactttaccatgaaaagtcagggcgccaggtcccttgagtttgtttccccattatccttagcatgtagtgtttcagtccaaaatggttgcctgagtgccagctatcacacccacattccatttggcagggatggggaagcaagggcagaaggctatgctccaaccttcaaagacagacacaacacttccacttacctttcgttggcctgaacttagtcacatggccacatccagctgcaagggaggctgggaaatgtctttacaccaggtgcccataagtgcagctagaaaagacaccggggcagacaatagtctcccctacagatagggaagactgagcccagccaggtaagaacttcttccagattcctgagcctggcatctggagctgctgtgtcccacactgtagggactgaagacgtcatggctgagcgcctactgtaaaccacgtgctgctgagggctgaggtggctcaggccctcaagatgctcctggggaagggagagggggcagctgagctgggaatagagctagtggtcaccccaggaagctggggacagcgtcaacacattggttaccagtgcaggtcttgaagttatacagatcctgcttgcagccccagctccagcactccctaggtgtgtgaccttgggcaagtgactgtacactctctgcctcagtttcccctttccaaaatcaaaccaattaacaacagcagaattcttgtgtgaattcaataatgcttgtgaagtgcttggcacctaacactttctcaagaagtactcagggcgcttgttactagcagggaggactatttgagaattccacatagggccgtgggactcagtactctcccaggaggactccttggaggaggtggccttaatcctgagccttgaaggacacagcaggatgtgggcaggcagagtggtgctaagcttcatgagggttaaccaggtagcggttgtaacccggagcaaaagcagggagtcctagcagggaacaacaagggtcctcttaggcatttgctcctgacttagtgttgatcagaatatgacgctgtgccgaggcaggaggatcacttgagcccaggagttcaagaccagcctggggtcgggcatggtggctcatgcctgtaatcccagcactttggaaggccgaggggggtggatcacctaaggtcaggaattcgaggccagcctggtcaacatagtgaaaccccatctctactaaaaatacaaaaattagccgggtgtggtggtgggcacctgtagtcccagctactcggtaggctgaggctggagaattgcttgaacccgggaggcagagattgcagtgagctgagatcgcaccactgcactccagcctgggcaacagagcaagactccgtctaaaaaaaaaaaaaaacaaaaaaacaacaaaaaaacaaacaaaacaaaaacccgcctgggcaacatagtgacactcagtctcaaaaaaattaaaaaaatgatactaaagaatatactatatgatgtcaattcaaacactctgcaccttattagaagaccccacttggtttggggatccctgaggcttttcagggttttacagctgcagaggtgatacctgtccccctgcccccagatgcattgccttctctgtctcacatccatctccttctctccctccctgcccccatctctctcctgtttcccccactcccatcctcttctgggttcccacttctctcagtgttgccaaggccctgggcgtgaagactgtgggggctcaggccctgaagctgtttcaggaacaccccattttctctgaagttatctcggaccaggaggctgtggccgccattgagaagttcgtgggtatgtgccaggtcctcccatgacctgacctgctgactcaggcgctaagtggctgtccacttggtatgccactggggatcccactcaccccaagtttccttcacagttctgtcttccacctctgcctagaattttccattaatagaagataatacaatgccgtgtagaaatagaaaagcaaaagccacacataatggaaaagtaaatagaaaagtaagcctgataaccatagcagcagaaaacaataagtgaatatttaaaatgttgcttctgagtttcctggcagccagggtaaaaaaaggaaaacatggggctcagagtttgattcattcagaggtgagtctgtaactaggctggactctttctgggttccgtctagggcagggatggcaaaaaagagagaaaaaaatagtaccatttatgcttctgtacctgctgcacacttggctaatcaaccatggaactcttgctcagatgatgcctcagaatccttctcaacacagtgctcacgcaaccacactcattctatcagtgttagcactcatgatgaaacccaggccctggctcaggcttggaagggccaattcaggccgatgacgggacgtttggttcaggacctgcggctgcagccagggctgagagctgattggctcagtattcccaggtcctgccaatggcctgtcagctcctgtgcaccctgggaaactcaggccacgcccctgtcacgccccttctctggcagatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatatttatgaaacaaagatcctgtgcattttcccatcatcagctgtctcctttcctgctttccttccaccccaagtctgctctcagccccagctctcaactggggccccagagtgaggccaggagcctgactccagctagtcttgcatgccaggacaggggcatccctgtaccacaggaagcaggtggctaaacaagagggacttggggtgggacaaaggctgcctccgctgaaggcagaagcagctggggaggccaacttcattctgatatgaagtccttcctactaagtcagaattatttcatcacagacccaatggaagcaaagaagtgaggccccctcccctgggcgtgtgtgagctgacactggacacccatctctgggagagggaaagggtgggtggacttgaagtcaatgtcatgcaaaccctcctcaaacatggagccctctcttccaacaaaagcatatgctgaagcccgtatcatagatcaaagaggaattactggggctggctccagagcatggagggaaccccaccctcagggtactttctggatgaccccaagttcaaactgaagtttaagagtcactcagggctgggcgcagtggctcacgcctgtgggaggatcgcttgagcccaggagttcaagaccaggctggttggcacagtgagactctgtctctacaaaaaggaaaaataacttgaacccaggaggcagaggttgcagtgagccgggattgtgccattacactccagtctggcgacagagtgagactccgtctcaaaaaataaataaataaataaaaaggaaaataagataaaaccacaagtcaattcccaaccccagaccccaaccttgctttattttctccacgggtttaccagcactgacacactgcatatttcatttattttgtttactatctagtcaatgtaaacttcacaagagcaggaatgcttctgtcccttttgttataaagtatccccgggacctcataacagtgcctggcatgtactaggggttcaataagtgtttgctaataaagagatgctgagtgcatgaggccccaagtgggctgcatcacatcccccagggaaacgctgctcacaccattaccccatttcacagatgaggtaatcgaggctcagagaggagtccatagctagctaataagaggtggagacagaattgaaacccaggtctctgactccagggctgtgtgctttcctctctccaagcacacagcactgggagagtcttgtctccaaggcaggctgcatgagatcagacagggagagagcctttttttttgtatctgtctgtataccacaatatggcttaggaaggtcttggtggttaacaaggctcccaaataggacccagaacacaggtgctcaataaacatctggatggatagatggatggatggatatgaatgaatggatggctgatggatagaaaatagataaatatggatgcatgggtggatattaatgaatctgcacagacccgtgtgtggatggatgggtgataaatgaataggtaggtggatggacgggtgggtgggtggatggatgaatggatggatgagtgggtggatggatgggtagatgggtgataaatggataggtggacggatgagtgaatgggtagatgggtagatggatggaaatgaacagatggaaatggttggatgggtggataaatggttggaaggatggatggatgggtgagtgggtagatggatgataaatggataggtaggtggatggatgagtgaattagtagatgggtaaatgggtggaaaatgaacagatggaaatagttggatgggt

SEQ ID NO: 12635 - DNA, 9230 bp, Human
tactaaaagcaggtgcttggaaacctgagggcagtggtgttcatgcgtttcccggcactttgactttcagcctcctgcaagcctctccttctttgccttcctgaccgttagatacgattaatttggggtttgttttttctgcttcctctttcccctcccaccctatgtttcagttctaaagttagaaggtcctctcatccttttaagaagaacagagacagaaaatggttagtcaccatctaggacagactacaattccagatcattgcaggacgtgcccactcaaatggatgattattgagagctggccacctgaagtgttttacacaggcagtgatctaagggttgaagctatctggcctttttgcttgcttgttatgtatttatggcttttttccttttcaaaataattttactaaatatttaattcaccaactatatatatttatggggtacaatgtgttataaatgtatacactgtggaatgatggaatcaagacagttaacatgtccatcactccgcatactaacatctgtgaaaacatttaaaatctatgcttggctgggcgtggtggctcatgcctgtaaccccagcaactttgagaggctgagatgggcggatcaccagaggtcaggagttcgagaccggcctggccaacatggtgaaaccccatctctattaaaaatacaaaaattagctgtgagtggtggcgggtgcctgtaatcccagctacacaggaggctaaagcaggagagtctcctgaacccaggaggcggaggttgcagtgagctgagatcacaccacagcactctagcctgggcgacagagtgagactgcatctcagaaaagaaaaaatatatatatatattttggagctacatcgtgctagcgctgcagagaatgagttttgttttgcgacacagtttttagatgtctaccgggctctggtggagatggaatgtttggcctcaagtgggcaggtcccatgggacatgagtagccgaccatgacctggctgcgtactggcccaccaggcattcgactggcgtgcccagccgctctccgtcatcgcagagaagtgctctatgtgagatttggttaaaggagtccctgaaggcctgtgggaggcagaatagtgacctcccagagatgtccacctcctgaggcccagaccctgtgagttggggaagcttatgtggcaaaagggactttgcagatgtgattaagtcaaggatcttgggttggggagattacccaggtgggcctgatgtaatcacaaggggctgagtaagtgaaagaggaaggcaggagggtcagagtgagagaaggaggtgagtgcatggaagcagggggcagataacgggactggtggctttgaggttggagggaatggagaggcaggaatgcgggagcctgcagaggcttgaacaggcgagggaacagattctccttggagcctccaggaggacacggctctgatagcagcttcattttagcccagggagacccattttggacttgtgacctccgggacggtaagtcaataaacctacattatgtgaagccactaagcttgtggtgatttgttatggcagcaaaaggaagctttatggttcatctgtaccctgaaaatgcaggtttttggtttttttttttttttcacttgttcaatgatgtacccccagtgtcaggcgctttgcaaacacacgatacatacgggttgatgtttggtcaagagaggaattaagatcaggcagacagcaggctgggatcagagagaccccatttctgtctgaaatgtctgcagagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggtgagatttaaagagggggaggggagacccgagtcttggaggaaatttgcctcacagccaggccctggttctttaggagactcaaaaatctcagggtagccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggggtggttgcaggcgcctgtggtcccagccactcgggaggctgaggcaggagaatggcgtgaacccgggaggcggagcttgcagtgagccaagatcgcaccaccgcactccagcctgggtgacagcgagactccgtctcaaaaaaaaaaaaaaaaaaaaaaaaaaaaaaaatctcagggtaaagagaggacctgctcaggcttccggggcaaatccctcacagggaactctcttccagggctgagtctgggccccaggacccacatgcaggcaggtgagtctgtccccagctgtcccaggtccctcctcctcactgggacaaggggccacccatgggcagctgggggaggagacagcagttctgggtgactgatgaggatgacgggggggtcctggggctgagagctgggatctgagggctgaggaaggtcttgggatccagcctctgattttcttccagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggtgagaggacactcaggggtcccagccccaggctctgccctcaggaagggggtcagctctcaggggcatctccctctcacagcccagccctggggatgatgtgggaggtgggagccccatttaacacggtgcctccttctctcctaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggtgaggctcctgaccctgtcctctctgagctcagtggctccgttcatgccctgctgccaggagagctctgggcagggatggagggagaggggctcagccagtgggggactcagccctcagaggggaggaggacaacaggggccctcccaggcatgcccatgctcttctccctcacctagggtccagaaggtgccaggtggacagagaaatggtccttgggaagctgcagggcagatatagggagaggttcaatttgatgtggagacccaagggcaaccccagactctcaccctcctcttgtccttctacccaggatccttggagggtcccaggccctcacccacaaggtccgtctcaacagctggtgagtctcagaggcctctgtccagagagtttccaaagcccgaggcctgtctcaagacatgctcagtggatctaagtcctcgttccaattctcagctgggcttgcttccacgggtgtgggagtcgggcagcgacttgggaggcaccacaggctcccaaggccctgaggctgggctggtgaggggtgagggggtcaaggctgaaggagatgttgcggggagaagccgagctgatgcggggagcagggcagccccagccctcacatccctgttctaacccagcaggccctgaggaccagcccctcatgcctacagggtcagtcccccacagtggtgagtgaggggctctgagtgggaggtgggcagggtctaggggagccaagggtgggttctgtcctaggttcaggctcctctggaggtggtgatgtggacaggcccctcccctgcatgggcctcagtttctccaagtgtaaaggagagaggcctgtgggtgggaaagttcctttcagctctgactcccagctgtgccctcctgggagaggaggcctcccagggaacctcccagacccgattccgcaggggcctgtccggtcccacctgcagcagagacggtgacctggggcaggggaggggagcagggcggtggttcaagacagtcaggctctttccctgcaactctggggcttggctctggtgcaggaacaagggctgcagctcagactcccgggtttccttcccagctctgccgcttcctggctggaggggtctggggcaggcgattcccctctctgagcctcagtttgtgcatctgtgaaatgggtggagagagggtggcaatctcaggttgcacaactgctgtgagggttggaggtaatgaaagaaagacccagcacacacagtaggtgcacacacagtaggtgtgcacatcaatgacatcatccccattcctgatgtcatcacgcccaaggtctgagaaggcactgggaggtactgatcggggtcttggtggtctccatcctgcttctctccctcctcctcttcctcctcctccaacactggcgtcagggaaaacacaggacattgggtaagtaggaaattgggggacccgtgggctgatggagggtgggctcagggcaccagccaaagggactccagataggagaggtcatcttagaaactctgctccagaaattcccagtgagaaaatctagaaagaagaaaatgaatgagggagtaatggaagtgctttattctttcggtttttctaaacttagaaagtatttaaaacatccttgcaagtgtattttcaggtttcctttcctcttgacttgcatgtgcaaggcaggtggttctaacgttcccagagctgagactctgtccatcttcccccagcccagagacaggctgatttccaacgtcctccaggggctgccgagccagagcccaaggacgggggcctacagaggaggtaattctgcccaaagacctcagactcccacccatcccaacagccacctcactgtccccttacactcccgtatcctcccccaggtccagcccagctgctgacgtccagggagaaaacttctgtgagtgagaggcagagaaggtgcacctggggtggagctgggggtcccaaaatttcaatagcaatgggggcaggagcacaggctaggattggtcagggactcagggagaagtggtctgaacccacattgtgggacctcggggacatcacagcccctccctgcgttgcagtggcactaatgggaacagggcagggaccagcaggaatgagaggtcccagggaaccttcccaggagatgaaccccttgctctaccccagcaggtgctgccgtgaagaacacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtcccctgggctccccttcattcattcatctagtgagtgttcccagggagctcactgtggatggggctccccatgggagctgcagacacagcagggagcaaagccgcccccgcctcctgagctcacctcgtggtgggagacaaaatgcaaataaatgcatcgtgtccaggagtgcaacgtgctgtaaggaacataaaccagggaaagggcagagagtgtggggcagtggggccagtctgaatggaaggggagggctgtctgctcagctgtcatctgagaagcctggacagagtggggcacacgatcctctaatggacgagcccctgcaggcagaggaaacagccgtgcaaaggccccgaggcagcagcgagctcttgcaggaaggcccgtgaggctgcagccaaatgggcaaggtcagagtgaggagcagagaccagaaccacagggagggagcggccagaccctccacggccttagggcgtccctgagattccatcaggaaagggatgtaatcggatcaccctgggaacagtggggaaaattgactccagggagtcaggaggattcaaggacaccccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggtgagtcctttcctctccaggcccccaggcctcccccacccccaccacgttccttccctctcactctcccccgctgcaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtcca

SEQ ID NO: 12636 - DNA, 11428 bp, Human
ccaagattgcccccacacaccattcccaagtccagacctccagaacttctgactgactggcttcaagttggggatcccatgaccacctctttgggtttgattaatttgctgtagcagctcacagaactcagggagacactgacgtttactggttgaatacaaagcacactgcagaggacacagatgaagagactcataggaggaggcatgggggaagggaccggagcatctatgccctccctgggcgccacgctccaggaacctccgcatgctcagccatccagaagcccatgaaacccagtcctcttgggcttttaaggagcttcgtgacatcagcatttcctcccacaaggaacagggtgagaccatcttctgggagggtcttaagagccaccatcagaaaggcagggaacattcgagtcttgccttgggcaggtgaaggaagggcaggaggaggtcagaggcctcccctaaggcctaacacagccaatactctaacaaaagactgtaaccagtggtatggagttataagccaggaaccgcgggtgaaaaccagtgtgtatcacaacatcacacttccctctccggatgcactgtgtcttgccatgccatgcactccagattgtaatctttgcttctcattctcaaatacaagcaaaatccaggcaaccctggagcaatgcagccttgaattcctggggtctcttgtatgcacactctcttcaaccaaacggggatcataactatggcatttgtgggatgcaaatcctgtgtatacgaatggcagactttccctatacatggtgcagtggagccagcttcagggctggagtacaggcaggttttgtgacatgtgggccacggactggagccagttcccttgtacaccaaagaacaactgtacttagagataattttctctagatttttgttttgttttgttattttaggttaaagcattggatagaacacccagtgtcaccttgtctacctccaggacatgctgcagggcccactctatggaagtccctctaacaaatgctctatgaacaccctggtgtttagtgcttctttctttggaatcccagcagctctatcactggacggtttggtgcactcctttgatggaattcctctgggctgcttggggtccactccagcctcaggtgtagctggaggacgcagcctcccaccttggtctggagccctgaggccctcactgtcattgcagatcccgaggttcctctcccacctccattcagtggtggaaaactccattctaattaccccttgaaggtcctgggaccctctggcctctgttctttcttgtggatccacctacacttgggaacttcctcacctctttttctgctcatgacattgatgctctgggtatttcagaaatgcctcatgtacatttctccattagggtcagatgtgagatccagagtggacacatcaatcatctacacagactggggggtccaacatcgagatcctttcacatcccaaacagttcaggtcttaccctggtctggaaatcaagcacaaatgagcccctccgaatgtcccaggcaccactgacccaacaaccactgtgaccagtgggattcatgacaacaatctgcaaaggaggaaactgaggctcagtgatgggacattacaaaccaaggtcatgtaggcagcggatgataaccagtcatcaaataaatatcaactccctcccccactccccaaatcaaagctcaaacataagtcattgttctcaaaacgttgaacagggattgaggtgcagagggatggccaagtaagcaaagggcaccgaggaggcaggaaagtctcagatgtttgttcccagcgggtgggagtggacactgtagcaaaatattttaaaaaggggaagttgagaggggactatttggttgaaagaaaacccacaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatggtaaggaccccacaacgctgagctgatggatggctgaaggagggagggtgaccatgtgggaggctgtgagaaggaaagggaagcctccgttaccctcatctggaagggcagacgcagaaagcaccagttctatttgctgctacatcccgtctctcagtgagaagaggagaaaccagacagacagtggctgggggtcaggaaagaccccattacagtctgaaatgtctgcagagggcctggttcctgcccccacctcagctctaaaagaatgagagtcaggctcctggtagggtagttctgcttcctgtgtggctgcagatgacaacaccccatgagaaggacccagcctccgagtgtccacacagggtgggaaggaggggaggctatttctctctgtgtgtctctgtcctgccagcaccgagggctcatccatccgcagagcagggcagtgggaggagacgccatgacccccatcgtcacagtcctgatctgtctcggtgagatttgaagagagaggggagcttctaacctaggagggacctcaccccacagccgacctctagtccctaaggagaccccaggggctcacaaagatcccagggaggggaggacctgcccaggcttcaggggcaaattcctcacagggaactctcttccagggctgagtctgggcccccggacccacgtgcaggcaggtgagtctgtccccagctctcccaggtccctcctcctcactggggacaaggggccacccccgtgcagctggggatggggaatagcagttctggactgactgatgggggcatctggagggtcctgggctgagagctgagatatgttgggtgggaaatgacttagaatctgaactctgatttccttccagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggtgagctgacactgagggctcccagccccaggctctgccctcaggaagggagtcagttctcaggggcatctccctctcacagcccagccctggggatgaagtgggaggtgtgagccccatttaacatggtgcctccttctctcctaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgagaaattcacagcattgcctggagttccctgagtctccctgagtctccaggcaggtggggagcagccacgtctcagggcagctccaggtgggatgatgttggggcgagagggctcagggctcctggggccggagacacaggaagatcagcagtggtgaggccccgggggagagggaggatatgtggggaagcctgagggtcggctcctggaaaccatgagcaccttttcccaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggtgaggagcccagcgggttcagtcagggacacaggctccgcacaggccctgccaggggagcccaggtggtgatggccggaatgaggggtgggggtcccaagggagggagagacagacagagacaggggatgggcggggcggggaagactcagagaaaacagagatagagactgagggtcccagatagaagcctggggaggcgtcagctcagaacaaggtggggcagcctctcacccatccttcttctctccaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggtgagggccctgaccctgtcctctccgagctcaaaggatcagctcaggccctgccccccaggagagctctggacactaagaaaagaggggagttggctgggcacggtggcttacacctgtaatcccagcactttgggaggcccaggcgggtggatcaggaggccaggagatcgagaccatcctggctaacacagtgaaccccgtctccactaaaaaatagaaaaaattagccaagcgtggtggcaggtgtctgtagtcccaggtactcgggaggctgaggcaggagaatggcatgaacctgggaggcggagcttgccgtgagctgatgtcatgccactgcactcaatcctgggcaagacagcgagactccatctcaaaaaaaaaggaaaagaaaagagtggagtgaagggggaaggtctgcgggggagggtcgagcccatgggagggtggaaatagacggggcctcccacccctggctcccacccttgtagtctcagtagggtaaagagcagggaaggctgggaggagatgggggtgaacctcagaggagatgagagtagactgagggtgaaagacagaggccccacctgctcccctcctgatgtctccacctcagaatcagagcctctggggatcccaacctctaagtcctgaccccatgggtgacaaaaacccagtcactcccagctctaaagaagtttctagactcatctcaatgctacctctaatattcagggtctgatttccagggcagcagaggggagggtggacagtaagggtgtggtctgcatggcttcctggtgctccagggatggggcaggtgttccctccgtggtgttcagaggggagagaggtgtctgaggttcagcattgatgagtggagcagcggggtctttccccctccccgagcaggattccaggagacatcacctctggttgagactctccactgtctcatgtacataacaaaatctctccaattttctactgaaagcaacacgtggcacagctctgcaggaccccacaccccgaccttgtcctgcaggatgtgtgacgagtagaagagggagaacaggtcgggtcagcaggatttggggtccagcctgacttggacacgtggaagatgctggggctgatggaggaggaacagaggcgggcgagttggaaagaggacagacagacggtcccttggcagctctcatttctcatttccaagggcccctgaggatgaacccctcacccacacctgtagggtccctgggccatctcaagacaagagaggaggccttggtgggatctgactgtgatgagggtgaagtccaccccgagcagaaatgagtgatacacaacacgtgctgtgaataattccctaacttgccagggagcaagtgcacggcccctccttagtctcaggggtgccctgagcccaagcccaccaggtgagcacaggaggggccgtgtgagcggcacccacagctggagtgcttctctctaaaggagcacgttttgggtggactcaaccctcaccacagtcagatcccaccaaggctctgtgctcagggcacccggagactaaggagggaccgtgcacctgctccctggatgagttagggaatgattcacagcacgtctcatatgtcattcatttctacactgtattttctgtacgtatgctttctatatgtatgctctctcctttactaaaacttttaaagcaatacttcaatatataaatttatattttttatttcaattatatgaacctattatttaaaaacatttaattttactttgcctttcattggggcttgatttaatttatatattcaatgtagacatccatttttcattaacctcaagtcttcctcctgtacatattaaaaatcgaggtttccttaacgaacttcagaaatgtttggatgtttcaaagcacaatggcccgagcgaaactgactgggcggctccctgtggcatgagaaacccgggggaggtcagcgggagctacagtgcagctcagccctgggcctggggggttcatgcccaaccttgtccaatcactggataattctaacatctaaataaacgtcttttatatgaaaaaagtgctttaaattgttaatttagatttaaattagaacagggcaatttggtagtgggttaatatgaaatacaatgaatatacccaaaccagtggctttctcatgagtacttatctctcgttttaaaaaatgtaaaggaatcaaatacttcacttataaattgttaaaggtgttgaataattctttaaattagaacgaatataattaaaaaaaattttttttgagatggagttttgctcttgttgcccagtctggagtgcagtggtgaaatcttggctcactgcaacctccgtcttccagtttcaagcaattctcctgcctcagcctcccgagtagctgggattacaggcgcccgccaccatgccccgctaatttttgtatttttagtagagacagggtttcaccatgttggctaggctggtcttgaactcctgacctcatgatctgcccacgtcagcctcccaaaatgctgggattacaggcatgagccactgtgcctggcctgaatataattttttaaatgtctacccaggacacccacctctccttgacagggaggttatataagttatacataatcttatatagaatttgttatataagttacctctgaatatgtctcttctcctctgttttgattctcaggagcagctgagaccctcagcccaccacaaaacaagtccgattccaaggctggtgagtgaggagatgcttgccgtgatgacgctgggcacagagggtcaggtcctgtcaaggggagctgggtgtcctgggtggacattttaaaaaattacattcattctaatttaaagaattcttcaacacctttaatgatttataagtgaagtatttcattcctttacatttttaaaataagagataactatccatgagaaagctactgctttgagtatattcattgtatttcatgctaactcactactaaattgctctgttctaactgcttttcaatggatctcctctaatttactaatacaatttgtataaaccgtaagacaatgggaaattttacttctttatttctaaattatgtgccaatatttctcactttaaatgtcaatatatatgttactacatcttaaataaatatctgaagttttacatatatacatatttatgtgtggttaagtaagatacttttgaatatgtgtgtaagtatatccaaattcatttgatgtatattcatgcatatgcttaatatatttgatgcggtaggtgtttacatgtttgttcctggtctagattcacctagattcacacttcataaaaacaaatactgatttatgaaccttgagtgacatctccatttagcatatatatatatatgtttgtatgtgtgtgtgaatgtgggaaactgtattgcattctaggtgttactgcctatatgaggaattagttaactagagattaaatggaagatgaaaccccaggtgaactggctgaggctgtgtgaagaagaagcacccccagactttcacccctttgtgcttctgacactggggagcccctgcagaccaacctcccatgcatggagcctgggtcctccgctggtggataagtgaaactctcatctctgggggaattggctcatgtgctcctgtgtccctggctgcacagacagcgcacagggctcagtgacttctgtattcccttgcagatcctgagctcccagagtgcaggaaaacgccctccccaaatgcctcaggagtaacattcgaatttctagaatgcaagaaatctgaaataattcaataaggacactggagggaaccctgctacacaggaagggtttattgaggaactccctagaactcatgtcagaagacataggggaagataagaatgcagagcccaggggagaggctggctcagggctcttcccctctgtttttattctcaggagcagctaacaccctcagcccatcacaaaacaagactggtgagtgaggagatgctctcgtttacggtgctgggcacaagggttgggtcctgtcaagggtaaggaggtgctctgggtggacatccagaggtcctgggtgaagttgatctgccctgacctctgtgacctctttgcccaccatccccagcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacctgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctccaaaccctacaagcccttccctccttctcagatgctacctgtgtatcttctcctcagatcactgtgtaaccatcactgccatcctgttccacacattgtcatcatcctacacccattcagcagccactccccattccctcttccctccagcacctgctaaccacaagtgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggacattttcaaagccttaacagaatatgaatgattacaatattatgttttacctatacagcatcttccaagttctagtttggttgtgccaggccaaacatttgagccagatttcggcaagatcaagcaggagactctggcgtctgtcgctgattaccttcccgccatacctggccaccagcctttcccatggaccccacgtgtgtctccagactcttgggtatgaatcctgtgaacacactgacctctgctttctacatgactgacaagcactatgaaatttgcataaatatgaatagaaaatatactgtccccacatcccctaaaataaaactgagtcctcacccatgggcttttgctggattatactaagaaaaggcaggtcttacaacacacattccatagactcacatctcagagaagattccttccacaggctcagggtcctgaacacactgctccactctcagggctcggagacactctgcaggtgggtcttcaccccatccgggagccctaattccttcttcctcggtttttcatacagtgatttttcccagtactgctgtctactttcctctgccagaaattccttgctggatccatggcaatctcctcaggactcctatttcataaaatggaaatggaattcttcatatgccttaaaaagtaaaataattatccaaacaatataaaata

SEQ ID NO: 12637 - DNA, 17763 bp, Human
taatataaaaattaattcaccttcacaatgtctgtctaatgcatttcaacaactgtctgtgttttcctcatgtatcttggttgtcattcctgtggggcggctcctcccacgcacctgacctttcataaagggtttctcccacggctgtccaggcatcagcctgatgaaggggattgttgccgctgctcctccccactcccccaaactcagtgtcagctcaagattgtgcccagcagggatgggaccaacgccagtctcacactcacctgtggggcagagcagacgcccatgtcagaccaccgtggattgaatctgtttctcacacacaggggaggggctgagcactgaccatggcctccagtgagtgagcagagaccccccagcgcctgtccacacacacaggggagggggagccacagcttccagcgtcacccagagccctgacccctccctgcctgggaggacgtggggttcctcttctgtcccacacggaggtgggagcctcctcctccctaatgaccctgggtggtcccagacacctgtggccactcagcattgaactctgctcatggaaggggatgcgtctcaatgtgaggaactgttcttcctctttctgtgcccgtggctgtgatgatctgcatatttcagatgtatcacaaggagaatttcatggtatttggagccgatgtgggctcttgagtgggggcgtcaatcatcctcctggactgtggagcccagcaccaggatcctctcccgtccccaccctcctgtctgaactggtctggaaattcaccatggctgagcctcccatgtcctgggcaccactgacccccacagccactgtgatgagtggggttcacgacagcaggctcagaggtgacattcatgtccaaagtcacataaaccctggatgataatcaggaattaaatacaaatcagctcaccttccccagaatcagattacagacctaacaaattcttctgaaaactctgaacatggacggaggtgccgagggaaggccaaggacgcaagggacactgagggggcgggaccgactcagagcctcattcccggggtgggggtgggtgatgttgcaacaaagagaaaaggggaagtacaggagagggacggtttggtaggaaggaaacacacactctcaagacagaacaaatatgttttattatagttaatccctgcatttccccttttgagacagggtctcactctgtcactgaggctggaatgctaagggatgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatggtaaggaccccgcaacgctgagctgatggacgggctgaaggagggagggagaccccatggggaagctctgagaaggaagaggaagcctctgctcaccctcatctggaagggcagacgcaggagggcaccagttctatttgctgctacatcccaggtctcaaggagatgaggataaaccagacagacagtggctggggggcaggaaagaccccatttctgtctgaaatgtctgcagagggcctggtgcctgcccccacctcagccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcggtgagatttgaagagggaggggagcttctaacctaggagggacctcaccccacagccaaactctggtccctaaggagaccccaggggctcacaaagatcccagggaggggaggacctgcccaggcttcaggggaaaaatccctcacagggaactctcttccagggctgagtctgggccccaggacccacgtgcaggcaggtgagtctgttcccagctgtcccaggtccctcctcctcactagggacaaggggccacccccgtgcagctggggatggggaatagcagttctgggctgactgatgggggtgtctggagggtcctgcagctgagagctgagatctgttgggtgggaaatgacttagaatccgacctctgatttccttccagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggtgagaggacactcaggagtcccagccccaggctctgccctcaggaagggggtcggctctcaggggcatctccgctctcacagctcaaccctggggatgatgtgggaggtgggagccccatttaacacagtgcctccttctctcctaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgagaaattcacagaattgcttggagttccctgagtctccctgagtctccaggcaggtggggagcagccgcgtctcagggcagctccaggtgggatgatgttggggcgagagggctcagggctcctggggccggagacacaggaagatcagcgggggagagggagggtttgtggggaagcctgagggtcggctcctggaaaccatgaacaccttttcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggtgaggagcccagcgggttcagtcagggacccaggctctgcacaggccctgccaggggagcccaggtggtgatggccggaatgagggttgggggtcccaagggagggagagacagagagagacaggggatgggcggggaggggagactcagagaaaacagagacagagagactaagggtcccagggagaggcctggggaggtctcagctcagaacaaggtggggcagcccctcacccatccttcttctctctaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcaggtgagggccctgatcttgtcctctccgagctcaaaggctcagctcaggccctgcccccagcagagctctgggacaataatgaatgaggggagtgaagcgggagggtccacaggggagggtccagcccatgggagagtggaaataggcagggacctcccacccctggctcccacccctgaagtctcagtaaagagcatgaagggctgggaggagacgggggcgggggggcgggtggtgaacctcagagatgtgattagactgagggtggaagacggagaccccacccgctcccctcctgatgtctccacctcagaatcagagcctctgggggtcccaaaccctatgtcctgaccccatgggtgacaaaaccagccactcccagctcaagagaagtttctagactcatctcaatgctacctccaatattcagggtctgatttccagggcagcagcggggagggtggacagtaagggtgtggtctgcgtggcttcctggggcttcagggatggggcaggtgttccctccgtggtgttcagaggggagggaggtgtctgaggttcagcattgatgagcggagcagagggatctttccccctccctgagcaggattcccaggagccgtcacctctcatgggggagccagggtcaggggagatcacagtcaggtacttggtctaggagtcaggtgggaggagcccggggaggtggggctgggtctgtgatggctcagcctctccttgggaggtggaacttctgaaagagcccattccccttgcaccctggactcctcatctgaataagggggagctgcctggatgtgactgccccaaagccccttcatttctgaccttctggggcatctgggatgtggctcatcctagacctgctcccgtctacagccctctctggccctctcctaattctcccaataactgagacttgttaagagttaaaaaaccaacggagatgggggcaggtgcatgcagttttacccatccctcctggaatctcagcttagtaagacaaagacacaatattttggaaaaaacaaaagtttacaaaaccccgctggttgagagtctcccctctctcgtgtacaagagaaaatgtctccaattttctaccaaaatcaatagctggcacagctctgcaggacccccagcccctggccttgtcctgcaggatgtgtgatgagtagaggaaggagaacaggctgggtggggaggatttggggtccaggcctgacttggacactgggaagatgctggggctgatggaggaggaagagaggcaggtgagttggagagaggacagatggacagtgtattggcagctctcatttctcatttccaagagcccctgagtataagcccttcacccacacctgcggggtccctgggccatctcaagacaagagaggaggctgcttgggcctcggtgggatctgactgtgatgaggctggagtccaccccagatgtgctcctttagagagaagcaccccagctgtgggtgccgctcacactgcccctcctgtgctcacctggaggcctctgtgctcagggcatccctgagaataaggaggggccctgcacctgctccctggacaagtcaggcaagtattcacagcacgtctttctgtttaactcatttctactctgcattttctgtatgcacttgtcctttgttactttttttctaaaacttttaaaacagtatttgaatatatgaatttataatatatgaacttaaaattgtatgcatatattatttaaaaatccttatttatactcccctttaattgagtcttgatttaatttatacattcaatgtagaaacaaatttctcattaatatcaactcttcctccttcacacattaaaaatgaagattttcttaatgaatttaagacatgttttgaaattttactcctaagaatattgtatgctcattttaacttaaagaattattcaacatctttaacaattgataagtgaggtatttgatttctttttatatatatatatattttattattatagtttaagttccagggtacatgtgcacaatgtgcaggtttgttacgtaggtatacaggtgccatgttggtttgctgcacccatcaactcgtcattcacattagtatttctcctaatgctatccttctcccagccccccacccctagactggccccggtgtgtgatgttccccgccctgtgtccatgtgttctcattgttcaactcccattatgagtgagaacatgcggtgtttggttttctgttcttgtgacagtttgctgagtgatggtttccaggttcatcaatgtccctgcaaaggacatgaactcatcctttttaacggctgcatagtattccatggtgtatatgtgccacattttcttaatgcagtccactgatggacatttgggttggttccaagtctttgctattgtgattagtgccacagtaaacatatgtgtgcatgtgtctttgtcgtagaatggtttataaccctttgggtatatgcccagtaatgggattgctgggtcaaatggtagttctagttgtagattcttgaggaatcgtcacactgtcttccacaatggttgaactaatttacactcccaccaacagtgtaaaagcgttcctatttttccacatcctctccagcatctgtagtttcctgactttttaatgattgccattctaactggcatgagatggtatctcactgctgttttgatgtgcatttctctgatgaccagtgatgataagcatttttgcatatgtctgttgcctgcataaatgtcttctcttgagaagtgtctgttcatatcctttgcccactttttgattttttttttttgtaaatgtgtttaagttctttatagattctggatattagcactttgccaaatgggtagattgcaaaaattttctcccattctgtaggctgcctgttcactctcatgatagtttcttttgctgtgcagaagctctttaattagatcccatttgtctattttggcttttggtgccattgcttgtggtgttttagtcatgaagtccttgcccatgcctatgtcctgaatggtattgcctaggttttcttctagggtttttatggtgttaggtcttacatttaagtctttaatccatcttgacttaattatcgtatagggtgtaaggaagggatccagtttcagctttctacatgtggctagccagtttttctagcaccatttattaaatagggaattctttccccatttcttgtttttgtcaagtttgtcaaagatcagatggttgtagatgtgtggttttatttttgagggctctgttctgttccattggtctatgcatctgttttggtaccagtaccatgctgctttggttactgtagccttgaagggtagtttgaagtcaggtagcgtgatgcctccaactttgttctttttgcttaggattgtcttggcaatgcgggcttttttttggttccatatgaactttaaagtagttttttccaattatgtgaagaaagtcagtggtagcttgatggggatagcattgaatctataaatccctttgggcagtgtggccattttcacaatattgattcttcctatccatgagcatggaatgttcttccatttgtctgtgttctcttttaattcattgagcagtggtttgtagttctctttgaagaggtccttcacatcctttgttagttggattcctaggtattttattctctttgtagtaattgcaaatgggagttcactcatgacttggctctctgtttgtctattattggtttataggaatgcttgtaatttttgcacattgattttgtatcctgagactttgctgaagttgcttatcagcttaaggagattttgggctgagtcaatggggttttaaatatataatcatgtcatctgcaagcagagataatttgactttctcttttcctaattgaatacactttatttctttctcttgcgtgattgccctagccagaacttccaacactatgttgaataggagtggtgagagaggaaattcttgtcttgtgccggttttctttttttttttttttttttttattatactctaagttttagggtacatgtgcacattgtgcaggttagttacatatgtatacatgtgccatgctggtgtgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgtgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgctacaaaccactgctcaaggaaataaaagaggacacaaacaaatggaagaacattccatgctcatgggtaagaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgtgccggttttcaaagggaatacttctttgcccattcagtatgatattggctgtgggtttgctataaatagctgttattattttgagatatgttccatcagtaccgagtttattgagagtttttagcatgaagggctgttgaattttgtcaaaggccctttctgcatctattaagataatcatgtggtttttgtcattggttctgtttatgtgatggattacatttagtgatttgcctatgttgaaccagccttgcatcccagggatgaagctgacttggtcatggtgggtaagctttttgatgtgctgctggatttggtttgccagtattttattgaggagttttgcatcaatgttcatcagggatattgacctaaaattatccttttttgttgtgtgtctacgaggctttggtatcaggatgatgctagcctcataaaatgagttagggaggattccctctttttccattgactggagtagtttcagagagagtggtaccagctcctctttgtacctctggtagaattcggctgcgaatccttctggtcctggattttttttggttggtaggctattaattattgccttcatttcagaacctgttattggtttattcatagattcaacttctttctggtttagtcttgggagggtgtatgtgtccaggaatttatccatttcttctagattttctagtttatttgtgtagaggtgtttacagtattctctgatggtagtttgtatttctgtggaatcggtggtgatatcccctttatcatttttcattgcatctatttgattcttctctcttttcttgtttattagtcttcctagcggtctatcaattttgttgatcttttcaaaaaaccagctccaggattcattgatttttttgaagggttttttgtgtctctatctccttcagttctgctctgatcttagttatgtcttgccttctgctagcttttgaatttgtttgctcttgcttctctagttcttttaattgtgatgttagggtgtcgattttagatctttcctgctttctcttttgggcatttagtgctataaatttccctctacacactgctttaaatgtgtcccagagattctgttatgttttgtctttgttctcattggttccaaagaacatctttatttctgccttcatttcattatttacccagtagtcattcaggaacaggttggtcagtttccatgtagttgtgtggttttgagtgagtttattaatcctgagttgtaatttgattgcactgtggtgtgagagacagtttgttgtgatttctgttcttttacatttgctgaggagtggtttactaccaattatgtggtcaattttggaataagtgcaaagtgatgctgagaagaatgtgtattctgttgatttggggtgtagagttcagtagatgtctattaggtctgcttggttcagacctgagttcaagtcctggatatccttgttaaccttatgtgtcattgatctaatattgacagaggggtgttaaagtctcctattattattgtgtgggagtctaagtctttttgtaggtctctaaggacttggtttttgaatctgggtgctcctgtattgggtgcatatatatttaggatagttaactcttcttgttgaattgatccctttaccataatgtagtggccttgtctcttttgatctttgttggtttaaagtctgtattatcagagactaggattgcaactcctgctttttttttttctttccatttgcttggtagatcttcctccatacctttattttgagcctatgtgtgtctctgcacatgagatgggtctcctgaatacagcacactgatgggtcttgattctttatccaatttgctggtctgtgtcttttaattggagcatttaacccatttacatttaaggttaatactgttatgtttgagtttgatcatgtcattatgatgttagctggttattttgtccattaattgatgcagtttcttcatagtgtcagtggtctttaccatttggcatgtttttgcagtggctggcactgattgttcctttccatgtttagtgcttccttcaggagctcttttaaggcaggcctggtggtgacaaaatctctcagcatttgcttggctgtaaaggattttatttctccttcactgatgaagcttagtttggcttgatatgacagtctgggttgaaaattattttctttaagaatgttgaatattggcctccactctcttctggcttgtagagtttctgccaagagatccgctgttagtctgatgggcttttctttttgggtaaccagacctttctctctggctgcccttaatattttttccttcatttcaaccttggtgaatctgataattatgtgtctttgggttgctcttctcaaggagtgtctttgtggtgttctctgtatttcctgaatttgaatgttggcttgcctttgtaggttagggaagttctcctggataatattctgaagagtgttttctaacttggttccattctcctcgtcactttccggtacactagtcaaacataaatttggtcttttcacatagtcccatatttcttggaggctttgttcatttcttttcattctcttttctctaatcttgtcttcttgctttatttcattaatttgatcttcagtcactgatatcctttcttccacttgatcgaatcagctattgaagcttgtgcatgcatcacgaagttcttgtgccgtggttttcagctgcatcaggtcatttaaggtcttctctacacggtttattgtagttagccattcatctaaccatttttcaaggtttttagcttccttgcaatgggttagaacatgcttctttagcttgaagaagtttgttattaccgaccttctgaaacctacttccatcaacttgtcaaactcattcttcatccagtcttgttctgttgccggtgaggagctgcgatcctttggaagagaagaggcactctgtttttggaattttcagcttttctgctctggtttctccccatctttgtggttttatctacctttggtctttgatgttggtgacctagggatggggttttggtgtggatgtcctttttgttgacattgatgctattcctttctgtttgttagttttccttctaagagtcagacccctcagcagcaggtctgttggtgtttgctggaggtccagtccagccagaccttatttgcctgggtatcaccagcagaggctgcagaacagcaaatattgctgcctgacccttcctttcgaagcttcatcccagaggggcacccacctgtttgaggtgtctgttggcccctactgggaggtgtttcccagtcaggctacacgggggtcagggacccacttgaggatgcagtctgtccgttgttggagctctaatgcggtgctgagagaaccactgctgtcttcagggctatcagacagggacgtttaagtctgcagaagctacctgctgccctttgttctactatgccctgcccccagaagtggaatctgtagaggcagtaggccttgctgagctgtggtgggctccacccagttcgtgcttccaggcatctttgtttacactgtgagctactccaacctcagcaatggtggatgcccttccctccatccagctgcagcatcgcaggtcgatctcagactgctgcgctagcagtgagcaaggctccgtgggtgtgagacctgccgagccaggcacgggagggtatctcctggtctgccagttgctaagactgtgggaatagtgcagtagttggtcaggagggtactgtttctccggatacagtctgtcacggcttcccttggctaggaaagggaaatcctccgaccccttgtgcttcccaggtgaggcgacaccccatcctgcttcagctcgccctttgtgggctgcagccacagtccaaccagtcccaatgagataaaccaggtacctcagttggaaatgcagaaatccagctgcagaccggagccattcctattcgaccatcttggaagcgacacctatattttttttaaagaaggataggtatccatgagaaagtgactggtttcattatgttctttttatttgttattcacccactagagaatggctcctttctaattactcttcaatgatctcctttaatttctggtacaattttagaaatcataatacatggaaattttatttctttatttctaaattacatgccaatatttctcaaatattaacgtgtatataactacataataaatacatttctgaagttttacatatatacacaggttctatacattacacatgatgtgagtggaggtatatctaaacacatttttatatgtattcatccatatgcttcacatatttgacatgacaggtctttacaggtttgttattggtcttcttatctagactcacacttgctggagcagaagtattcatttatgaacctcggatagcaccagcatttaacatatgcatatttgtgtgtgtgggtgggtgtgcatgcacgtgtattgcattctaggggttactgcctgtatgaggaattagttacctaaggattaaacggaagatgaaaccccaggtgaagtggttgagggcatgaaggggaggcagacccagactttcacccctttgtgttcctgacattcaagagcccctgaggtccaacccctcctccatggagcctgggtcctcagctggcggatccgtgaaactcatctctggggagcattggcttctgtggtcctgcacctgctccttgcagccagttagggctcagagaggacacagagagcacacaaggtcccaggctgcacagagagcacataaggtcctggttatttctgtattggggaccacttaccatatccatgctgagctcccgggatgcaggaaaactctcccaaatgactcaggagctgagtttggatttgtagaacacaggaagtctgaaataattcaatgaggagactggagggaaccctgctacagcagaggaagggtttattgaggaactccataaaactcatgtcaagagacacaggggaaaagaagaatgcagagcccaggagtgaggctgggctcagggctcttctccactgttttgattctcagaagcagctgagaccctcagcccatcacaaaacaagacagactccacgactagtgagtgaggagatgctctcagttatgggactggcacagagggtcaggtcctgtaaaggggaggtgggtgccctgggtggacatacaggagtcccggggtgattccgatctgccctgacctctgtgacctctttgtccagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaatgttgacttcccttgactggatcccctttttttcccatccccagacatgaggctccatcccacatggcaccgttgggtccacacctccacacacctgtgtgctctggtccacggcatgtgacacagtcttccttattcctcattgtcacactccttgatgtcacttactgagtccccgtctcttcagttcagagatccaaacctgaaccaccaactaaatcaacgacaggagatcagattccaaccaggaaaacataaatccaccctgctgccctgacaccctctctgtaccttatgagcccttccctctttctcagatgctatctgtgtaatttctcctgaaatatcaccacttggaatcatcacactggcatttcaagtgacaccacagctatgctgattcagaaaaagacatctctaaaatactgtaattagtggtatctaccaatttctgtgacataaatatttttctcatggcccaaatcaaggtgccaatgggttctcactgaatacagggttgggaagcaagggacagaactgtcttcactaatgagcaccagggacctgtggcacatcccactgagagctcacccatatacctacagtcctttctatttcagaggcaatgatcacttctacttcagtgttatggcacaggtcaaatgaaattctgacactgttatcctagcatatccacaaaagacaaacctattaatatctgatgtgggagataacacggctcacctaaaaatcaaagtacatgccgggcgcggtggctcacgcctgtaatcccagcactttgggaggccaaggcaggcagatcacgaggtcaggagatctagaccatcctggctaacatggtgaaaccccgtctctactaaatacacaaaaaaatattggccgggcgtggtggtgggcgcctgtagtcccagctactcaggaggctgaggcaggagaatggcgtgaacctgggaggcggagcttgcaatgggccgagattgcgacactgccctccagcctgggcgacagagcaagactccgtctcaaaaaaaaaaaaaaatccaagtacaacataagaaaaatgttaacagaactatgcagtttcgatgaaagaattttttttgagatggagttttgctttgttgcccaggctggagtgcaatggtgcaatctcggctcactgcaacctccacttcccaggttcaagcaattctcctgcctctgcctcccgagttactggactacaggtgtgcaccaccattcccggctattttttgtatttttagtagagacgggggtctcgccatgttagtgaggctggtcttgaactcctgacctcaggttatccacctgcctcagcctcccagagtgctgggattacaggtgtaagccactgtgcccggctgatggaagaattcttaaatgactcgttctactttctgctggtccaggcactccttggcttggggcagcatcccaccagtttctgcctccatcttctcaatgcttacacctacctggttgcctctgtcttcacacccattcttctgtgtgtgtcttttctcttcttcagattatgatatcactcagatcagattaggactcatcctaattcgttatgatcccttgatcataacttaaatgcatttgcaaagactctatttccaactatgttcacatttatagctaatggggctcaggatttcaacgtgtatattagggggaacaagtcaatttatgacagtgtctacaagaaaagtatgcatagaaatacatttaaccaaatacaaaaattaggtgggtgtggtggtacacgcctgtaatcccagctactcaggaggctgagacaggagaatcgcgtcaacccaggaaacagaggttgcagtgagctgagatcttgccattgcactccagcctgggcaacagagtgagactctgtctcaaaaaaagagaaatacatttaaccaaagagatgcaatacgtatacattgaca

SEQ ID NO: 12638 - DNA, 60917 bp, Human
tctagtaattatattttacctctatttaatctttaaaagatcagaattaggtttcctttccgtacttcacaaataagcagcacatctggccagctcccaagaattcgtcaagggttataaacattgcatgggctggactaattgtggctactttcattctctctgataagtttcatttccttccctgaaacttcatgaacttcctttggggtatagctaatgaaaccatgtgggatgggctgagacctttatcatcttcagacatttgtgttaaattgaatattgtgatgtatcttttatggtcagccttatcacatgctagctcaaggagaacagttgctagctcagttcgaggctgcagaaaaatggaagagaatgaaagatgattcttgcctttgtgcagttagcattctagtttgaaaatacaaacacaatgcacataatgtaacatgtgactacaaatctgtaactaccatgcattgagcaactactatgggacagacattgtgcttacataaacacacacactttaattctcacaaaaaccagggaggagatagggttaaccccccctcctgcccccaccccttttatgagaaaactgagacttagagaaattgactcccctaaggtcacctagctagacagtggtggaaccaggtttcaaactcaggcagagatgttccaggacaaaagcagcttcagtgaatagttgtagcaagttttaaggactgagaaatttatattgaatttttctgcggccttaggcaagttatttcatttatagaagcctcgtttttccttatctgtgaaatggctctttcttcattgggttgttctgagagtgaatgagatgatgcatgaagcccggcagcacatttcaaatgtataataaaaggtcggtaaggtcaataagtgaatcaatgaactcacatcactggtaacccctcgaactcacatcactggtaaccctcagaggggactcaggcgcctcaaatctcaggatctgcgtcgactacagacctcactgtttttcttaaacaaaaatcctgaaatccaggctgggcgcagtggctcacgccagtagtcccaacactgggaagctgaggcgggaggattgcttgaacccagtagttcaagaccagcctgggcaacacagtgagaccttgtctcttaacaacaagtccaaagggaatcatggcctccacaatcccagtacagctaaacagttaactgcccacgttcttttccttaattctatacaacctccctggggtttctggttctttggcaagtgagagacgtgctcctcaacactgggtgagcacaccgggcttgaattttaaaaaaggagaatccgccgggcacggtggctcacgcctgtaatcccagcactttgggaggccgaggcaggcggatcacttgaggtcaggggctcgagaccagcttgggcaatatggtgaaaccccgcctctaggaaataatttttaaaataagctgggtgtggcggcgtgcgcctgtactcgaggaggctgaggcatgagaatcgtttgagcccaggaagtcgaggctgcgatgagcggcgatagcgccactcactccagcctgagcgacagtgagactgtctcaaaaaaaaaaaaaaaaaagtaaaagctctcagggagcgacttttcccttggataaggcagccacacgctaagtcccctctccatcggggaccctggggacaaacagaacggtgcgcatttccctcccccgtccccattcggtcactgccacgggctgtacacctgagggggaaggacgggggcggcggcgcgaggaggaagggcttcgccgccaatctgtccctaaccagtctgcctctcaacccctgcctgaggcggaggcggtgcccggggcgggccaagcgtgaccgcgggtcggcggggcgtgtttaagaccgcggcgtgcgcacccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtgggggacgttcggaagtcgcagtggggtgggatttttttttccgggtggcgcggggcaagtgggtggaagggggtggcaccgggttaccctgcctgctttggtgtttgagactggggcgctgcgcccccgttcccgcgccccagcacctgccaggacgtgaggtgtctttaagggcggtgatacgggggcccatgaaattctctacacgtcggtcccgttgggtggcctaggggaagttcacagtgaaactcgaccacagatgagcgagatccagtggccagttggtttagaaggaataggggtacgagggcgcttatagcaagaaaaggaaactggagctaggggagagaggacgagaaaaacaactgcagatcccggtgatttttggctgcgtctcctagtgctgataattgctgctgctttcgcttcgggtccagcggtggaacttcgtgaacgcgtctgaaaaaccagaacccagggcacaagttcagggtttcctttctgagtttggcggccttgctggcagtggggcttggggactcagcggtactggacagcccgcggtcccagcctagccctggagaagagtttcgaaagctttggggtgagagaggtgggggcgaattggaagcctcgggcatttccctggttctgcctggatgtcctcaaatcctaaggaacaggtggagaccggactggaaatagcctgaggctgggggaagggaggccagtccctgaaggataaactagttgcctgaaaggcagagtgccccggggtggtgtgcgctggtgactggctttgctgagagctggagaggaaggtgaggaaaccggacacggttgaaggctggggctgaaggagtaaacacgaggaggctgggccaacctgcacagctccgtccactcagctccacaaacaagaccataaataaatcccctcagcaaagaagtccgctgcccactccggtgccaggcctaactgcagtgcctggggctgccagccgagggcttgcttggattggggaagcctccgcgttagccaatgactaaaccaagtggccttctgtaagcagcagcattggctggtttggagcccggcaggactggaggacgtaggggaggaatgattaaaacttatcgccccagattgggtgaccctgtgcctgtccctcatgacctttcaggtgctaaagagggggcctctcttggaacaaaaacagtttggagggcaggcctgggcctctggaagcatgagctgtagccaattcctaaggcaagaccaagatgaaatagggggattctggatgtgctaataatttggtggcctcaatattctttaaatattcaaaatgtatttagaagagagaaactcatttttcagaaaattggatgttcaaaacaaagatatacctattttctgaaccagaaaacatgttgagaaggtaaaatattgaacattaatgtaatagggccaggcacagtagctcacacctgtaatcccagcactttaggaacctgaggtggaaggattgcttgaggccaggagttcgaggccagcctaggcaacaaagcaagacctcagctctacaaaaatttaaaaaatcagccagggcagttgtgcacacctctagtcccagctatttggaaggctgaggcgggaggatggcttgagcccacgagctggagattacaacaaaaatttaaaaaattagggcagtggtgctcacctgtagtcccagctacttggaaggctgaggcgggaggatggcttgagcccaggagctggaggttacagtgagctatgatggtgccactgcacttcagcctggacaaccctgtctctaaagctaaaatgaaatttatgtaatagaatgaattactccttctcggggaatactatcacatcatgcgacaatgtcatgcaacacttggcttcataatttgggcagattgtaactaatgttccagtttgggatagcatctttgcaatcttcatgtacacattgcagtgagaactcagtgcccttgaggagtctcttttgtatttttatgttcgtgggagtttgccagccacgggcctggagactcaggttaaccagcattgcctttctaatcggttgccgtgatggtttagctccctgatgcgtgaggctgctgcctggctggccacccccatgatctgactttacttgcctcggtggcgttgagggatctagttaggcctccctaatcccctctcaatgttttctcagtttgcttgttgatgcctgaaatttttcacaggcagataaaaacttttccttgcacaatcagaagcttaaaatatgtgcatcctggcagaagtaatatctggaggcaaattggaaactgaagggtagatgaccgacattgagcctaacagcagatttgtacagagccaggaaagagaacgtacaccctgggagtagagtctggctgagggaggagggttttgacagctgatgatgggcttatcctcgtgacagttttgctaagagccaggcccagcaatggatcatcaggctatagcaggaaacggacagtaagagtgatctccccctcagaagcttcaggactcctgcaaggacatttccaccagccttccataaatgaacatgaatgagatgaatctgaggtcacctctgagaggcaaagaatacaggtagcagtggcccaggtggccttcgcctggattctccagggaggcattcatctctcaaatgtccagcccctggcatggaagaataaagcgccacagggtcatgtggggacatttggataatctttttctgagaagtgatgagtttgtggattgagacaagacctttgttttcatctgttacgctggggagcctgcattctccctgagtgttttcttccttagtacccatttctggctctaacattctactctagtccttaagctagtaagaatgtacttatttatttatttatttagagacggagtctcactctgtcacccaggctggagtgcagtggtgtgatcttggctcgctgcaacctccgcctcctgggttcaagcgattctccttcctcaggctcccgagaagctgggattacaggcacctaccacgctctgctaatttttgtatttttagtagagatggggtttcaccgtgttggccaggctggtcttgaactcttgacttcaggtgatctgcctgcctcagactcccaaagtgccgggattacaggtgtgagccactgcacccagctgataagaattaaaacaaaaacaaaaaataaacccctaaaaaacttattaataaattatcaggcattgaagagaatcgcagcaaattactcattttgtttaaggacagagaagacacaacagatgttcagtctgcttaaaacttcatagcagttttttccccagcagtcccgtgagaagagttctggtctagctttcaccgtctgctactggttggcctgagggggatgagaacatggcagagtggctgggaggaaggatacctgtgttttagtccaagctctgtcactaattactttttttttttttttttaacctttgcctgtatgctggtttcctggggctgctgtaactgaggaccacatacttggtggcttaagtaacaagaatttattatcttacagttctggaaggtagcagtcccagtccaagatgttggcagggttgattccttctgagggctgggagggagattctgtttcttgcccttctcccagcttctgctggtttgctgacagttgtccccaatctctgccttcatctccacatgaggttctccctatgtgtgcatctgtgtccaaatttctcctttttattttattttttatttattttttttgagaaggagtttcgctcttgttgcccaggctggagtacaatggcgtgatcttgtctcaccgcaacctccgcctcccaggttcaagcaattctcctgcctcagcctcccgagtaactgggattataggcatgcaccaccacgtccaactaattttgtatttttagtagagacagggtttctccatgttggtcaggctggtcttgaactctcgacctcaggtgattcgcctgccttggcctcttaaagtgctgggattatgtgccctgaaatttatcctttttataagaacatcagtcatattggactagggctcaccctcttgatctcaccttagcttgatcatctgcaatgactctgttaactaagtaaggtcacatttacaggtactggaggttaggacttcaacattttgggggcgggggggagacataattcaacccataacagacagcctttgtaaattttggtttggaaaattaaagagtttggcgctgttctgagtcatgaatgcgttagaatcgcctggggaaacactccaaaatacacataatatgtccagcacaaaggtggtgattcatgaagtttgaggcagctggagcacgagtattttggaaccagttctaagaggattctgatgtgtacccgggtgtgctggaccagcctctgaagccctttccatttgtggaaccctgcggctctctggtagcactgcagctgggcatgagcttctcacgagcctgataactgatggtgaggctttcagggcttggatccacattcagaggtctgggctggggccaccaaacactgcaaaaggctgggggccagaacacagtattcttaccttttagccagccattagtttaccccatgctttttgagccactaggactacaaagttggaagacgtccctgtactcagacaggtgttacagctaatgagcgatctatataatagattatgtaataaaatacaatatgtaaaagaattgctttactcggtaccatctgtagatctaggaaaaggagcctctgtcctgggtcccacgtctgccccccaaattgcatccctcctcactgggcagggcctgtgggctatgctgttccttaggccacgctccaagtactcaggatcctggatctccttccccaagtaactttgagctgattctaaggcctgcatgggcctcttgccctggtgtgtttccaagggccacccatgatgctggtgtgctcacctccaacccagagtggctaagtggcagttgttcatggaaaagtacgtgggtatgcacacagctttgtgtgctgactgaaggtgggggccttttcctctgtgcacacataaggatttgggtgagaagggaagaggggtggactgggggccagggccggctccccgctaccatgttctggtgcctttctggttgtgaatgaaattgctttttttttttttcagggtaggaggttagaacctattttatgtagcagtttgttcgttggacttaccacattgaattatttaggaatgtggtaggttgtcctctatttgtactttttttttttttttttttgagacaaggtctcactcttgtcactcaggctggcatgcagtagcatgatcatggctcactgcagcctcagcctccggtgttcaatcaatcctcccacctcagcctcctgagtagctgggactacaggctcgcaccacccaagcctggctagttttttctattttgtgtagagatggggtttcaccgtgttgcccaggctggtcttgaactgagctcaagcaatctgcctgcctcagcctcccacggtactgggattacaggtgtgagctaccacgccagcccatttgcacttttgagcccctgacatgttgggtggcaggactggctttaatgaaggcctgttagagagcagcagagatgtgtgtttgtgggtgggggaggggactttgttactttatgttccctttcaggtcaggcttagacagggaatctaatctatatttggcgtattggccggctgtgccagactaagtgccaagtgttgttcctgggaggctgaaatatttaaaatatttatctctgctagtgaacaactggcctgggttatgtgtgtgtgtctgggtggataaagttggggaagatcattttatttttcattcttagaattaacgatggcaaagagctagctcataaaaaggactggaaatgaggggaagcgtttactgttaaggctgcccttttccatgaagagctctgtgttttgtgtcctgctgataggttttggagtgccaagaaaaacccattgtgatctcagccgggtgcagagtgtagcagctagccccatgcctgttggaggatagaagagtaatttgagaccaaggaattgattgtttcaagcctgccaagccaaatgttacagagccattagccacacacagggttgctatgggtaggtcccttcagttctctttcagaatgtcactataaacgtgctccactgaagtagaacccagagtcatcaggaaggaggtggagaaagggacgtgccactgcgtaggttcgtgcacttccagcatctcatttctcctcactgatggctgtgtgaggcctgtgcagtcatgtttatgacatcattcacccaggacgccttctggacacaaaacccggtgttgagaagcaagagaaatgtaaaggctaaagggccagagcggtcccatggtgttttctgacttaatgctgatcgcaaagtgaaagttgcctcaagtgaaaaaaatgagaggagcatctaggtaaacactggcagaaaatgactcttgctggtgtaattcatgaagccagggttaatgtaggtctaagttactgcagaagcataagattcatacctgtgctcctctggccagttccccttggggaagcacccacttctaatgtagtttgtgtctatcggagtccagccagagaaacaaacgatgctgactgtttaaaacatggaattgaatgcggggcattctgacacaactgaggatattaaggcaccccagagatcagcaacagcgagaagccaccccttccttagggtgagggtcggagggagaagacagtgctctggagcccaggaagggactgggcttgcttagggaaagctggaacaaggaatacgcaggcctctctggtcggaggatccaggcccggaggcaacccagctgttctggagaagctgtctaaggcagaggggttctgggagaactaccctgacttccgccaacctctgcctgccactgtcctccagtttcccacccagtgtcctccattggcccatcccagccagaaatgaacttgagaaatggagcctgtagcagttagccttcctgggataagagcaggctgaggatggtgggtgggcagacaggctggcatctgccgtgggtcagagaagtaattcggactcttctagctcttggtgagttcctggctctatctagcacgtggcttctgtcaagcccacccttgtgactgtgttgttctggattgccgatagcaaggttagtcctacatgccccgatcttgaagttgcaggagaattggagccccctgacctccccacccagctgcttgcaagtcaaaggaacaagtgttgatatgcaggaacatatggttgcaatgtactttccaccagctttttgaaagatcctcataattaaagcagccgtggagggtaaaaggcgaagggattaattgtgtggcgctcactgcagggtgaatttggagtgtggctctaggtgaaaggtaagaagtgaagggattgttccaggaggagggccatggttggcaaggaagagtggagcagatcctcccaggaggggaatggtttctatagggcttgcgggtggggcgaagataacatgtatgtgggtctttagggaagtggatagaaggaggcagtggggttggagaggctgggaaagtaggagagagcttccgattccgaggcttgtcttgacggcggaatttccgctctggtgtctttggaatacctgtctttgacccctaagagaatccagggacctttgtcttgttcctactcgctccaaactccagaaattctgcacatttcacataagagcaaagcactcatttctttccctttttctttctttttttttggccaacaggtggatcttgaacgcaccttcacgtttcgaaattcaaagcagacctactcagggattcccatcatcgtggccaacatggacactgtgggcacgtttgagatggcagccgtgatgtcacaggtgaggcggtaggcttttgttttttccctttgctgctcacactgtggacaggttatcaggagccgaccctggctttattcagacacaaggaagagtagaaatgtgagctgctttgggtcattctctgtctttcccttcaatcagaaagtggacggtgtctggactttgggttcaatgagaaggtctagatctgcatccattgcttctgtgaaaatgactgtgatggttttggaaattagagatacaaaaagaagctagacaacatgaagagtgccatattgcagaaaagtgacaacccctttaaaattaagacagagctgctttgtatgcagtccgtgctgcagcatttactgtataattatgttgaatacatgtatcgagcgcttatgtacgaaacactgcagataatgtatttctttttttttttttttaagacagagtctcactgtgtcgcccaggctggagtacagtgacgtgatcttggctcactgcaacattcgcctccctggttcaaacaattctcctgcctcagcctcccaagtagctaggactacaggcacatgccaccatgcccagctaatttttgtatttttagtgaagatggggtttcaccgtgttggccaagctggccttgaactcctgacctcaggtgatccgcctgccttggcctacccaagtgctgggattacaggcatgagttaccatgcccggcctgtatctcttaattcttgacgcaactcaacaagataggttccttttacagatgaggaaactgaggcagagaggggaggggtaggtcacttgccctaggccctcagccagatgtatacagagagaatcaggattccagctgaaactgactctagaatctaaggaatttaccccttaacttaaatggatgatcacattgaaagctcaaagtctcttttagccaagtacaccagcctaattttctgtaaagagggtagctaatatccttgctttggctgggcatagtggctcacacctgtaatcccaggatttggggaggtggaggcaggcggattgcttgagctcaggagttcaagaccagactgggcaacatggcgaagcatcatttctacaaaaaaatatgaaaattggccaggtgtggtggtgtgagcctgtagtcccagctactcgggaggctgaggtgggaagatcacttgagctgggaggcggaggttgcagtgagccaagattgcgccactgcactccagcctgggtgacagagcaagaagaccctgtctcaaaaaaaaaaaaaaaaaaaaaaaaaaattcattgtatagatcaatctgagaagtactgtttgttaaaataaaattaaaaaaaaattaaaaatggtgtcctcgctttgggaaaaataaaggaaaacccatttgtgggcaggacatttatgggtgaggtgcagagcgtcttctgcatcctagatgtggaatgtctgctgcactcaggggttctgtctttcctgtggataatgcctgccaagtgaaaagataaatccaattagttgagagagcttctcactgtgggcagcaagtctgaccacaggagacactgagattcattattagccagtgattcgacggaaaatattctcaaataaattatgagctcccaaaatggagtaggggtggtctgtcggattccgtgatcacttgcattgtctgtcagacctcagcccctactgagcgttgggccagaggctaataaattaattgctaaggaactggtatttttttctcctcaccctttccctgctctgctctgtcatcagccattgctactaatgaattatgtgttagtataaaagtgaggggaaccagggagcagtcaagtctgattaattcacataatagattatagtccaggaaaaacctaggactcgctgtgctcttcccattttcctaggaagtctccctgctaacagaatagcatagactggtgtagctaaccatgggtggctactgtgaattttccgtttctaggatccatagaactagcacaagttactaaagtcatagaagtttagaatgagaagttgtagatggggacataggtagccccagagaagttaggtgggaggcttctgttaaagggcaaggtgtccaatctccgtagtcagatccaagtttgactctggccttttcctcttccccgccatgcagttgttacattttgtaatttttttttttttttttttttttgagatggagtttcactcttgttgcccaggctggagtgcaatggcaccatcttggctcaccgcaacctccatctcccaggttcaagtgattctcctgcctcagcctcctgagtagctgggattacaggtgctctaccatgcccggctaattttttgtatttagtagagatggggtttcactatgttagtcaggctggttttgaactcctgacctcaggtgatccacccacctcagcctccccaaatgctgggattacaggaatgtgccaccacgcttagcaaattttaaaagtttgatttgttttatgttttttaaatagacatggggtcttgccatgttgctaggctggtctcaaactcctgggcttaagtgatcctcctgcctcggcctcctaaagtgctgggattacaggcgtaagccaccatgcctgggcaacttaaactgcttaagctccatttatgcccacgaagctaataatgctgttcaaagttgttccaaaaattaaatgaaacgactgacacaaagcgggtcataaatgctggggcagtagtcataggtttagggttatactttatataattcccaccggcaagatttaatggatttaccttttagcaagaagtgttccggttgtgagcacaagagaaagctttcagggataaggtggggttcttcagggtcggctaagcagaagtttgtgttaggatggtccttctgggcaggggacctgctgcctggttttctctttggaccatcagtgctgcttttggcctaatacaggtgtgggtgggagcctgggtgggctgggtagggctctgagaattctcttttatccctctcctgcctcctggcagagcctccctagtcctgaatgcggtattgtctaaccagattagaatgggaaacagggttttatgatttcaatggttgtacctttgtttggttttggctgctaggagcacattcaaagcaaattaagcatggatggcaggaacactgatgcctttgtcttgttggatcaccacctccagatggaggagggaggggggctctcacttggcttcccatcctaatggtgctgttttgttttctagcactccatgtttacagcaattcataagcattactccctggatgactggaagctctttgccacaaatcacccagaatgcctgcaggtacgactacagcctggttatcaattaccagtgctgcaggggggaacaaaatcttcagagctgtcaagaggatttcagtcagtagcagagagacattgagagttcggtgtttctctagccctgtgccattgccagggatttgctgagaaaacttgtttccatattgtattattaaaatactaggatttatctgtaagaaatgtctgttttcccctgaaagatgaagtgtgttatatcccaagagcttggggaagacctgtgtttcctgccaggtaattcaaggtagatccagtcttttggctgtagaaaaaacttctgagtataacaaggtgctttagagttgagtaaacattattcccaccaggatggctgtcatcaaaaagacagataatagccaggcaccgtgggtcatgcctgtaatcccagcactttgggaggctgaggtgggaggattgcttgaacccaggagttcaaggccagcctggtcaacatagtgaggggtctctttttaaaaaaaaaaaagacaataaatgttgttgaggatgtggaggaactggaacccttattcactgctgggaatggaaaatggtgcagctgctttggaaaacagttgtcagttcctggaacgttaaccataagagttgccatgtgacccagcaattccatttctaggtatagactcaacagaaattaacacatttccacagaaaaacttgtacatgaatgttcatggcagcgttattcataatagcccaaaagtagacacaacccaaatgtctatcagtgggtgaaaggacatacaaaataaggtatatccatacagtggaatattgttcaaccgtaagaaggagtcaaggtctgatacaggctacagcatggatgaaccttgaggacatttcactaagtgaaaaagccagacgcagcccggcgcggtggctcacgcctgtaatcccagaactttgggaggccgagtcgggtggatcacctgaggtcgggagttcgagtccaacctgcccaacatggagaaaccctgtctttactagaaacacaaaattagccgggcgtggtggcgcatgcctgtaatcccagctactcaggaagctgaggcaggaacattgctttaaccccggaggcagaggttgcagttagccacgattgtgccattgcactccagcctgggcaacgagagcgaaactctgtctcagaaaagaaaaggccacacgcaaaggccagagcatctatgatcctatttctaggaaatgtccagaataggcaaatctaagtcataaaatagattagtggcctgaggggctgaggaagtttgagagggagtgtggttaaggggtatgagactttctttgggagggttatgaaaatattctaaaatctatcatgatggttacagaactctaaatatactaaaaatcattgaattgtgcatgttgaatgggtgaactgtatggtatgtcattatatttcaagaagccattaaaaaaaaacaacagaaagccttgctgcaacatgcctgcacttgctcctgccacattcaggtggttctgagctgaagccacagacaggtctccctgggttagaggtgttccctgctggtcagatcatttatgattggaaaatgacttcaggtcgtactgttttcaaggtctcactggctttttggggttgtcgttactgtgctttaattatgtgtggattttgattagtgaaaaagtggttttggatataaaataattctgactcaatagtaagtccttcatttttgccatattgtgttcaagtgaattgtgtttgttttcactttcttctgtttttccctataataagtttgggaataatgattttctttttgtctttttctcagacctccctctaacttcttttattttttttgtttgaggcagagttttgctcttgtcacccagactggagtgcaatggcgtgatctctgctcactgcagcctccacctcccgggttcaattgattttcctgcctcagcctcctgagtagctgggattacaggtgcgcaacacctagcctggctaaatttttgtatttttagtagagacaaggtttcaccatgttgacctgaaatgatccacccacctcggcctcctaaagtgctgggattataggcatgagccaccatgcccggcctccctccaccttctttaagggagtttttggcaatgtattgttaactggaactgtggctttcattaccaagtgtgatacatcgacttactacacagcccgccaccaaataaaaggcgaattcaaaagggataatgttaaaaacttagtagcagtgagagaaggcaaccaatctcaagttccatatagtatacttagacagaaatgaagtaagataaaaaaagcagagctctggtgggagggagagtgggcttgtgtggattgggctggcacagggcagagctgtgaaccacgaggcccaggcgtgaatgcacagagaaggctggagtaaatatgtgtcatgttaaccatcagctcactctcagtctctgcactgcagccacattgttatcatttgggggaataacataaaggatattaagataggccactcatatgtggcccagggtttagagataagagttaaaatataaacaatccatgtcttagtttcactaaggcataaattagtgaaagcaagtccttgcccaaggggcagatgttcagagaagggagaggtgtgaggttcaggggcactggtggaagttaagggacaagggtgttacaggggagaatgtggtggcttcagatttaaacatgtacaagtgtagttgtgaaagatcatgtcaggcttgtttgttttcacaccttgggaaattttatccctttaataggaaaacagatttgcaattctgtgtacaggttgagatttgcatgctgtattaggttgttcttgcattgctttagagaaatacctgaaactgggtaatttataaagaaaagagatctaattggctaatggttctgcaggctgtacaggaagcatagtgccacccatttgcttttgggaaggccttgggaagcttccaatcatggtggaaggcgaagtgggagagagaaagagagggtgggaggtcacacacttttaatgaccagatctcctgtgaactcagaccgagagatcaccaaggggatggcccaagccattgataagggatccacccccatgacccatacacctcccaccaggccccacctccactgggggggggtcatatttcaacatgagatttgggtgaggacaatatccaaactatgtcacatgctgcactattattttattgggagtgaaaataaaaataggtaagagtttttcagaggcatttcagatatcatcccctctcttgctccccaagcaaggtgctcagggtgaaggccacagctttcatgtggggaagcccgagttgattggccatttctccttcttcctggaaacttttggttcttgcttattgtcctcccttgagtttccctgatatgacacaatcatgccggtagtcattatttttttttttagtggcggggtggggtttggcggacggaaccttgctctgttgcccagactggagtgcaatggcacaatctcggctcactgcaacctccgccccccaggttcaagctattctcctgcctcagcctcccaaggagctgggattacaggcacctgccaccacgcctggctaatttttatatttttaatagagacagagtttcaccatgttggccaggcttgtctcgaactcctgacctcaggtaatccacctgcctcggcctctcaaagtgctgggattacaggcatgagccaccacacttggctaatttttgtattcttagtagagatggggtttcaccatgttggccaggctggtctcaaactcctgacctcaggtgatctgcccgccttggcttcccaaagtgctaggattacagcatgagccaccgtgcctggccaaagtttagataatttaatgaatgaatcccctttacctctgctgttgcatgtgtcttgagcaggtgcactgtgcatttgattagggtagaccgaaaagggttgttgtactgtcccagaataggtgcataaatgggggcagggtctgatgtctgaatgctactgtttatgcctgtcttcttggtttattttggtgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggtaagtacggtagaacattacggtagaacattctcaagatggggaagccacgagggagttgttcaatgtgtcgggggagctgtatcctcttcagagcttttggtgcctctttagtcaaagattaattgaggatcatttgggaaaggataggtagccgctgcggaagatctgaaaactagcttccctctataaaaaataaaatccccatcaacttcataggatgttggctgcaatttttcctaagtatcatcacatgtttcttactatctgatactttttctttttttttttttgagaaggagtctcactctgtccacccaggctggagtacagtggggtgatctcggctcactgcaacctatgccttccaggttcaaaagattcttgtacctcagcctcacaagtagctgggattacaggcgcccatcaccatgcctggctaattttttgtatttttagtagagacggggttgcaccatgttggccaggctggtctcgaactcctgacctcaggtgatccacccaccttgatctcccaaagtgctgagattacaggtgtgagccaccacactcagccccatatgatacctttaaaaggggtttgtattacttcttaacagagagtgtattttaagattgaaaacgtgactgggtttgagtgtcacatatgtaggtcctccatgtcccacccctactgccagcaggaaactctgctgtaggaattgggagtctacgttatgaacatttcacgacagtctactatcgatggtgaatcggtcagtggtgtgttttatctaggagctttgtttcttgacttttcctgtattttcctaattatctgcaccttacctagttagaatgtagatttgtgacttttgggaaagatggattggcagaaaaagggacttagcagctctagagtacaacttgggcttttgcaaaaacctgtattgtaattatgcaagtctttgctaattctaattatgatggcacatactgattgaccactagataatttacctaccccttccttttttgaattttgaacttcgtttcttctcatatatgttatcattgtaagaaagttgggaggaaggaattgttatggagtaaagtcttcttctaaaggactttcaaggattgttaaggatttttatgtttttcaaacacataggaagaaaggatcaagaattgttccagctgggcgcagtggctcacgactgtaatcccagcactttgggaggccgaggcaggtggatcacctgaggtcaggaatttgagaccagcctggccaacatggcgaaaccgtgtctctactaaaaatacaaaaattagccagccgtgatggcgggtgcctgtaatcccagctacttaggaggctgaggcaggagaatctcttgaacccaggaggtgaagcttgcagtgagccgagatcacaccactgcactccagcctgggcaacagagggagactccgtctcaaaaaaaaaaaaagaattggccgggtgcagtggctaatgcctgtaatcccagcactttgggaggccgaggtgggtggatcatgaggtcaagagttcaagaccagcctggccaagatggtgaaaccctgcatctactaaaaaaaaaaaaaaaaaaaaatagaaaaattagccaggcatggtggcagatgactgtaatcccagctacttgggaggctgaggcagagaattgctcgaacccgggaggcaaaggtggctgtgagccgagatctcaccattgcactctagcctgggagacagagtgagactctgtctcaaaaaaaaaaaaaaaaaaaaaaagagttgttccaaggtcaaccagctgtaccagtgttagaagtgggttgggaaatagaaaaattcactttgttctctgtaatagaacagccaacttcattgcttttgataatgatgtttgttgaatactgttaaataataagaaatgtatatgtgtttattggtctcagcccttggttcttgagacagaactcctaaaacccttgtagataagggtgctaagagaatcttttgttctaatatttggtcattgatcctgattgctgacacagagcttctagaacctttgtaatttccagagtgatgacagcacctggcacagagcttctgaatcccttgagatttcctgggtggtaggagtagcttttgttctaatatttaatctttgaccctggttcctgacacatggctcttaaatcccttgggatttcctgggtgatagcagcacagctgctcttgtcctaacaaggcgactcttaatgggctcctgtgtgggggttggtcatcagatagaacaagccatgattagaagcttggagcttctggctccatcctccattttccagagaggggagagggctggaagtagagttaataatccattatgcctccttgacgaggccttcacagaaacccccaaagtatggggttttgaaagcttcctggcgggtaacacgtctacatgcctggagggtggcagaccccagctctgtgggtccagcactctggactcttccagacctcaccctatgtctcgcttcatcaggctgttcatctgtatccttcatcatagcccttattaatacgataaactggtaaacattccataagtggtcatcctttatgtcttttatcttctttttcttgatagtatatttgagattcaccacattgctttatgtcagctgtatatatatattccttggttcctgaagctaatctttaatatcatttcctagatacctcacttgctctttttccttctctttactttccagctggttgtatcgctgttaaactcactccttaatgctctttgtctgagtctgtttagtctgctagcataaaataccataaactgactggtgtataaacaacagaaaattgctcacagttctggaggctggaattccaaaatcaaggtgttggctgatttagtgtctagtttcaccgttcctcataggtggtgctttcttgctgcatcttcatatggtggaagaggcatacaggctccttggaacctctcttgtgagggcactaatcgcattcatgaaggctgcacccttatgacctaatcacctcccaaaggccctgcctcctaatgccattggattgaagattcagtttcagcataggaatctgtgggggacacaaacattcagcccatagcaccccagaagtcagtgtgggcacatgagctgagtcacactggggaaatcgcattctttctgaatctcactttcctcacctgtgaaaaggaggttgaggatcctcgtggctggagaatgactcgggctcagatgggatgctgttttgtaacagtgccaccttcactagcatttgctcgtctctggtgagtgtcatcaagggcacatgctctgagaactgagtcagagatggagaagaaagatggagggtaatgtggggtttaagaagagagagaaaatgtgtgtcactctttaaaatgacaagtgatagcagaaatgcattagtgctcccaagctgtccattacattctccaaactggagctgctgtggggtgtagttcacagctgggcctgctgagaactgtgagctgcctgttggacagcctagagagcctgcatgtcacctctgaaggacaaagaccaggaaggagggaagtgcaggaaggagggggctgggtaagacgagggaaagggtgttgttgccagtgcagaacttaggagttgctatgggggagtttactgggagggaggagatcggttcagagttcccacagctgtctgggaagccaccaacagcgaggccctctccagcacccgctggctggctggcccaggggtatgttttcattgctcttgttggtttccccagcaatgaacaggagactttggcaaggtaggtgtttattcttaagctgttctgtgcctgcattgacccttgaaatctgtgattcttttggaaacctccagtacttttatgtccttggtttttggtgtttttgaaacataatttcttatggcttttggaggcattgtgaagacgcattcacatttttccagtgttttggaatgaatgatgtaatatgagggctgagtgttatggaatggagtgttattacgattgttacaatacagtgaacagaaaggatgctcacaaacgttccaggaagaagctggcagttcctggcctctgcaccaggagtgagggcttgtcgctccctgtgcccagtttctcctggttttttttccttgccttttttcatgtgcgtccgtgtgaagagaccaccaaacaggctttgtttgagcaacatggctgtttatttcacctgggtgcaggcgggctgagtccgaaaagagagtcagcgaagggagataggggtggggccgttttataggatttgggtaggtaaaggaaaattacagtcaaagaggggttggtttgttctctggcgggcagagtaggggtcacaaggtgctcagtaggggagcttttgagccaggatgagctaggagaaggaatttcacaaggcaatgtcatcagttaaggcaggaacaggccattttcacttcttttgtggtagaatgtcatcagttaaggcaggaaccggccatctggatgtgtacctgcaggtcacaggggatatgatggcttagcttgggctcagaggcctgacattcctgtcttcttatgttaataagaaaaataaaacaaaatagtggtaaagtgttgggacggtgaaaatttttggggatggtatggggagataatgggcgatgtttctcagggctgcttcgagtgggattaggggcggcgtggtaacctagagtgggagagattaagccgaaggaagattttgtggtaagggttgatattgtgggactgttagaagaaacatttgtcatttagaattattggtgatggcctggatacggtttttgtatgaattgaaaaactaaacggaataagagaaggagaaaaacaggtattaaaggtctaagaattgggaggacctaggacatctaattagagtgcctaaggaaattcagcatagtcctgtcagcaaagattatttatttacttcaagagttaagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgacaagtttttttggggcacagtctaagttggtctggtgtctggaatgagactggggcctaataaaaaggagcgtctatacaggagctcaaataggctgtactttgtagcattctgaggacaggtctgacttctgagaagggaaagtggtaaaagtattgtccagtcctttttaagttggtggctgagcttggtgaagtgtgtttttaaaagacctttagtccgttctacttttcctgaagactgaggaccgtaagggatataaaggtttcactgaatactaagagcctgaaaaactgcttggctgatttgactaataaaggctggtctgttatcagactgtatagaggtgggaaggctaaactgaagaattatttctgacagaagggaggaaatgactgtggtggccttctcagaccctgtaggaaaggcctgtacttatccagtgaaagtgtctacctagactaagaggtattttagttatctgactcggggcatgtcgagtaaagctaatttgccagtcctgggtgggggcaaatcctcgagcttgatgtgtggggaagggaaggggcctgaataatccttgaggagtagtagaatagcagatggaacactgagaagttatttccttgaggatagatttctacgatggaaagaaaatgagaggttctaagaggcgggctagtggcttgtactatagcatagcctgcctttgctggtgtgtggcgattaggcctggtggaactgccatcaataaatcaagcgtgatcagggtgaggaacggcaaagaaggaaatatggggaaatggagtgaatgtcaggtggatcagagagatacagtcatgggggtcaggtgtggtatcaggaataacgtgggagggtggattgaagtccgggccaggaacaatggtaattgtgggacttaacaaagagtgagtacagctgaaggagccggggagcagaaagtatatgcgtcaggtatgaggaagaaaatagattttggaagttatgagaaatgtagagagtaagttgagcatagtttgtgattttgagggcctctaaaagtattaggacggcggcagccgctgcacggagacatgatggctaggctaaaacagtaaggtcaagttgtttgcacagaaaggctacagggtgcggtcctggctcttgtgtaagaattctgactgcactaaccatgcctaggaaggaaaggagttgctgttttgtaaggaattgaggtttgggagattaattggacactatcagcagggaaagcacgtgtgtttttataagaattatgcttagataggtaacagataaggagaaaatttgggcttgactgaagtaatgggggctgtctgtgaagctttgcaacagtacagcccaggtaatttgctgagcctgacgggtgtcagggtcagtccaagtgaaagcgaagagaggctaggaggacaggtgcaaaggaatagtaaagaaagcatgtttgagatccagaacagaataatggactgtggagagaggtattgaggataggagagtatatgggtttggcaccatggggtggataggcaaaacaatttggttgataaggcgcagatcctgaactaacttgtaaggcttgtctggttttaggacaggtaaaatgggggaattataaggagagtttataggctttaaaaggccatgctgtagcaggcgagtgataacaggctttaatcctttcaaagcatgctgtgggatgggatcttggcattgagcagggtaagggttattaggttttaatgagatggtaaggggtgcatgatcggtcaccaaggagggagtagaggtatcttatatttgtgggttaaggttgggggatacaagaggaggacacaaaggaggctttggattgggaagaagggcggcaatgagatgtagctgtaatccaggaatagtcagggaagcagataatttagttaaagtgtctcggcctaataagggaactgggcaggtggggataactaaaaaggagtggttaaaagagtaacgtctaagtgggcactagagttgggggattttaagaggcttagaagcctggccgtcaatacctataacagttatggaggcaagggaaacaggcccttgaaaagaaggcaatgtggagtgggtagcctccgtattgattaagaaggggacagacttaccctccactgtgagagttacgcgaagctcggcatccgtgatggtcttgtagggggcttccgaggcgatcgggcagcatcagtcttcagccgctaagccaagaagatgtgggaagcagtcagagagccttgggccagaattccaggggcgctgggagtggctgccaggtgagttagacagtccgatttccagtggggtcccgcacagatgggactcagcttaggaggaatcctgggctgcaggcattccttggcctggtggccagatttctggcacttgtagcaagctcctgggggaggaggttctggaggaacgcctggctgctgcggttcaggcgtttggaagttcttgtgtgctggagatgtggctggggtttgtctcacagtggaggcaaggaattgcaacttttctctattattgtacaccttgaaggcgaggttaattaaatcctgttgtggggtttgagggctggaatttaatttttggagttttctttaatgtcgggagcagattgggtaataaagtgtattttgagaataagacggccttttgaacttttagggtctagggctgtaaagcgtctcagggttgctgccaaacgagccatgaactgggctggatttttatatttgatgaaaaagagcctaaacgctatccgatttgggataaagaaaaaggagcattaaccttgactatgcctttagctccagccacctttttaagagtaaattgctgggcaggtggggagggctagtcacggaacgaaactgtaagccagactgtgtgtgaggaggggaggtgataaaaggattatagggtggaggagcggaggctgagaaagaattgggacctagctcggcctggcgaggagcagcctggggaggaggggagaggtcagatgagtctgtagaaaaggaagattagaaagactcagcgacgcttggggttgggactgaggggacaggcgggagggaaaggaggaagatttgggacgagttgcattgggaacagagactagagagggaccgatgtgtaaaagaatgcctggatgtcaggcacctcagaccatttgcccattgtacgacaagaattatttagatcttgtaggatggaaaaattgaaagtgccattttccggctatttggaactactgtcgagtttgtattggggtcaagcagcactgcagaagaaaataagatgcttagcattttaggtcaggtgagaattgaagaggttttaagttttttgaggacacaggctaagggagaagaaggaggaatggagggtggaaggttgcccatagtgaaggaagcaagcctagagaaaagagagtagagacacggagggaaggggttcaggggttcttaccttccagaaaagcgggaaaggggttggggcgtggaaataaggggttgggatgcagagataagaggtcgggttgcagagataagaggtcggggcacggaaataagggatggggtgcagagataagaggtcagggcacagaaataagggattggggtgcagagataagaggtcagggcacagaaataagggattggggtgcagagataagaggtcagggcacagaaataagggattggggtgcagagataggtcagggcacagaaataagggattggggtgcagagataagaggtcggggcacagaaataagggattggggcacagagatataagaggttggggtacatgcccctcctctagaaaagtgggacttgccgctaagtgtgaaggagaaggggttgggggtttcttgccccccagaaaggcggagaagggatagagacacggagagaagggattagggtacttgccccttccccagaaaagcaggacttgccgctaagggtgaaggaccaaggcaggcatccctgcgtggtctgacacctctgaaacccggtagaataatcagaggtgtccctgcaatgattaaacaccaagggaaggctgccttccctagtctgtgaccggcgccggagttttgagtccgtggataaaacgtgtctcctttatctctaccagaaaatgaaaggaattgaaattaaaagaagggagagattgaagtgtggcgccaagattgaaaggagagaggctgagggatagtgagggaggttggagaagagagtaaaaagaggccgcttaccggatttgaaattggtgagatgtttcttgggctggtcggtccgaggacctgaggtcgtaggtggatctttcgcaaagagcaggaggacaggggattgatctcccaagggaggtcccccgatctgagtcacggcaccaaatttcatgtgcgtccgtgtgaagagaccaccaaacaggctttgtgtgagcaacatggctgtttatttcacctgggtgcaggcgggctgagtccgaaaagagagtcagcgaagggagataggggtggggccgttttataggatttgggtaggtaaaggaaaattacagtcaaagggggggttgttctctggtgggcagagtgggggtcacaaggtgctcagtaggggagcttttgagccaggatgagccaggagaaggaatttcacaagacaatgtcatcagttaaggcaggaacaggccattttcacttcttttgtggtggaatgtcatcagttaaggcaggaaccggccatctggatgtgtacatgcaggtcacaggggatatgatggcttagcttgggctcagaggcctgacacctttcacctaagatgggccttgccacataggggtaggagaacagggatttttagagaacacctttgtcagaaaaggtcctattgaggggctggctgattgaagagtataccaagtcctgtggccatttgcctggtggctttcagggaggaaagagaataatgtgttctcgggtacattctcagtactgtgtaaaaaggcactagcacagactaggcacttctttgttaaaaaaaagtttgtagaaacagaatattgcagtgttgaccagggtgatctcaaactcctgacttcaagtagtcctcctacctctgcctcctaaagtgctgaaattacaggcatgaatcaccatacctggccagaatttcttttctaataacaaatctttgagtagaggtaatagcacctacttttgttgatgtaaaacttagtcctagagagctcagggagccttctgagggttacaccactagtgagagctggacctggcatttagggctaggtggcttgcctgagcctgcaaatttttgctgttgtcccccacatgccaccagttcaggcttgctggtgagaggtgaagccagcttgactttctgggtccagtggggacttggagaacttttctgtctagcctagaggattgtaaatgcatcagtcagtgctctgtgtctagctaaaggattgtaaatgctccaatcagcactctgtaaaaatagcaccaagcagcgctgtgtctagctaaagcagcactgtgtctagctaaagcagcgctgtgtctagctaaacgcaccaatcagcactctgtaaaaacacaccactccgcactctgttaaatggaccaatcagcaggatgtgggcggggccaaataagggaataaaagctggctgctggagccagcccggataacccactccggaacccttccacgccatggaggttttcttcgttcgcttgctgctgctcgctctttgggtccacgcgacgtttatgagctgtaacacttactgcaaagatgtgcagtttcactcctgaagtcagtgagaccacgaagccacccgccgggagaaaggaacaattgtggatgtgcaacctttaagagctgtaacactcaccgtgaaggtctgtggcttcactgctgaagtcagtgagaccacgaacccagtgggaggaatgaacaactcccgacgggctacctttaagagctgtaacacttgccatctttaagagctgtaacacttgccatctttaagagctgtaacacttgccatctttaagagctgtaacacttgccatctttaagagctgtaacactcgctgcgaagaatgaagaacgccgcgcgcaccacctttaagagctgtaacactcactgcgaaggtctgaggcttcattcctgaagtcagtgtagaccatgaacccacgaggaggaacgaacaactctgggtgcgccacctttaagagctgtaacactcactgtgaaaaaggtggcacgtcggacgtgccacctttaagagctgtaacactcactgtgaaaaaggtggcacgtcggacgtgccacctttaagagctgtaacacttcctgtggaaaaggtggcacgtccgacgtgccacctttaagagctgtaacacggctgggcgcggtggctcacgcctgtaatcctggcactttgggaggccgagatgggtggatcaccaggtcaggagatcataaccatcctggctaacacggtgaaaccccatctctactaaaagtacaaaaaaaagaaaaaattagccgggcgcagtggcgggcgcctgtagtcccagctactcgggaggctgaggcaggagaattgcatgaacctgggagggggagcttgacggcactccggcctaggtgagagcgagactccgtctcaaaaaacaaacaaacaaaaaaagagctgtaacactcactgtgaaggtcgtggcttcactcctgaagtcagcgagaccacgaaccgtccgggaggaacgaacaactccggacgtgccacctttaagagctgtaacactcactgcaaaggtctgcggcttcactcctgaagtcggcgtagaccatgaacccacgaggaggaacgaacaactctgggtgcgccacctttaagagctgtaacactccctgcgaaaaaggtggcacgtcggacgtgccacctttaagagctgtaacatggccgggcgctgtggctcacgcctgtaatcccggcactttgggaggccgaggtgggcggatcaccaggtcaggagatcatgaccatcctggctaacacggtgaaaccctatctctactaaaagtacaaaaaaaagaaaaaattagtcgggtgcagtggcgggcgcctgtagtcccagctactcgggaggctgaggcaggagaattgcatgaacctgggaggtggagcttgcagtgagccgagatcgcgccactgcactccggcctgggtgagagggagactccgtctcaaaaaacaaagagctgtaacactcactgtgaaggtctgtggcttcactcctgaagtcagcgagaccacgaaccgtccgggaggaatgaacaactccggacggtgccacttttaagagctgtaacactcactgcaaaggtctgcggcttcactcctgaagtcagcaagaccatgaacccaccagaaggaagaaactccggacacatctgaacatctgacggaacaaactccggacacgccatcttttaagaattgtaacactcaccgcagccgaaggtctgtggctccagcgagaccaagaacccaccggaaggaaccaattccagacatactgggacttggaggtccctgtgttggctctgggagatgcttttgtgctggtggctctttctgatctggtctggaggaaataggtgcctgagatctaatgtgttcagattagatagaggccaagctctactcccctggggcaatgccgtgtcagctgctgcgggcagatctccgggagccatgggctggatctccagggcgggaccctgacatttccatgcatgactgatggctcattggcctgcccacattctttctcaaggttctgagccacacagatgtttccgctgtacgcctcttcacagagaggcggacacattgaatgttccttgaaagcttggggcaggtctggggcctcaccattcaagtgtccctcccctgaggtacaaggggtgtgtatggctgagagcacctctcaggccgtgttccctggattttctgtattcacccactttctggaaccatggctgaaagctacaaaggtgatgttctctctgaagagtcacataataaactcagtttaacatggctgttgcctggatagcaactatttttccatgggcaggtagtgggacattttccacgtgcttgggaacagtcactggggttgatactcctcttttttgttgttgttgagatggactctcactctgttgcccaggctggagtgtggtggcacgatcttggctaactgcagtctccgcctcccaggttcaagtgattctcctgagtagcacacctggttaatttttgtatctttagtagagacgaggttttgccatattggccaggctggtctcgaactcctgacctcaggtgataacacctgtctcagcctcccaaagtgttgggattacaggcgtgagccaccgcgcctgccgatatttctctttttatgttaggggttggcacatcacagcctgtgggccaaatctagccgcctgctgcctgtttgccaacccttgccttttatcatcctatggaaaggatttttcttgcaagaggaccccagaaaaaccagtaaaaagtggttactgtttaatgggtacagaatttcagtttgagatgattaaaaagttccagagatggataatggtgatggttgtacaacagtgtgaatgtactcaatgccactgaactgtacacctaaaaacttatttactaacaaattttatattacataaatttaaaataaatatgaattattttaaattaaaaattttaaataaatttaaattttttatttatttttaggtgtacagttcagtggcactaagtcccttcacgaaaaaaataaaaattatttaaaaaacaaaaattttatttctgttttctatgtgtaaaatttacacctagtaaattttatgtgtatttgaccacaattacaaaaaaactaaaaagaatgggtaaaggagcaatatacagaaagtacttttaaatggagggactaacatttataaagcaccaccaagagctgggccctgtgctaagaatttgagagaactttctttgtaaaccttttaaggactaaaagtgggtacatccacccccattttatagcaggataaatggagactctggttgaagtgatttgctcaaaagtacccagtaatgagggaggtctagcattcgaccccagatctttccgaacttattttgccatagatgttgaggcctaaaggaaagctggaaaaattggggcaaagcagtttttgtttttatttttgcccagagaccttttgtcatcagttctgttcaggctgcaataacaagataccataaactgaatagcttatattataaaaatcagaagttggcctggtgtggtggctcatacctgtaatcctaccactttgggaggccaagacaggcagattgcgtgagcccaggagtttgagaccagcctggccaacatggagaaaccccatctctactaaaaatacaaaaaattagctgggcgtggtgtcacatgcctgtagtcccagctactcgggaggctgaggtgggaggatcacctgagcctgggaagttgaggttacaatgagctgtgattgcgccattgcactccagcctgggtgacaaagtgagaccctgtctcaaaaataaataaataaataatacaaatcagaagtttattttcacagttctgaaggctgggaagtccagtatcaaggcagattcggtatctggtgagggccggcttcctggctcatagatagatggccatcttttcattgtcacctcatgtggatctctctcagtcctctcttagacggccactaatcccattgttgggggctctgcccccatgacctacctaattcacctccccaaatccccacctgctaatatcaccaccttgggaataaagatttcaacactttaattttggagggacgtaaacattcagaccataccaactttttaaaaaatggtacaaaagtacttgaagtcttggcttggccactttttatgtcttttccatgaccttcaacctctccttgacacagaattgttgccttccagagcatgggggagcccaaaacatgcttggcttccctaggaagaggggttgcctatcagaaacctccatctgcctgcctcagtgctctggacaagggttcattgcttccatgttgtcatggctgcccaagaaatgaacctgcatgaactgcctgggtgactgagcctgctgtgctgctacgcacagtcccattctgacagtcctgtatccgctccacacccaaggtgcttcatgacaagataaagtagactcctcacttaatcaccctgaccagctgcttcctggcccctgttatcacaccccattcccagaggctgctcgagggcacaccggggacttcactaaagcctgaccacactcctgtcatattctcatttctgatttggtcttttcctcttttcccttattttgcccttcttgatttcaaacttgaattgacagctttttgttcctgccaatggaaactcccccgtcctcctggaagcattcttgctgtgctgtccctcatggttgaggcatttcataatcactttgggtttttccagacagtagcagtgaccacatttggaccatggacagattcagcagccacacaggtagctgatgggatggagagacatttgcacaagcttctgggttactaaagcggcgtcagccttcttgatgtttttaagctgactttggccagttgaggtggctcatacctgtaatcccagcactttgggaggcagaggtggggggattacttgaggccaggagttagagaccagcctgggcaacatagcaaggccctatctctgctttaaaaataattaaataagtaactagaacttactttgactctaccgggttgtacctggtacgtctatggtgagctgacttgaattaatctattttatctaaagtagccccttaaaaataaaatggttcgcaggtggcgccagattggggaaaagaaatccacattgaaaatgaaattgtggccgggcgcagtggctcatgcctgtaatcccagcactttgggaggctgaggcaggcagattgcttgagctcaggagcttgagaccagcctaggcaacaaggcgaaactctgtctctacagaaaatacaaaaattagctaggcgtggtggcacatacctgtaatcccagctgcttgggaggctgaggcaggagaatcgcttgagcctgggaagttcaggctgcggcgagccatgtttgtgccattgcactcccgtctgggagacaagagtgagaccctgtctcaaaaagaaaaaagaaaacaaaatgtgtggtgggcttagagtagcttctctaaagtttttgtggttttgtttggttgtttagcaagtcagccacttgggaagaactggagctcgcgccctgcttcttaggctcctgttaggttctctgtcagggacagagctcatgctgttcctcgcactataaaaaacaaaactacacactcctgcccccattataattataaaagtaacacactttctagtataaaatctagaaaagattaaagaagaaacaaaaaaaagtttgatcatctcttcacctagacatcatctgttagcattttggtgtattttttcatacacacatacactttttttaataacaaaattgagatctttctatttctcccaacattatactgaaagcatttaagcatttttcccatgctgtcaaaccactcttaggctgggtgcggtgcctcacacctgtaattgcagcactttgggaggccaaagtgggcagatcacctgaggtcaggagtttgagaccagcctggccaacttggtgaaaccccatctctactaaaaatacaaaaattagccaggcagtgggggcgtgtgcctgtaataccagctactagggaggctgaggcaggagaatcacttgaaccctggaggcagaggttgcagtgagatcatgccactgcactccagtctgggtgacagagcaagactccatctcaaaagcaaaacaaaacaaaaaacaaaaaaaacactcttaaaaacatcacatggataggtcataagttgttggatcattccattttggggaatatatttacagttctgcactgttacagataatacatctttgtagttaaatgtttgtccacacttatgattatttccttggcagagaatcttagaagaattattgaatacaaggaagtgcatatttcttttatatggacaaacggctttctgggaaaactcatactacaataaattttcccaaaagaaatagagattccatctgatgttttctctacagtatttactgtttacaactattgataatttgttaagtgaaaagtagtacctcattggtaccttagtttacatttggttattcaggaggttgaacactttccgtttttctcagccacttttatttctttcaatagtgtgttcctgtcctttggcacttactctgtgaggtattagcgtttttcttataggtttgtaagagctcttattatgttaaggataataacactttgtcaaaattgtagatatttttctctacctgggtatttgttgattgtatgaatatctgtgtttatgtgtatgtcagttttttttcttttttcttttttttacatagagatgggattttgccatgttgcccaagctcgtctcaaactcctgggctcgagcaatccacttacctcagcctcccaagtgctgtggttataggcgtgagccactgcacttggccaagtttttagtttttatgtagacagctctgtcattatgttttttcacttttatgcttattgaaagtattcaaggtttccttctgaatttggggagtataactttaattttaattctttaatctacctctagtcctctttctgggccatctgtgatttttccattgtcagctactgtttggattaaagctttaagccctcctcatcaccttttccccacatccttttatatgaagttaaaagtcactttgtctacgttaaaaaagaaaaattccctctgggaagcaattcagagagaagacacttggacttcagtgcaaaagacatgagtggaatgagtaaggattcattttgcaaaatatgactttgcacagttgtgaaaactcagccagggcatcttgccaagtatcctatatactggctgaagaatccacagggcagtgagttgtaataaaaagggctatttttgcactcctacactcctgcagtgaaagagcttgtactgtttccaaaccagacacatccttctggttgatagattctgccacttcctggaggcttgtgtgttcttaggccaaagcttcatgttctgtaaactgagcacgtgctgatgctatgtggtccatgagggctcatctgccctttcctgtctagatgggaatcccagccctagagagtggggcacactgctattttcttaactgcgttttctaattctgactctctggggttccataaagattcttcaggggctttgcaaactgtgaaacatttttttgcccaacactaaagatattaattaccaagagtgtttcattgctgactttttgtatttgggggtccctctaagattttttttttttttttttttttgagacagagtcttgctctgtcgtccaggctggagtacagtggtgccatcttggctcactgcagcctctgcctcccgggttcaagtgattgtcctgcctcagcctcctgagtaactaggactacaggcatgcgccaccaggcccagctagtttttgtatttttagtagagacagggtttcaccatgttggccaggatggtctcaatctcttgacctcatgatctgcctgcttcgggctcccaaagtactgagattacaggcgtgagccaccaagcccagcctcctctaagatttttgttgttgttgttgattgctgagatgtctgaaaagccctgacctggactctctaagatctcttctagttcttaaatcatataatgctgtatcttctcatgccaacagctcacccaaggggcctttcccaaaagtggtctccaggtatgaaattctgtgttccttttttgtcccccagctgcctggtggctttaggacatgcacatcctcgtgttcaggtgtggggttcctcacctttataccagcaatagtagttcatgatcatcagctgtattctttctgtctcaggcagggaacgtggtgacaggagaaatggtagaagagcttattctttccggagcagatatcatcaaagtgggagttggaccaggtaagacttgttaggagcacagcagaggacgtgtgtggggaagaatgggatctggggcttgcggggactgcagatcactggaggggatgcatgaatgactcattcacagatatttaaagcatgctttttctggaagcataattgagcttctcggggaagcccctgatgaaaagtattgttgagctgctttttgatgcccccagggattttctaaattatggttagaatatatggatgtggtcagaatatgagggcttggtttcagaaccaatgtggaagaatgtagatttcactaatgaccccatacaccttgcagaggaaggcgataggtgaagaatccatagagacagttaataaacatgaatgactccagtttatgtgaatgtttgagggaccccaaacattgcaaataagcttgcagtgatgaggccacattcaaacttgacccatggcctaggtaatgatcacctttggttactcacctgatacgtattagatgtagattttgcccatgttcttctcccaggcatgctttcttaggaccacccattggcatcttaagcagaagaacgaggtagagccttctgtccttgtcatgggtggcgccattttctcatggggcagggttactgttcgctttccttctttgccctgcttgaagatgagctgccatgttttaaattcatccgtgcacatccagtattaaccagacactaaaattgaggagcaagaaagaatatacacattttcacttgggactgaaaaacagcaaagatttttcaaaagaatctcatacccaaatgacactaccaaaaaaggaagcaaacctaaaccaatatgagaggaatctgtgggaaaacgcacagctgggaggcgcaggagacgctgttgagctgtgacttggctccgtgatcagcctgagggaattggatgtgtatgaagagaatattaggaagaagaaccctgtagattcgtaaaaatacccaagcttttaacatacagggagattttcaaggttaagtttttcatattgccactcatttaagccagttaataatgtattctgagcaaatgggaagaggtctttactgagtatctaccattattgaaaaggcaagaaaggataaggcctcgttcttcctttccaggctgcctcctcttagggcaggctgtaatagacagactgataatagaacaaaataggctaatagattaggaagactctttttagtcccaaaggcagggacactcactagtcacctgtttaatcagaaatatgggcctgatgtggtggctcacgcctggtctcccagcactttgggaggccaaggtgggtggatcgcttgagcccaggagtttgagaccagcctgggcaacatggtgaaactctgtctctactaaaaataggagataaaaattaaaaagtagtcaggcacagtggtatgcacctgtagtctcagctacttgggaggctagggtggaacgatcagctgatcctgggaggtgaaggttgcagtaagctgagatcgcactactgcactccagtcttggtgatagagcaagaccctgtctcaagaaaaaaaaaaggaaatatgtattgaatgttcactggctaccattgtgttgggcgggtgctgtacaggatgtgaaggtgtgtgagaagcttcttggctctcaaagctttattttttttgagacagtcttgctctgttgcccaggctggagtgcagtggtgtgatctcagctcactgcaaccttcgcctcagaggttcaagtgattcttctgcctcagcctcctgagtaactgggattacaggcatgcaccaccatgcccagctaattttttgtacttttagtggagacggggtttcaccatgttggccaggctggtctcgaactcctggcctcaggtgatccacccgccttggcctcccaacgtgctgggattccaggtgtgagccaccacacccggccctctcaaagcttttctagatgtggtctcgaacatttactacacttgttttcttcttgcacatctctgtgtctgcattctatttccccagaagctgtattgtccttctgctctcactgtatctccccacccctctggctgtctgtgtaggacagatgtgactaaagagaataaggggctttctctgagcccaatgcatgggagctacttctttaaattgtttggagaccatatttaagtctcacacattctttatggtaaaaacattgcatattacatatctaaatgatagcattattggatgtctattgattgatagatttcattcattattgagcaactcctgggaactgggaaaaagcatcagaaacggattccctgcccctctagtcaagagaaagtatgcaccaacttcttctttcacctaggtgttaatcagaaccgcctgtgtgttatttgaagcttcttccttggctgtttccaagaaaggcaattggtctaccctttatagagccctcactactatcagaaccccaggcctactgcagctgaggcccccacccccggatctagcaattcaatgggagaggaggagaaaagctgaggctgaaccgggggttaaaccttttattctgccgtgcacaacgtctggttgcagggcggggggaaggcgccttcgtgggaatgagacttcttggctccaggactgtgagtgacacatagcaggacacagggagctacaggacttctgtggactctgccccacagctgatgcaggagaggggcttgccctgtctctcctggtttctctgctaaatccaggcctggggacacagacatacttctctgtctgatcttgtccctaaagacccctggcagaaattagcatcctacaaggtggtgccggccaggagccggagattaggctgcgcctcaaagcatcccacccccgggtctggtgggagggaggagttcacttccacctttaccctgtccccagagcgccctctcgtgcacaccacaagacctccgggaggggctgagtgagtggcagtggagacagggatgtgggtgactcattcattcttgagtccacacattctttcagtgactatttatagtgccttattgtatatgaggctctgttctcagcacctgataacaacagcgaatgtccacggagccgaccacccagtacagaagacagacccttaacattctcacacagatcctgattgaaatgcctctttttgaaactgtgatgaacaactcccctggggcagtgacatttaagaagaagctggaaagatgagaagggtttggctaggcgggctggtacagaggggagtgtccaagagagagaacattgtgtacagagtccctaaggtgggaagaaacttgccccattggagaagcagtggggagggaggggagcaggtggagcttgattctgctgatctgggtaaagtggggtgctgtggcggcaccgggaagcttgaataaggggaggtatgataaagaggtcagagtgcgacttggcctggacctaactgggagaacaaccaggactggggctgaccgtgggacaggcaggcaggagggtgctggtgtgagccctggcctggaagtgaacctcgggctaggctgcaagggacttgaggtggggcagccaggagggagatggacaaacagctgggccctgtggagcacagagctgagtgagagcaggtgagggtatggagggtgtcgtgctgcaggccaggccctgggccaagcggtatccctccctgtgccatttgttctctgccacaaccccaggaggttgtgtttctctttggattttacaggccgggcagtgaggcttaagagaggtgagtcatttgacaaaggttgaaggtaaagaagctacgagccagtgggaggattctgagaggtcctttaaagcagagtgtagatttgtagaaaggtggaaaggagtgggtgtttaagtgtggaaaggtcagtgcctggctattgcatgggagccagtgccacagggaggagtggcagtgacaggtgcatggtagaggggaaggcgatgtctgggacatcagccagtgacagtgatgaggaccggagggggtgcatgaccaggtggtgtggtttacagtgacctccatcgtgcagatggggcagcctgttccccacatctcctctgccacagaggttcaccctggtccctaaagcagggctgcaaaggtaagggggacgcatttcatgtcacagtcttctcatgtataaccatctatttggggacaacttctttctctgtgcaggttctgtgtgcaccacccgcaccaagacgggagtggggtacccccagctgagtgccgtcattgagtgtgccgactctgcccatggcctgaagggccacatcatctctgtgagtctccacccggggctgaggctggggtgtcttgggaggcccctgctccctcgctgctcttctttcactggctgggcatcctgtgggcatgggagggagctgggcactgcggtcacagcgctgacattcagcagaaacagaggccctgctgcccacggattccacagtgagggtggcaggcccagtaggcagaagccatacaagcaggtgggtggtccatctgatgagggatgtgcaggcagctttcagagcacagggtaggccaggccacagcttgctagaacagttgtaataaagccccacagactgggggcttcaatttcagtgtctcaccattctggagacgagaagcccaacatcagggtgttggggggggcatgctccctctcagggccccagggaaggatctgttgcaggcctctctgtgaccttctgctggttccttagcttgtggcgtcctctgtgtgtgtgtctctgtgtgcaaacatccccttttcctgaggatactagtcctttcagatcaggggccaccctcctccaggatgtccgcatcttaactgatgacgtgtccattgttcctgtttccaaataaggtcacattctgagatgctaggggttaggatggcaacatgcgagtttttggggggacccagttcaacccataacaggccacgtatcccatattcagggtcagggaaggtttcctggagtgtaatagagagagctgatggttgaaaaggaagttttcagatgagaagaaagaagggaacagaaaagcactggggaaccaaatctcagtcactgcatctggggcgagtgacctgagaggggcaggcgtgaggggcagcaggagataagcttgagggcaagtatggacaagagctgtgggatccacctttaaggatgggacttctccaagagcactagggagctattgcagaggtctgagtaggagagtgcccaactcactgccttgggtcagattgaaaggggcaaaataaaaaagagagcccagctgggacgcgttagtaattcaggagggggaggtgactgtgctctgcagcaggcttgagagccatctccagaattgactgacatttgggaggcagaattaaacaagtgtcggcaatggagtaggtgcttggggggcactggagaaggagaaggaggagcaaggctgtggctggctcatgtgctggctcacctggaagatggctgcaaaggaagaggttcggggctggtgtggtgatcactatggcacgtgtctgttgattctgaggtgcttgaggggcatcagaagggaaattgcacatgaggcattgtgttcatagttggagacctggcagcttttagcccatagatgatgaaagtcttgggaatggtgctcaggtaacaactgaagctaggatcaaggtctttcactcgctgtccagtgcagattgcctgggccccttctaatgcctcatccaaatttttcacccacccatccattcatccagcaagtctctattaagcatctactgtgatagtatctgaaataaatggtcaaaggtttattggttaatgacagagttctaagactctccactcaataccctttgccccagtgaacaaattaatatccatttattgagcaactagtgtgtaaaaggctgacatagaactgtcggtctacatttgctaagaggttattcaactcacgggagcggccaggcagtagtaccattccgcagtatgtcagtggttctcaaatcctgagtgcagccttgtctgagtctggctgcgtgaggatcaccagagaggcttttacaaatcaacattccgggaccccatcctagtgaactggctctttcagaggttagtccccaaaatccccatatgtaattagtcctgtctccattacctaataatgttaaccattgagcatctccatcaagtcaaaacttggaccctatatcgtaagtgttgaatgaccactatttccaaagtagtggagttctgattaataaagttttactctgaacatattctgagatccttatgtctttctagaaacttcaaacttgcttagtttacagggctgtttggccaaagattggtggtaggcagggtggggtggaggctctgtgtgccccagaggtgaatctgattggaaatcaacttagcatctctttacacagcaccacctaatttatagtgtatctcagcagttctcttaagcgtggtgcccagaccagcagcagcagtatcaactgagaacttgttacaaattcttgggccccaccatcgacgtgacctacagaatcagaactctgcaggtgaggcccaggaacctgtttaaacacgagccctccaggtagttctgatgtcctctcaagtgtgagacccactggcttatagagtagaggctcagcatacgctggcggggtgagtgttcctgaaccaggtctcatctgctggtgcccaaggcagcaacttctctgaatttaacagttagggacaatgacatcccaagcctggggcactggtgcaataggaaggtagcacttctgatcttgcttgtgttctctgaggttcttttttttctttttagtttttacttttttattttatttattttttatttttttgagatggagtcttgctgtatcgcccaggctggagtgcagtggcatgatctcagctccctgctagaatgcctcccgggttcaagcgattctcctgcctcagcctcccgagtagctgggattacaggcacgcgccaccacgctcagcccattttttttttgtatttttagtagaggcagggtttcaccatgctggccaggctggtctcgaactcctgacctcatgatccgcccgcctcagcctcccaaagtgctgggattacaggcgtaagccaccgtgcccggcctccgagtttccttttacgtcaatgctgagaggtctcctagatggggttaggagttccatttagctggaaaagcaaatgaatggacttagtagaatttggacctttgccctcagctcagtccttgtaagcagctgagtgtcttgaggttcagagcagccattgcccccacactccctttgtctaacagggcacgggcacgtttctgtcacttgccagtagccctgaacctgctagaaacccaccaggtgttttggatcctgccacttggtccaatttccttccagctgtcccattttaccctttatttgctgaattagcacactggtgccattgaagttcaaaggaagccacaacatggtgtctgttgagcatgtactgatacccaagaggctgggcttcagtcgtgtttctgttgtggcccacatgggcttcagagaggcagagggaggaaaaattcaggatacttcctgcataggtgaagattaaggtgggaccagttaattttttgttatcacaccattatttagaaatacctaaacaaattcattcaaataattaatctttttttttgagtctggaaaattttcccagcaaaatgtgtttaacctaggaaaagttagaaatgcaaataaacataaaaaggaaaataagtattagcagtaatgctatcatcttaagataaccactggttctaaacttgtttttccatttttatagctgtgtgaccttaggagagttgcttaacctttctgagcctctttccaccgtccccgccgtctacgcaatatctccttcaggttcatgagtttgaatggaaaaatgacttttaagttcaaaagagttgctggttcttagtaggtgactgatttgaactcctttctctgcctactccatgtttgccataccatccttcctttgttttaggaataagcaagtatttttcttttttcctttttgttttttcattgtcagtattcaacataatgtgagcaagtattttttttttcttttttttttttgagacagagtcttgctttgtcacccatgctggagtgcagtggcatgatctcggctcactgcaacctctgtctcccaggtttaagtgatagtcctgcctcagcctcccgagtagctgggattataggcatacgccaccacacccaactaatttctgtagttttagtagagacagggtttcaccatgttcgccaggctggtcttgaactcctgaccctaggtgatctgcctgcctcagcctcccaaagtgctgggattacaggtgtgagccactgtgcctgtagcctgagcaagtatttttaagcaaaagaggcaggctgacagttcacaagttatccttcatgtcctgtgatgccatttgtacttaaatataatgttaactcttttggaaaaacaaaaaaaggactccttgtacattactgctttgaatacttgcacagaacaaacaaattacaagcccaaatgttgttgtttttaacaacctttcagcagctatgaatgtttatgtgtgaagatgcatgtatgtcttgattgctggagctacactgcttcccgagaacatgaaaggacactttgaacacttttggaaatataaacagtagcaggaagtagactgccatgtctgtcctaaggcatcatgtgaagttggattgctcttggttaaatgtacaaccattaaccatatacagttgtttggtctacgctgaccatttcacaagtgcacatacaaaagcaccctgtgagcggatgacgccataaatatgatttcctctttgcaatacgccatacagttgtattaactgtggatctcttggcccatcctgggaagagaaaggctgattttcttggggtcccagtggcacagggctcctgattcaggcctcatcacagaccacagtaataagaaattttcaggacaccacaggagacacaaatgagtgaacaaaagagtgatttttttaaaagtcatacatgtgtaggacttattttaatgggagcatgagtttatttaatgtgtttgaggccagaagtgtgaaacactgtgtagagctggttttgataaagagataaagcactttaaaattaattggcagggcaagcgaagggcattttgaggttgtacctttgaaaggtaaaataaataaatatgccaggattttgaagcattaacaaggggtatagagccacaagccctgtccctgtcttcacacagtgggtttgggccagataacatacggcaagaccacctctgaaataatattcctcagtgctctgtggccctctgggggtcagagaagccatgtatgaataacacatttgattgaggaaataactgtggtcagtaaatgtttgtaaagaaaaggtccagccttcacacttaaccttttgatcagagctgcaaagaagtagtgaaatagtattggagttctagctcctggagtgacaggcctcactggtagatagagaaagggaactgagtcacagagaccctatgttctcagtttgagatgttcttcacaaggtgggtcatcccatttccctgctctccaactccagaggtgtgtgcactttcctgcaggttgtaacacggggtagcctgggcaccctgtcttttctctattccttcccaaagtgggtcccaccttctgcggacaggtgcttccctctgaggtcctgctgtttctcctagacccacacttagctttgggctgtgtcactgtcacgtgagccctgacactgttgctgtctccccttgcaccatggctttcgtgactgtccccgtgtgtctggctgctgctccagcgtactgttgctgtccttttgccccttgaattgcgcccaggctacattaggaatagcaggtagcagcctgggcatttggtgtcttgtgtttgtaagaaaatgcagctagtggctgggcgcggtggtgcacgcctgtaatcccagcactttgggaggccgaggtgggcggatcacctgaggtcaggagctcaagaccagccaggccaacgtggcgaaatcccgtctctactaaaagtacaaaaattagctgggcttggtggtgggcacttgtaatccagctactcaggaggctgaggcaggagaattgcttgaacccaggaggcagaggttgcagtgagccgagatcacgccattacactccagcctgggcgacaagagtgagactgtctcaaaaaaaaaaaaaaacaaaaaaaaaaaaacagaaaagaaaagaaaattcagctagctctgcatcctagaagacttgtactgtgtagctggagtttaaacattacccccaacagctgaaccttgctgggcagcccaagataacagactggccctgctacacattaaaccagcccaagtgtggtctgcatgggcagtgtgggtggaaaaacagatgtttgattttaaggtaactttgtaccatacatgaggaataggaaacatggaggtacctggaaagataaaaggattaactcaatgtccttttcttggctcttacaagaattcaacccttgtactaaataaatctcacctcacaccaggcagagagggaaaggtgactcctgagtgagaatgagtgtggacagtggaatggctgggtgtgttatgtagggggctggcatgggatgagggctgagcccctctgccgctcacagcccctgctgcctcctgctctgcaacagaagtgtctgagcccaggcaggcaggtgggcagtgggtggtgccagcttctgacccacagaggaagcctggatgggcctggggagtgaaaggtgcaatattgaggggagtacactcgatcagacaacaacagccgtggtaggggaacttgggcccgtgggcttgctgggggctgtggtgggtctgaacccccagtcactaggtcatctggggggaggggacagcctggctgagctcccgctgatgatgtcctgtccttgctttttcctctgtgaaggatggaggctgtacgtgtccaggggatgtcgccaaagcctttggtaaggccgggccctggtgcagagggagggaaggaaggaaggagggagctccctacacctctccagctggcaacctgaatgaggagggggacctggtggggaagttctgggtctcctggaggttcctctccctgggtttcagccccaattggcccaaatcctggaccgtggcagagcaggtcacagatgccccaggagatatctaggggtgacgtcctgcaagccaggagtgggtgaagtcacggccttttcatcccagggaagagaaagctcaagggacctgtccaaggggatggtgccaggtgtgatgtgtaacaactacagagggggttttttggacccagcttggagaagtcccgtggaagggacaggaggaatcccgcagcggtttctccctggaggctggagcctgcctcccgctagggggcagcagtgcctgctgtgagcccgtgggattggggatggggagcggtggtgggagggcagcaggtcctgagcttttctctggaaagcactagacgctccagcctctcaacaccacaagcagtaaagtacggctgccgagccatgtgttggccatagaactgcaaatggcatttggaagtcagagctggccgcgtggctgtgggctccagaatgtgaaatgggcgttgtgggtgccggcgggaggcagaaacgaagctcccatgcctccgccctttgctgatgccagaaaaaaaaaaaatggtggcaggaaactttatgtcataggaattctgtttttttgttttttggtttttgtttttaattttcaggctgggtgcggtggctcacacctgtaatcccagcactttgggaggccgaggtgggcagatcacttgaaaccagcagtttgagaccagcctggacaataccccatctctactaaaaatacaaaaaaaaataccggggtgtggtggtgcacgcctgtaatcccagctactcaggaggccaaggtgggagaatcgcttgaacccgggagccagaagttgcagtgagccaagatcacgccactgcactccagcctgggtgacagagtgaccctgtctcaaaaaaatataaaaaataaaaattaaaaaataaatggtcagacaacaaccctgatagtgacaaaggaaaacacagggcagtgttcttagcaacaaggtttcatagcaacccaaagatgtcatgaaaaatggtatttaacctcctcctaatcatagatcctatctgtggagaggaatctacagaccctccactgattccagcttcctattttatagttgaggggactgaggctgtaggagggaatgacaaggtcacagccctacaatcaggggcagaacagggagaatacagagcctctgctaactagtgctgtcacttaccctttattgtaaggatcattggccaagggcatttttatgattggtttttgagctgaatctacttaatacaggtggtggtccatcttggactcttttgtgttgcctcacacatgctctctgtacagagggagagccaaacacactttaaagtgactggtcgttgagaagtgccttgtagatcacagttcctggcctttggaccacactcagctcagtctcctttgggtgccattccctcctccactgtctctcagtcagtgcggccgtacctgtgccgagactcagtggagcgagagggaccttgtcagggaaggatgcaagggtgtcccgaaatgaaaatggttgggaaccccctcaaagcattctttagtgggtctgtgctctgcgttcctgctgttgacatctgctcctttgcagctgccgcagaggtgctgtgctcctgaattgtcaagaatcctggctggacaccagttatcctctgcctccttaaaatcatggcaggaggaccagggagtcagcattcgtgttaggaaccctgaaaggggagggtcttaagaggttgctgccacttaggaaggttgcgttgtgctttgcttccctgagtgctagaaaagctcgcctttctgtcatgctgaactgtaacgccaatgaaaacctcagagtgctctgccaatgtttaaatgaccaaattgaaggcatcagggccactttcaggggttcctatgtttcctcctcctgattaggatttgccaggctcccctcctccttcatcctattacttaatacatctgcgccctgctactgtcttgttctgttctaaaggtaaaccctcagtagggcttactcaggggaggctgtagtgagaggtgacagccctcacagccctcgcttgctgtccacgcctcctctgcctgggctcccactttggcagcacttgaggagcccttcagcccgtctctgcactctgggagcccctttctgagctggccaaggccggagccggctccctcagcttgaagggaggtgtggagggagaggcgcgagtggcaaccgaggatgcgcgaggcgcttgcgggccagctggagttccgggtgggtgtgggcttggcaggccctgcactcggagcggccggctggccctgccggcctcaggcaatgagaggcttagcacccgggccagcagctgcggagggtgtgctgggtcctccagcagtgccagcccactggcgctgcgctggatttctggctgggccttagctgcctccctgcggggcagggctcgggacctgccgcccgccatggctgagcttccccgccccctccacgggctcctgtgcggcgggagcctccctaatgagcgccgccccctgctccaaggcccccagtcccgtcaaccatgcaagggctgaggagtgcaggcgcagggcgtgggactggtgggcagctccatctgcagccccagtgcggatccactggatgaagccagctgggctcctcagtctggtggggacgtggagaacctttatgtctaactcagggattgtaaatacaccaatgggcactctgtatctagctcaaggtttgtaaacacaccaaccagcatcctgtgtctagctcaggttttgtgaatgcaccaatccacactctgtatctagctaatctggtggggacgtggagaacctttgtgtctagctcagggattgtaaacacaccaatcagcgccctgacaaaacagaccactcactctaccaatcagcaggatatgggtggggccagataagagaataaaagcaggctgccggagccagcagtggcaaacccttctggctccttttctttgggagggtgatttgttgtttcgctctttgcaatagattctgttgctgctcggtctttaggcccacactgcttttatgagctgtgctatttgccgggaaggtctatagcttcatttttgagctagcgcagaccccaaccccaccagaaggaaaaagcctcagccgcgccaccttatagagctgttacactcacagtgagagtctatggcttcattcttgaagtcagtgagaccaagaacccaccagttccgaacacagtagcagttccttagttaataggcaatgaagaatcccactgcacagtgatccatgaacaaaatggggaatgataactttttttcccacgtttttacttttttgacagctaatcattcagcgtctatcatgtgctgtgcactttggatcaacatagaaccagccctgggcctgttccagcatagcccacaaagacaggcagcttcagtacctctgtctcctgtgcctgtcctggaaatgtgctgtcattcggtgattagtctggcagaatatgtactctggaaatctaatgtgcagcagcatggtgcgggtggagttttagacgacttccataacacggggacttctttccttgaagctgtctagtgtaggagcttcagtctgttctgaggctttttcctgatgtataagcacagggagtgtcagagtgtggagagcttcaagtacagaccagacacctgagggggtatcatagaggagtcatagcattaagtacaagattaggtaacttgctttctaagatactgcccaatttttttttttttttttttttttttttttttttttttgtgagacggagtctccctctgttgcccaggttggagtgcagtggcatgatctcggctcactgcaacctccacctccggggttcaagcgatttccggctaatttttgtatttttagtagaaatggggttttatcatgttggccaggctggtcttgaactcctgatctcaagtgattcacctgcctcagcctcccaaagtgctaggattacagggctgagccactgtgcctggcagaatactccccaatcttaatgtttctgtgattctaagagagttagatctgaggaaggtggtcgtagttagccattaaaagccattcagcatggtccagtatatgggacactagccttcagtaggctgcatttgtttctcgcagtgtcccatggccctttctccctgcatggaagccttctccctttttccaggaggagacaggcgagagaggtccagcctttctcttgactatagctgggcggggagggaggtgaactgggcaagcactgggattttttgagagccttttcccctgagctgttttctctgctactcgctttcatccccaccgttggcatttaggagctggagcagattttgtcatgctgggaggaatgttttcgggtcatacggagtgtgctggagaagtgtttgagaggaacggacggaagctcaagctcttctacgggatgagctctgacaccgccatgaacaagcacgcaggaggagttgctgagtacaggtgaggaggtgaccccggggcgcaccctcgaggcctggccttgcttttcttacggagatgggatggaagcaggtctgaatagcagctctgtgtatattaaagtaccgtgggaaggggttctttttaaagacccctaatttgtatccagttagcatttgcagtgtttggggttcccaaaagcaagtacagagcagcagtgtttggtgatgggttggaagtgtgaccagggttatatgtgagtgggtgccagtcctgaagggaatacttcagacctctgggggtaggtggaattattgtcttgtccttccagtagagcctgtgctgagctatccctgtaagcttagatctctggcttgagaagagttcaggctgaaaggattgagttgaagaatggctctcctcttgcacagaaagccataggtgtggtctagaccactgcacggtggccaggcctttcctgaagaatgctgcatacagctcataccgcttctcaccttcctccaggctccgagagccgacacagcagcattttcagccattcagttgtgtcatccactgtagaagtggggcttacttctgctgatgtgtgtttattttttattttttatttttatttttttgtggtggagtcgtgctctgtcgcccaggctggagtgcagtggtgtgatgtcagctcactgtaacctctgcctcccgggttcaagtgattatcctgcctcagcctcccgaataactgggattacaggtaccccccatcatgtccagctattttttgtatttttagtaaagatggggtttcgtcatgttggccaggctggtctcgaactcctgacttccagtgatccacccacctcgacctcccaaagtgctgggattataggcatgagccaccgcacctggctcctgatgcatgtttttaatccatggtctccaaagacacctgggtcttttcctgattcccttccattttaactgtctgcatgtgtgttttaagaacctgatgatggggccaggcacagtggctcatgcttgtaatcccagtgcttccagcagccaaggttggaggactgcttgagaccgggagttccagatgagcctaggcaacatagcaagaccctgtctctacaaaaaaattaaaaattagctgggtgtggtgtcacatgactgtactcccagcagctcaggaggctgaggcaggaagatggcttaagcccaggagttggaggctgcagtgagctatgatcgtgccactgtgctccagcctgggcaacagagtgataccctgccaaaaaaaaaaaaaaagaacctgatgacagtatactcgctgcctcaccctgctccatagagcctactgttactctcatcagggttagcgccgatgacaagctatacaaaatgggtacaggagcaaaggttctccatctgcagagggaagttgcctgtgaatcggctggttgcctttttccaggaaagttcaggcttctccctccaattttcagactctatccggtgctggagtggaaacctaagccctccctgactgacaccctttatttcctaccactcattccacacccagagggtcattttgaggacctgggattcagatgtattatataaggttcataccaagctagcagcaaaatctcagaactccactgagatttgtaggtggggggattggggggagtggggtgtattctaccagagttctattcatccgtggggttctagcggacttacttcagttctcattctcctcaagtctctttctcttggtggtgaaccccaataaagatattatagtatgggaaaagcaggatgggaaagatcgatggggactgcaccaatcagaaatgagggattcactccttccaggtagcccccgaggccctctttcccccaagcggtccctgatagaggaggaggttgcatggttgggtaaggaggaggcactaagctggacctatgttcaagaagcttcgtgctttaccagcaactgttgtcatcatccaagggcctgcacatgtgtcctctgtgccagaatgtaagtggagctttcatgggtgagcagcagctaggtgctttgcctggagtacctttttcaccctcgtggctgcatctgttttgggttcttaaaaaaattatagaatcaagaagaccagagcaggctatggcacaaacagaaaccaaagagctgaaagaaaaaacgtcttctgtaatttcagcagggtttaggtataatagaaaaaaaaagattcagcagtagcaagactcagttctgaaagtggattcaaatctttaacagggaaggaaattgctgaggaaattagaaccttaatccaaaggcttcagcctgagccttgcggctgcacctgtcttacctctgtctgagtctctctctctctctctctctcttagttttcagcccgtgaccatgatcttgtcatgagaatgcttcccgactttgacaaattacttatggcacagttatgtacacattgctggttctttcccaatcattatttcattctcacgctgtgcccgggaggcaaagtaccttcattttacggatgagcagacttaagcatcagcaaaaaaggaatttgtaaaaggcgacaccaccacttagcagagaagcaacagtgagaatctagaaatttccaagaagccccaggaaggccatggaaatatcttacgaaaatgaaatgtcagtaattgcaggcacaagtgtacagacgcctgtctggggtcacggagtgctgagccctgaaccatcctgggtatggccaatgactggcttcctgagcttggggctctaaaccggctgatggtttaagtagctggattttacccaagggtagtcctgcctgttcagcaaccaagagttaagccccttttgaaattctagataatgaatgtctggtcaagagatgctcttcaaggcaggtggatcacctaaggccaggagttcgagaccagcctggccaacatggtgaaaccccatctctactaaaaatactaaaattagctgggagtggtggcaggcacctgtaatcccagctactcaggaggctgaggcaggagaattgcttgaacccaggaggcagaggttgcagtgagctgagattgcaccattgcactccagtctgggtgacaaaggcaaaactccatctcaaaaaaagatgctctttttccagctgaaaagaacagctacagaaagttccagaatttgggtacttgttagaacttgcatggcccttagatgagagctagagttttgcctagatttcagatttccttctggtaatacacacatctggtaatatacacatgtgtaatatacacatattctggtaatatatacatgtgtctggaccacatccccattttgcagtgaggggacatgacctgtgttacccaagtaacaatcaagcagtgttacctggtggctttgtgaagagagggacatgggctcagtggggacagtgaaatgttgcttagtgttcatgccataggccagacttgagtttctaaatactcctctgaaaatgtgaacgttgctatccaaagcctggaagcctctggtgctaagacaggtcttggttctcctctgattccaccttgcttggacccacacatgtgcagggtgataggtgtagtgacctgtaagagaacagggagtcgaactgggggtggccagtgtacccagcaaagcagaaagacaggcaggctatcaaaacagagccacttcaatgaaatcaccttgctggtgatttccacgtaagctggtaggacctgcgctatccattttatgtcctcctcgtcctggtcgtcccccttgaagacacttgatttctgatcttagaccagacaggcgggaggtgaagctctggacttttcctgttgttgacgtaggaggacaggaggctgtttccaggggggaatcggccagggccattctgggggcattttgggctcctggttgttgggaagttggtgtgcatgttgaggtagaatagaaaggtaaaggtggtttctgttagcagcagaggggagcacgttgctggagagaatggcaccaagcagggtgttatgggtccctgactccttcaagcgctgctcaccaggactttcctctccgcaacatgcagggcagccagcaatgagcccgtgccctttgggcgggaggaatgtgttcatctgagatgctggtgatcatcttggcacttggtagaaatgtggggatggggtcagagggtggggtctggttttctgagtgccttgggggctacagaaagtgctggagctgggagtaattctaattgggctcttaaggtggggcgggaaactagataaaaagaaaacttctatcgtcttccagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttctcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaatggagttgctggagtttgtatttccaggagtcaagttgaatggtttgggatttgttttgctaccttcctagacaggctgatggcaagcctctcccggcgattagcagacaagtcaccttaggaggggcaaggagaggaggacagtgcgggggccaagggtggacaggccggagtcaaagtaactggcatccctcacctctagcttttggttgctgcaaaagaacaaaagcaattaactggacagatgaacatgaattgttttcccagctgatactcacaaagttgagccaatgtgttttccccgagtttcattacatgtgcttttcagggacaagtcatctgtcgctaccagtttgctgttgcctctaggaagctgtccctgtcctggcttctcatttcgttttgttttcctccatcttttttttcccccttctcagtcccaacttgtcttaatttgaaattccacaggatgttttatgggaaggttgtctcccaagaaattagcaggtggagtcacactgaaaaagagccaaagctttgatcagtggcatcctaaaaggcattggtttgagacatgagttagagccattccctcagtgtgccagtgaatcctttctcggaaggaccacatggcactactgtataagggtcagttaacgggttgggaacaatgacattgtcttggagaattggcctctgcagctgacctgcagcagtccaccaggatgcttgtttaaacagtgaacgcagaagaagtgatgaccggccgctaaactttgaagtattgagttccaggcctggaaagcgtatgcagatcaggttgttttactttgctttttaataaggctgaagagcagatacacaagtcagttttctttggaaaggcaagcaatgaccctggagtagagaagatccacagggtgctgctgtgccagggtgaatgaatggcctgattgtccacagtgaccgatggcatgagaagggtccaaccagagctgtcacactctgggataatacaggcccactgttggtcctttaagattatgtttagagatccagccagcagcattgtctccattgtaatactttcccctactaaatccattaagagttttttttttttttttttttttttttttttaatttgagacagggtctctgttgcccaggctggagtgcagtggcaggatcacagctcaccacagccttgacctcccgggctcaggtgatcctctgacctcagtctcccaagtagctgggactacagacacctgctaccacgcccagctaatttttgtattttttatagagacagggtctcaccatgttgcccagactggtctcaaactccagggctcaagccatccacctgcgtcaacctccccaaagtgctaggattacaggtgtgagccactgtgcccggcccattaagaataactcttgcacctgtagaaacacaagggctgcactttggagacgggagggccaagaggcgatttaacgtggagcaagacatggggcttggctgcaggctccccgccttgctctctgtggtcttccagctgcttgtaactgagtagttacaaaatcaaaaactcgttaggaccattttgaagcagagccttcagaaagagaatgtcttttttttttttttttttcctgagaccaagtcttgctctgtcacccaggcagagtgcagtggcacaatctcggctcactgcaacctccgcctcccaggttcaagtgattctcgtgcctcagccttcagagtagccgggattacaggtgcccgccacgtctggctaatgtttatgtttttagtagagatgggtttttgccatgttacccaggctggtctcaaactcctgggctcgggtgatccacccacctcagcctcccaaagtgctgggattacaggtgtgagccaccgcgcctggcccataaagagaacttgtaaggctccgtcaccgtttgccttagcaggttcatct

SEQ ID NO: 12639 - DNA, 37802 bp, Human
  misc_feature (1)...(37802): n = A,T,C or G
gaggaggtcccagttttctggtgggggtgggcgtggagtagggggcggggaagggatgagggccttaggttctgcactgaagagggctggaggccccagagggccccgtacaaatgccgctctgcaattaagagctctgggcgtgaaatttgatttaaagtaaatacatcaggttccagagagcggagcttcgttggagctaaaactgaaaaaatataatcaaagccatacttttcgggagttaaagaaatcaagtgttcagtatttgaaggttcacggcttctattccccttggtgctgcaaatgacagagagagagagaaaggagagagagaaagaaaagagaagagagagagagagagaagacagaaagacagagacagagaagagagagaaaagacagagagaagagagaggacagagagaaagagagagagagaaagacagagagagagagagaagacagagagagaaagaaaagagaagagagagagaaagaagacagaaagacagagagagagaagagagaaagagagaggagagaagagagagaggagagagagaagacagacagagaagagagagaaaagagagagagaagagagagaagagagaggacagagagaaagagagagaggagagagagaaagacagagacagaagagagagaaagagagaagacagagagaaagagagagaggagagagagaaagacagagagagagaagatagagagagagaagacagagagaagacagagagagagagagaaagacagagagagagaagagagagaaagacagagagagagaagacagggagagagaaagagagcgagaagagagagagaaagacagggagagagagaagacagagagagagagaaagagagagaagacagagagaggagagagagaagacagaaagacacagagagagagaagacagagagagagaaaaagtcagagagagaagacagagagagagaaaaagacagacagagaagacagagagagagaaaaagacagagagaagacagagagaaagagagagaagagagagagaagacagagacagaaagcgagagaaagacagagagagaaagtcagagagaagagagagagagagcaaatgacttattccttaaaacgtacctaattcacatagaaaaagccagattatttgataaagtgggccagtctcagagttccttcctcttcgcagccatcctaagcgcgttcctcgagtttccccccagcaggtgcgttctagaaagcgctggtcaggacgcatggctgccccatagatttcttggggacgggagtgagagacgcctggacgcccaagcgcaagcctccagcctccaaggtcctacaacagatacagcagctactgagtctcctctctggtttcttttccgcccctggggagagaaaagagaaggggagaaacgtcaccaccagcaactgctcccagccagcaagacgcacggcggggaggccggggctggccgcgtcctgcagctcctgagctgcgtgtctgagcttttcccagccccgcctgcgtctccaggggcgaaataagaagcaaatcttgctgggaccgagttcaggtcgaggaactccgggaccctctgcagcctcagccctgccgcgctccccgcagcttcgggcctgttgcggggagttggggaggaattcagggaaggggggaaccaggccgggataagaggctccggcttgctgtgggctgcatgacggggtgcaaaggcgaggagaagcccctgggatccttggctcgtctgctgcgggacccccagccccggcgggcggaccgcggagagcgctgtcccggatccggagattcgcttttcctttgcgactgcggggctggcgcgcgcgcgcgaggggtcagcaccctgggcattggggtcaatgcaaccagggcaggtccctggggggcccccaggagccaataggggtcttcgagtcaccctgcggccgcctgcttttgcccgggtcctgagaacaggggctccccacactttgttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggtgagctcggttttggaactttccttttcttttccagaaagctttgccttctttcctttcttcgttcgttccttccttccttcctctcttcctctttcttttctttctttctttctttctttctttctttctttctttcttttctttcttcctttcacttggcaagattggttttggagctttccttttcttttccagaaagctttgccttctttccttccttcgttctttccttccttccttcctctcttcctctttctttcttttctttctttctttctttctttctttctttctttctttcttcctttctttctttctttctttcttttctttctttcacttggcaagattgcttttggagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtctctctctctcctctactactactttctctgtctctgtctgtatctctatctctgtctctctttctctctgtctttgttcctctcttttttctctttctctgtatctctgtctatctctgtctctctttctctctctcctctctctctgtctctttttctctgtctctctctgtgtctctacctctgtctctctctctcctctctttttctctgtctctgtctgtatctctgtctatctctgtctctctctctcctctctctctttctctgtctctgtctgtatctctatctctgtctctctttctctctgtcttcgttcctctctctctttttctctttctctgtatctctgtctatctctgtctctctttctctctctcctctctctctgtctctttttctctgtctctctctgtgtctctacctctgtctctctttctctcctctctttctctgtctctgtctgtctctgtctctctctctcctctctctgtatctctgtctctgtctctttctctcctctactctgtatctctgtctctgtctctctttctctcctctctctctttttctctgtctctgtatctctgtctatctctgtctctctttctctctctcctctctctctgtctctttttctctgtctctctctgtgtctctacctctgtctctctttctctcctctctttttctctgtctctgtctgtatctctgtctgtctctgtctctctttctctcctctctctgtatctctgtctctgtctctctttctctcctctctctgtatctctgactctgtctctctttctctcctctctctctttttctctgtctctgtatctctgtctatctctgtctctctttctctctctcatctctctctgtctctttttctctgtctctctctgtgtctctacctctgtctctctttctctcctctctttttctctgtctctgtatctctatctctgtctctctttctctctctcctctctctctttttctgtctctgtctctctgtctgtctctgtctctctttgtctctctcctctctgtctctttttctctgtctctctctgtgtctctacctgtgtctctctttcctctctctttttctctctctgtctgtatctctgtctacctctgtctctctctctctcctctctctctgtctctttttctctgtctttctgtctctctatctctgtgactctttccctctctcctctctctctctttttctctctctccctgtctcagggaagcatcagtaaaacctccaacaagcacccccttgtacacagcccaggccaagagaggtgcagaccctgctttctgcctgcagccgcctgctgtaaaatgtcaatgcaaaacatttcatacagtccacccactctgcagactggagctgcggcctctcggacagcgtcttgaatttgcaacgaaaaacgtgtggggtagaaaaagctctcgtctggatttctaacatgttatcaagcactcaaacgctgggtgtttcctgcctgtctttaaagggaagggcagggagagaacgtaaaagctctggtcagagaagggaaaggtctttaggtgagaggggtgaggccgcctccgtgctcatcccacaggaagagttggagttttacagaaagatgagatctctttcgcgtagccagaaactcttaggaaaagcggggtgttggaaaggcagaaagtgtgccatgaatcggacgtgcgtgatttcaaagccacttgtctgcagtgagaattacaattggggcttcagttgaaaaagggcctttgctttttctccgaggccgaggggccttgaatagccacacagctcctgactggtgtccccatgctcattcctggaggctcggacaccctggtagagcggagtttcctactagacaaaggggtccagattgcggcccaagaaggaacctcaggtcggggaaagcctgggcctcacgggaccccccaggaaagcctggtccttggggttggagaagacagctgagctgggaggacggagggttttcggtagggagacagtgagcagctgtgagaggtttacggcgcagtccctggggacccagtttcccagcagaggcagagatggggaggcctttagaagcagaaaagttacccggcctctgaggacccagaaagttgctctaagccagagacccttctccgaatctccctctctgtctgtctctgcctctctccctctttctcttccccctccctgtctccctctctgtgtctctgcctctctttgtctctgtgtcccctgtctctctgcctctctttgtctctctctgtatctctatctgtgtctctctttttctctctccatctctctgtctctccgtttctctctttctctctccctctctctccctgtccgtgtcgctctttctctctctccatctcccagtctctccctttctctctctctccatctctccctgtctctctttctctgtctccatctctttctctgtctctccttgtctctctctttctctctctccatctctctctgtctctccctgtctgtttctctctctccatctgtctgtctctccctttctctctctctgtctctccctctctctccctgtctgtgtctctctttctctctctccatctctctctgtctctccctgtgtttctctctctccatctctctctgtctctccctgtctgtttctctctctccatctgtctgtctctctctttctctctctatctctccctctctctccctgtctgtgtctctctttctctctctccatctctctctgtctctccctgtctgtttctctctctccatctctctgtgtctccctttgtctctctctatctctccctctctctccctgtctgtgtctctctttctctctctccatctctctctgtctctccctgtgtttctctctctccatctctctccgtctatccctgtctgtctctttctctgtctccatctctctctgtctctccttgactctctttctctctgtctccatgtctcatgtctatccctgtctgtgactctctttctctctctccatctctctccgtctttccccctctgtctctttctctgtctccatccctctgtctctccctttctctctgtctttccttgtctctctctttctctctctctctccatctctctctctccctgtcatctctctctccatctccccgtctctccgtttctctctctgcctctccctgtctgtctctctctttctgtgtcttacacacaccccaacccaccgtcactcatgtccccccactgctgtgccatctcacacaagttcacagctcagctgtcatcctgggtcccccaggccccgccggggaggaagatgcgccgtggggttacgggaggaaggggactccgggcctcctggtgccccactttatttgcagaaggtccttggcaggaaccgtgacgcgtttggtttccaggacttggaaaacgaatttcaggtcgcgatggcgagcaccggcttcccctgaagcacattcaatagcgagaggcgggagggagcgagcaggagcatcccaccatgaaaaccaaaaacacaagtatttttttcacccggtaaataccccagacgccagggtgacagcgcggcgctaagggaggaggcctcgcgccggggtccgccgggatctggcgcgggcggaaagaatatagatctttacgaaccggatctcccggggacctgggcttctttctgcgggcgctggagacccgggaggcggccccggggatcctcggcctccgccgccgccgcctcccaagcgcccgcgtcccggtttggggacacccggccccttcttctcactttcggggattctccagccgcgttccatctcaccaactctccatccaagggcgcgccgccaccaacttggagctcatcttctcccaagatcgtgcgtccccggggcgcccgggtcccccccctcgccatctcaaccccggcgcgacccgggcgcttcctggaaagatccaggcgccgggctctgcgctcctcccgggagcgagggcggccggacgactgggaccctcctctctccagccgtgaactccttgtctctctgtctctctctgcaggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaaggtaagttcctttgcgcgccggctccaggggggccctcctggggttcggcgcctcctcgccacggagtcggccccgcgcgcccctcgctgtgcacatttgcagctcccgtctcgccagggtaaggcccgggccgtcaggctttgcctaagaaaggaaggaaggcaggagtggacccgaccggagacgcgggtggtgggtagcggggtgcggggggacccagggagggtcgcagcgggggccgcgcgcgtgggcaccgacacgggaaggtcccgggctggggtggatccgggtggctgtgcctgaagccgtagggcctgagatgtctttttcattttctttttctttcctttcctttttttgtttgtttgtttgtttgagacagagtctcgctctgtcccccaggctggagtgcagtggtgcgatctcggctcactgcaacctctgcctcctgggttcaagcgattctcctgcctcagcctccccagtagctgggattacaggcatgcaccaccacgcctggctaatttttgtgcttttagtaaagacggggattcaccatgttggccaggctggtctcgaactcctgacctcaggtgatccacccgcctcggcctcccaaagtgctgggatgacaggcgtgaggcaccgcgcccggcctgggtcctgacggcttaggatgtgtgtttctgtctctgcctgtctgccttgtatttacggtcacccagacgcacagaggagccgtctccacgcgccttcccagcgctcagcgcctgccgggcccccggagatcacgggaagactcgaggctgcgtggtaggagacgggaaggccccgggtcagctcggttctgtttcctttaaggaacccttcattattatttcattgttttcctttgaacgtcgaggcttgatcttggcgaaagctgttgggtccataaaaaccactcccgtgagcggaggtggccgggatctggatggggcgcgaggggccccggggaagctggcggcttcgcgggcgcgtcctaagtcaaggttgtcagagcgcagccggttgtgcgcggcccgggggagctcccctctggcccttcctcctgagacctcagtggtgggtcgtcccgtggtggaaatcggggagtaagaggctcagagagaagggctggccccggggatctctgtgcacacacgacaactgggcggcatacatcttaagaataaaatgggctggctgtgtcggggcacagctggagacggctatggacgcctgttatgttttcattacaaagacgcagagaatctagcctcggcttttgctgattcgcagagttgaggtgcgagggtgaatgccccaaaggtaattcttcctaagactctggggctacctgctctccggggccctgcatttggggtgtggagtggccccgggaaatagcccttgtattcgtaggaggcaccaggcagcttcccaaggccctgactttgtcgaagcagaaagctgtggctacggtttacaaagcagtccccggtttctgaccgtctaagaggcaggagcccagcctgcctttgacagtgagaggagttcctccctacacactgctgcgggcacccggcactgtaattcatacacagagagttggccttcctggacgcaaggctgggagccgcttgagggcctgcgtgtaatttaagagggttcgcagcgcccggcggccgcttctgtggggttgctttttggttgtccttcgcagacaccgttttgctcctctgaactctctcttctccccctggccgtggacccgggagagcaaagtgtcctccagaccttttgaaagtgagaggaaaataaagaccaggccaaagacccagggccacaggagaggagacagagagtccccgttacattttccccttggctgggtgcagaaagacccccgggccaggactgccacccaggctactatttattcatcagatccaagttaaatcgaggttggagggcaggggagagtctgaggttaccgtggaagcctggagtttttgggaacagcgtgtccccgccgagcctgggagcccgtgggttctgcaaagcctgcgggtgtttgaggactttgaagaccagtttgtcagttgggctcaattcctggggttcagacttagagaaatgaaggagggagagctggggtcgtctccaggaaacgattcacttggggggaaggaatggagtgttcttgcaggcacatgtctgttaggaggtgaaacagaatgtgaaatccacgttggagtaagcgtccagcgctgaatgtagctcggggtggggtgggagggccctggtgtggatcgtggaaggaagaaagacagaacagggtgctagtatttaccccgttccctgtagacaccctggatttgtcagctttgcaagcttcttggttgcagcggccttgcctgtgcccctttgagactgtttccagactaaacttccaaatgtcagccccttacccttgacagcaagggacatctcattagggcatcgcgtgcttctcatctgtgctcagcaggcccgagataggaacagaggggcgttggagatgccacttccaccagccctgggttgaaggggagcgagggagacaccttttacttaaacccctgagcttggtcagagaggctgaatgtctaaaatgaggaagaaaaggtttttcacctggaaacgcttgagggctgagtcttctgcccttctgactcccccagcaaatacagacaggtcaccaactactggagatgagaaagtgccatttttggcacactctggtggggtaggtgcccgaccgcgtgtgaaaaagtgggaaggagagatttctgcgcacgcggttcagcccccaggcgcggtggcgcattcaggtactcagacgcggttctgctgttctgctgagaaacaggcttcgggtaggggctcctagctccgccagatcgcggagggacccccagccctcctgcgctgcagcggtggggatagcgtctctccgtaggcctagaatctgcaacccgccccgggtcctccccgtgtccttcccgggcgtcccgccggggatcccacagttggcagctcttcctcaaattctttcccttaaaaataggatttgacaccccactctccttaaaaaaaaaaaataagaaaaaaaggttaggttatgtcaacagaggtgaagtggataattgaggaaacgattctgagatgaggccaagaaaacaacgctcgtgcaaagcccaggtttttgggaaagcagcgagtatcctcctcggcttttgccttatggaccccacgcagtttttgcgtcaaagcgcattggttttcgagggccccctttccaccgcgggatgcacgaaggggttcgccacgttgcgcaaaacctccccggcctcagccctgtgccctccgctccccacgcagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtaggaacccgggggcgggggcggggggcccggagccatcgcctggtcctcgggagcgcacagcacgcgtacagccacctgcgcccgggccgccgccgtccccttcccggagcgcggggaggttgggtgagggacgggctggggttcctggacttttggagacgcctgaggcctgtaggatgggttcattgcgtttgtttttcaccaacagcaaacaaatatatatacatatatattatacaaataacaaataaatatatatgttatacagatgggtatattgtatatattatagatatttgttcgtccttggtgcaaagacacccggtgaacccatatattggctcctgactgccttcggttcccctgggattggttataggggcaacacatgcaaacaaaactttccctggattatacttaggagacgaagctacagatgcgtttgatccagagtgttttacaagatttttcatttaaaaaaaaatgtgtcttttggcccctgattcccctccgtcttcccgtgtggctgcattgaaaaggtttccttaggatgaaaggagaggggtgtcctctgtccctaggtggagagaaacagggtcttctctttcctccgttttttcacctaccgtttctatctccctcctcccctctccagccctgtcctctgctacaaaccaccccctcctccctccggctgtggggagcgcaggagcacgttgggcatctggatgagcggagactattagcggggcacgggggctccccgaggagcgcgcgaattcacgctgccccatgagaccaggcaccggggggcggaggggccttgggtgtccgcagagggacgggcgggcagagccttcctccgcattctaaacattcacttaaaggtatgagtttatttcaggggtgctgctgggagagcctccaaatggcttcttccagcccctgcctgacagttcagctcccctggaaggtcaactcctctagtcctttctcctggttctgggcaggacagaagtggggggagggagagagagagagagagagagagagacggtcaggatccccggaccctggggaccccgtcaaaaataaatgaaattaagattgccgaccagagagagaaccgtgacaaagcaaacggcgttcaaagcaaagagacgaactgaaagcccgttcccgtaggactggttatgaggtcaacacattcaaacacagcttgctctggattttgctgagcagaggaagatacagatgcatttgatccaaagtgtgttacatctttcattatatgtgtgtctatatatataaacatatataaatatataaacatacataaatgtatgtaaatatatataatctatatacatatataaatatataaacacatatataatatataaatctataaacatatataatatataaacataaatatataaacatatataatatataaatatattaacatatataaaatatgtataaatatatataaacatataaacatatataaatatataaacatataaatatataaacatatataaatatatacaaacatattgtatatatataaatatatataaaaacatatatatacatataaaaatatatataaacatatatacatataaagaaatatatataaacatatatacatataaatatacatatataaacatatatatacataaaatatatataaacatatatacatataaaaatatatatatattaacatatatatacatataaaaatatatatattaacatatatatacatataaaaatatatatatatttttggcccctgattcccttcggttcctgtgggatgggtgattgagtcaacacattcaaacacaacttttccatcgatgttgcttaggagatgaggatacagatgcgtttgatggagagggttttacaagctctttcatttaaatatatatatatatatatatatattttttggctcctgattctcttccgtcttcccatgtggctgcattttaaaaggcttccctaagatcgttacgattaaatcaaccctccccaggcatctttaccgagggctgtggtccccaaagcgatacagcccaggagggagagaggctttggtgacttggaggaaggactgtgtccctccttagggcgtctgtggcctcagtgagggaaggaagctgcatcagacaggggtttcctcgctgtccacccctctggcagaagatggattgggctgccccgtataaattaatgaaaagattaaagtttcgctaaaggggacatcgagtttatgtgtcatctcctggtgtctgtgtgcctgggatctgcaatatatcccagcccttgatgtactgtttctataaaaataaattacttgtaatttaattccacactatttctttccgtagtctattaccgacgagagcacgttagttcagctgcggaaaattggttgtggggtgtgtgcggaccccgagaacgccctaaaataaagacaaatcggggacaagctgggggttatcgattgcaggggtcgcatgaaaatttaacgacggtaaataataataaaaacaaacatgggaatgcaataaaagacataattctccatcgccgcggggggaaaggatcctatagtaaaggcgagtgcgctttgaggggtcataaaaatcaattagttccaacacccacgtcccgcgttgaggggacggggacgagcagggacagaaaaagaaaccatatttgaatcccatctctctgtgaattcttgggtcacatgcgtctcagtacagcccgtcccgtgctgtgaccggatagagtttcaatttactgtggaaatttgctgtaaataaattgagcatccgatagaagctgttgctgattaaccttttatttttagcgtggccctgcaaagtcgtatcacccagctgtcaggcttctaatcgaaagttatgagaccacggtgaggggcaggcggtaatttaattacaacaaatatctttgggtttatggcgcagagctaaattaaatgtcattattcactgtctgtaatggaaatcaaaaggaaatcgcattacggcatttgggaaagaaagcggggagtgctctttaatgaagaaataactgtcttaagcagtgtcacacacttcacttaccatattcgggcctaattggaatggatcgtgaatcactccaagactgatttattagcgcttcacgcagcggctaattcatcacttgtattcttcatcatttttttttttcctctcgccgtgttgaagggagagtgaatgaggctttccacgtttcaggaggattttcttttttgaaaaatgcccttccagaggcttttgggtggctggcttgctttctgggccctggaggagacaggcggagagtccaggtgggcatggagaggcacagtggcaggtcacctggatggtcagtggaggtggaggtctgaaggcgccagctttggaaattattggtgaatttcgatgtcagcaccaggcaggggcctttttggcgggggtgtgagggaggatgactttgctgggaaacaggatcaggttctccaggcgcactgcagcccggtaggacccactttggaaatgaaaagccagttccgaaagctgggctggaagcttccgtgttgggttcaagagcaagttcacgttgcgctgtgtagactcctggctgctcccaaactctgagggttttctgaggttcccttcataggggcaccggccctgggccatgcacagtgcgtaagggtggctgtgggccgagggacccagcacgtgttttgcccacaacagccggagtgactggttcactcaccgccttggcggaggacgcctgttctctggacgaatcatttctcttgggtggtgactgccttgtgggtcaaggtgcaggttttctgccacagaaaacctgttaggaggaattaagcgactaagactgtcagggaggtggtggtgggggagaggagggggtggtgtccagattaccaggcataggctaaactgcctgcactctccagctggtctgtctgtggaggaggggattgtcaatactgggagagcagaggaggctcgtaggaggtgagagggggtggaatttgcatgcaaatcttcacatgaggcctgtgtgaatttctccagcctcctgagggtcccctgcgctattgcactcaacttcttgatagtttaccccaagactcagaagtccttagaggggcagaatgcccccaccacaaagcctgctatccttgggcgtcctcaggacccttggtcatgaatgggaccctttcatgtatggggacccttggtaatatgaatgggacgccttcagctccccagggcttccgaggaggccgagaagggcaaagacacttccgaggaggccgagaagggcaaagacattttctgggcttggtgtgtcaagagctagattggagaaggggctggatttggaactctttagccatcagctcaccctctccgtttgtggctaaagtctgaaggtggaaacttcggttctcctacagggtctacaggagttggggggcggggcgcccacacagaacgctggaaagttcgacagtccacttccactggctcggaactcactttttcaccttaagttcatcagcggtaacgcataggtctcacttaggcagggcacggatgatttaacaatttctacttctaggtcaggtgcggtggctcacacctctaatcccagcactttgggaggcccaggagggtggatcgcttgaggtcaggagtttgagaccagcctggccaacatggtgaaaccccgtctctactaaaatacgaaaattagccaggcatggtggtgagcacctgtaattccagctactcgggaggctgaggcaggagaatcgcttgaacctgggaggtggacgttgcagtgaggtgagatcacaccactgcactccagcctggatgagagagcaagactctgtctcaaaaacaaaataaaacaaaaacaaaacaaaaatcaaaaaagaaaacccaatttccagttctaggccaggtgcagtggctcacgcctgtcatcccagcactttgggaggcccaggagggtggatcgcttgaggtcaggagttcgagaccagcctggccaacatggtgaaaccccatctctactaaaaatacaaacgttagctgggtgtggtggtgtgcgcctgtaatcccagctactcgggaagctgaggctggagaattgcttgaatctgggaggtggaggttgcagggaggcgagatagtgccactgcagtccagcctggaccagagagcaagactccgtctcaaaaacaaaagaaagcaaaaacaaaaaacaagagaccagcctggccaacatggtgaaaccgcgtctctactaaaatacaaaattagccgggcatggtggtgggcacctgtagtcccagctactcgggaggctgaggcaggagaatggcttgaacctgggaggtggagcttgcagtgagccgagatagtgccactgcactccagcctgggcgacagagcgagacttgatttcagaaccaccaccaccacaacaaaacaaaacaaaaaatccaaaaaaaccccaatttccagtactaggtagtcagtgatgcagggctggagacagaggggcggtaagtgtctgggcgcccaccatcagtcacctcccagctcccagaggtgcaaagtgcttggttcagcctcatgggaaggatgctccctggggaggctgggctgggttcacagggctcttcacatctctctctgcttctccccaaggtttggttccagaaccggagagccaagtgccgcaaacaagagaatcagatgcataaaggtgggtgtcgggactggggggacctgaagctgggggatcctgctccaggagggatggggtcgacgaggtgctggctacacccaggaccaccacactgacacctgctccctttggacacaggcgtcatcttgggcacagccaaccacctagacgcctgccgagtggcaccctacgtcaacatgggagccttacggatgcctttccaacaggtagctcactttttcttcctctgaagatccctagggacctgctgctcccttcccctttcccctatttgctgccgcatcctgacactcctagtccctccctgcccctgcagacttctcagctggcccttagaaaaaaagcctcttttccgaggaggcatttacaggcaccttggcacctatgaaatcaggctgggccaggcggggtggctcacacctgtcatcccagcactttgggaggctgaggagggtgcatcacctgagatcaggagttcaagaccagcctggccaacttaacgaaaccctgtctattaaaaatacaaaatgggtgtggtggctcacgcctgtcatcccagcactttgggaggccgaggcaggtggatcacctgaggtcaggaattcgagaccagcctgaccaacatgctgaaaccccgtctctactgaaaacacaaagcttagccgggcgtggtggtgcacacctgtgatcccaggtacttgggagggagaatcacttgaacctgggaggtggaggttgccgtgagccaatatcgcgccactgcactccactctgggtgacagagtgagactccaagactccatctcaaaaaaaaaaaaaaaaaaatcaggctgtaaaaatccacttttgggaaggtgaacacacacaagcccaaacagaaatctgacaaaaaccagaggggtgaaaagtccacacagtcaggcacccccacctggcttgctgcctggttaagaagggcgcagatgcctgtgcctggataccagagatgggacagacacccattcccttttcatcaccacccccgagtgcccgagggcctggggcgtctgcctggcccctggcccctggcttgggctctgcacctctgagctggagacaccctactcagctccccacttactttggagtgagcagcgcttgggtgcccagcgtggatttggggcttccagggagtcggggttcggtcgcggagcccaagcttcccaagggcgcccccgccctgccctggcttagtggtggggatgggatggggggaagcggggagctgcgtggaaggaggtgaagggtcacaggaggagagagcgcagcgcccacgtgcgccctgcctgaacgcgcagcgcagcgcccggctgcggtgccccttgccccttcggtccctaatttgggggtcgggagtgcatgcgcgggcggaacgggcttggggggggggctctggcagggcggacgcgtggcctcccttcttcaccgttttattccaaggggacaggctggggattgtatttgggcgcgtgtttggctgagggtgcagggacttggggggtggcggtggggagcgcggaaggtataaacgtataaatcataagtaaacaactcagaaatggaccccgagcgctggtcgccgctagctctccagctctccctggcccaggcccgaaggagaggggtccgcatccctccgcggttctcctctcctgggtacctggccttgaggtgggggaacgagcctacttcttgtaccgtcttttgccgacggcgggacccagtgaaattaggccgttggagcccgcaggcctgcctggctttgcgcaccggagtcttggggacctggtgtccccgggaaaaacttggggacctggtatccccgggagaggcttggggacctggtgtcccgggagaggcttgggtacctggtttctctggaagaggcttggacacctggtgtcctgggagggcctttgggacctggtgtcctgggagaggcttggagatctgttgtcctgggagaggcttggggacctggtgtccctggagaggcttggggacctggtgaccttggagaggcttggagacctggtgttctgggagaggcttggggacctggtgttctgggagaggcttggggacctggtgtctctggaagaggcttggacacctggtgacccgggagggccttggggatctggtgtcccgggagagccttggggacctggtgtcctgggagaggcttggggacctggtgaccttggagaggcttggggacctggtgtcctgagagagccttggggatctggtgtcccaggagaggcttggggacctggtgtctctggaagaggcttggacacctggtgtcctggggagaggcttggggacctggtgtcctgggagaggcttggggacctggtgtcctgggagaggcttggagatctggtgagccgggagaggcttggggacctggtgtcccgggagaggcttggggacttggtgtcccgggagaggcttggacacctggtgtcccaggagaggcttggggacctggtgaccttggagaggcctggggacctggtgacccgggagagccttggggacctggtgtcctggggagagccttggggacctggtgaccttggagaggcttggggacctggtgtctcgggagtgccttggggacctagtgacccgggagaggcttggggacctggtgtcccgggagaggcttggggacctggtgtcctgggagagccttggggatctggtgtcctggggagaggctgggggacctggtgtctcgggagagagccttggggacctggtgacccgggagaggcttggacacctggtgtcccgggagaggcttggggacctggtgacccgggagagccttggggacctggtgtcctggggagaggctgggggacctggtgtctcgggagagagccttggggacctggtgacccgggagaggcttggacacctggtgtcccgggagaggcttgggagcctggtgtcccgggagagccttggggaccaggtgaccttggagaggcttggggacctggtgatcttggagaggcttggggacctggtgtctcgggagaggttacgggggctggttgggggagagaacgttgtgagccaaagtccctgaatccctgcgaagagagcgcatcgggagctccccctgagggcgttccatttgtggacccccctcccatgcgctttgcagggagctgttcggattcccctggcccggctcccgcggatgcatccagtggcagcgccaattctgggccagggggaaggaggaaaggcgggtgtggggtggtctccacggctggagaaggggcgacgctccctaggggagaagaggcacgttgggggtttccgggggcgcggggcggagcaggccccccagtccccatcctgcgccctcaccccgccgggtccgctcccgcaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggctttaatagttaagctgaaatttttatcgaaaagaagaattgcattttgaatctttgggaagtaggttcattcatcagagtatgtaaccctttggaaaagtggttggtaagatatgtacagccctagatttttttttttttaaccaaaaaggctgagtaattttgaaaaatcgaaacataacagtgtgtcatcatttcctcccaagaaaaagctcactccacgtgagtagaaagacatctacctggtccctgtagaatctgaacgtttctctttagagacggaatttcaatcttgtcccccaggctggagtgcagtggcacaatctcggctcaccgcaacctccgcctcccgggttcaagccattctcctgcctcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtacagacagggtttcggcctcctgagtagctgggattacaggcacctgccaccaggcctgggtaactttctggtagttttagtagagacagggtttcagcctcccgagtagctgggattacaggcacctgccaccaggcctgggtaatttttttgcatttttggtggagacagttttttgccgtgttggcccggctggcctcaaactcctgacctcaggttgacctgcccgctttgtccctcgcaaagtgctgggattacaggcgtgagccaccgcacctggcctgaatctgaacttttaaaagggagttactgactctcaactgtgcggggacggtttcagtttgatttaatatggaaagagggccaagtgtcatcctcacaaatgggtccccgaagcagatcaaacgcagagaactgtgagggtgggacacgagtgtctgtggacactggctgcctttggcttttctcctgcgagagaagttgggtgactttctgtaggtggatgagtgatccctgaatgagtgtggggtacgtgtatgctagctgcttctttctccctgaaactctcggatggaaggaagtaagaaattcagcttgggctgtgaccagttctcaccaccaacgccctcttctctctcccttctccttccttccttccttccttcctttctttctttttctttctttctctctttctttcttttctttctttctgtttctttcctttttatctttctctctttttctttctcttttccttttttgtttctttctttctttttctttctttctttttctttcttctttctttcttcgatgaagtctcactctgtcacccaggctggagtgcagtggtgcaatcccagctcactgcatcctctacctcctggcttcaagaaattctcctgcctcagcctcccaagtagctgggatgacaggcacccaccaccattcccggataatttttgtattttttagtagagactgggtttcgccatgttggccaggctggtcttgaactcctgacctcacatgatccacccgcctcagcctcccagagtgctgggattacggggtgaggcaccgcgcccggcctcctctctctttttctgagatgtttaggaaggactgggctgatggggaccctctgtatgtgatgtgcgtgggtttggtttcccggaaggccctccagagacacgtttgcgtgaacattcagcatggaaacaacatacgtctctccacaggaggtgagaaattgaatttatggggtgggtgtacgctggcgattcttggtgctttttgctcaaaacaaggttcttttgaaagtcacgttcctgctttccctgtggcttcccggtgagctcgctcgcagagcaaggaataccacccagagagcaacgtgggctgtgttccgttgtaacgccgttgcagagagaggatttggtgtgtgagatccgtaccagctccagcacactgataggaacacgttgctggccgaactgaacgatgctgggttgggtcctgattgatacgtattttcttccctcctctccccaaaacttggccaaatagtccgtggagggttgtcagtcgccgcagttgagcaaaaaacacttcttcctttgagtggctgttctggtgaaatctgtttctgacatatccacttttctctctcttttctctctctctgactgcgaagcacccacagggagaaggaattggatgtatcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcctctccatcccgccaaagtccagccaggcccccgaaatggtcccatttccttggaagcctgagtttctgttctggtcttgctgctgtccttggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacattaaaaaaaaaaaaaaaaaaaaaaaaaaaactggtgcctaatttattaaagagaattagcttagcgagtatatgctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtgcatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaaccaaaaaaaaccaccctgagtttctctggtgacgccctcattctcctaacgttcaataatctcaatgttgagttgcagcaacagactgtatttttgtgacgccccgtagtatgaatgtacatcttgtaaaactgagatataaataaacttataaatatttgtattcaagtgttaaaaaaaaaaaaattctcaacctctcccctgaggacaggcttattggaaaaaaaaaaaaaaaaaaaaaatcctgagtcggccgtggctgaacacagagtgttgttctgctccgtgcatttccagggtgggtacccagtgttgccccccagccttagatcgggaggtaccattgacttttgcttgtatcccatccccttcctttactgaaacctacctccccgcttctcagccaacgtccccccagaaggtggcaaaaaaaacagaggaaaaagccctgatttgaatcaagtcagagctgctaattctccactttctttaattaattaatttatttttttttttgagactgagtctcgctctgtcgcccaggccggaggagtgcaggggcgcgatctcggctcaccgcgacctccgcctcccgggttcaagcgactctcctgcctcagcctcccgagtagctgggatgacagtcacctgcaccaccgcgcccggctcatttttgtatttttagtagcaatggggtttcaccgtgttggtcaggctggtctcgaactcctgacctcgtgatccacccgcgtctgggcccggccggtgatgtgtgtgcttttaacttttattttgttccagttttcgacagtggcacggattttccagcacggtcttgcaaggatgattgagtcatttttgagacaaaaaatataataataataaatggaaaaagaaatcgacttttaaaaatgacaaatttttttttttttttttgcatagatttttctctctttatgtaaaggaaagttcatgattggatttggccggcctgactgcttcccggctgtgataaaaaacacatgtgagctgggagggaagtgggggagggacacagctgcccacacagggttcccaccgcggttacagggtgggcagtgctgggggagctttctctgtggggggctcagagcctgaggacaggtgagcctctccgacacctccccagttgcctggagtctaaaccgtccgttgtctgtaccgtccgttcttcctgctgactcctggtagttcctgaaagcttctcttggccagagaaggggtttcagaggccgtgtgtccaggccattctgcaaagtgcaacttgaccgttcctttccttttctggcctgcgtggtctgaagctcagagccctctcttcacccagcctgtgtgtgtcttgccggacagaagaaaaatggtgctttttgcgtgttagcagaggtgcttttcatggctgacctcaacgcgtccatctccagccttgaccaagctgttttttaggggcaaacgcaggcaagttctgaatgcacacagttatttcatggttaaactattcagctttggccgggcgcagtgtggctctcacgcctgtcatcccagcactttgggaggccgaggcgggtggatcacctgaggtcaggagttcgagaccagcctggccaacacggtgaaactctatctctactaaaaatacaaaaattagccgggcgtggtggtgtgtatctgtaatcccagctactcaggaagctgaggcaggagaatcgcttggacccaggaggcggaggttgcactgagccgagatcgcgccattgcactccagcctgggcgacagagccagacgctgtctcaaaaaaatgaataataaaataaaataacaggaactaaataaaataaaacgttcagctttgttctgcaaatccactcctattgttttacgtggtttgagagactctgtcccttagaaatagatgtttgttgccaattgtaatgaatctgtttcaaaaatgaacagaatattcaaatggtttgagagatcttttcccttagaaatagcttgttgccaatcacaaagaatgtttttcaaaaatgaatggaatcttcctggatatcgcttccagatcttcattttttttgcatagttcaacctgaaaagtaagtgtctcagccctgaatttctttctgatttttccatgggttgtcttgcagacttctctggacttgaccacatttaaaaaaaaaaaattaactttttcacacggacacggtttcaataggaatgagatctttgagtttttatgtaacagattcttaccatcagttctcagattcccaaattacacacaaaaagccacggacttcgcctcctgctaacatgtccttctgtttctgaggcttctgttggtgttagactttcatgtttaatagcagacaatgtagggatttaaagaaaaatgcagagaaagcaaaaacactgaccaaacacacggagataagctttctaaagcctttgttcttggagttgtcgttaaaaaaaaaaagttgttttaaactttgcaagcatgcctatattgaactcataagcaagagagccaagaaaaatagtgtcggtcgtctactctacaagttttcccaaaacagacgtattttaatttcttttgtttgaactcacagatgctgagagttaaaagttaaatttttgtcatgaacaataatggccaaaaccacagttacttttgcactatagcataataagaaaaatacaggctgggctcggtggctcacacctgtaatcaaagcacttttggaggcgaaacagccagatcccttgagcccaggagattgagaccagcctgggcaacatagcgagaccctcatctctacaaaaaaggtttgttacatatgtaacaaacctgcacattgtgcacatgtaccctaaaacttaaagtataataataaaaaaattaaaaaaaaattcaccaatcaactgcctgctggtgccttcaagagactcacctaacacataaggacttgcataaacttataaaacaattcaatggaagaatccttgaaagtattctgagaagacagtataataaactgatttctaaaaaggctataaaaaattgaataaatcattgttgggcatcctgtgctgaaatataatgcagccaataaaaattacaaaatgaataaacattttataacaataaaaaaaagtcaaataattaggcaggcatggtggtgctctcctacggttgaagctattcagcaggcaagaggatactttgtttttgttttttaattttttttgagacagagtctcgctctgttgacaggctggagtgcagtggcgtgatctcagctcactgtaatttctgcctcccgggttcaagcgattttcctgccccagcctcccgagtagctgggattacaggtgcccgccaccacacctggctaatttcttttgtatttttagtagagacgaggtttccccatgttggccaggctggttttgagctcccgacctcgggtgatccacccgcctcagcctcccaaagtgctgggatgacaggcgtgagccaccgcgcctggcccaggaggattatttgatcccaggaggtggaggctgcaggaagccatgattgcaccactgcactccagcctggctgacagagtgagaccacatctctaaataaatgaataaatacaggcagaaactttttttgttttgttttgatggagtcttgctctgtcaccaggcaggagtgcagtggtgccatctcagctcactgcaacctccacctcctgggttcaagcaatcctcctgcctcagcctcccgagtagctgggattacaggtgcccgccaccacgcccggctaattttttgtatgtttagtagagacgggatttcaccgtgttagccaggatggtcttgatctcttgactttgtgatctgcctgcctcagcctcccaaagtgctgggattacaggcatgagcccaggagttcaagaccagcctcagcaacaaagtgagaccttttctctccaaaaaatcaaaaatttagccagctgtggtggctcctgcccgtgatcccagtactgtgggaggctgaggcagaattgcttgagcccaggagttcgagaccaacctcagcaaaaaggactctctctctctctctctctctctctctctctctctctctatatatatatatatatatatatgagtttcaaaaattgctgggtgaccagctcatctactggttttccccttgggaaagtgaaattgtcatgtattgaagatttccaaggaagttgtattgaatgagaaacaaactcaatctgttcgtgtttaaagagctgcagtgcgtttgctgtgtttcccataaaactgcacttccaaaagacacgctgagaaaggagaccaggatttgtaattcagaaattggaaagcaagttaggctggacgtggtagctcatgcttgttgtaatctcagcactctgggaggctgaggcaggaggatcacttgagcccaggagttcaagaccagcccgtgccacatggtgaaaccctgtctctccaaaaaataaaacatttagccagatgtggtgactcatgcctgtaatcccggtattctgggaggctgaggcagagttgcttgagcccaggagttcaagaccagcctcggcaacaaagtgagaccctgtctctccaaaaaataaaacatttagccagctgtggtgactcatgcctgtaatctcagtactctgggaggctggggcagaatggcttgagcccaggagttcgagaccaacctcagcaacaaagtgagatcttgtttctccaaaaaatcaaaaatttagccagctgtgctggctcatgcctgtaatcccggtactctgggaggctgaggcagaatcgtttgagcccaggagttcgagaccaacctcagcaacaaagtgagatcttgtttctccaaaaaaatcaaaaatttagccagctgtgctggctggtgcctgtaatcccggtactctgggaggctgaggcggaattgcttgagcccaggagttcaagaccagcctcagcaacaaagtgagatcttgtttctccaaaaaataaaacatttagtcagctgtggtggctcaagcctgtgatcccagcattttgggaggccgaggcgggcggatcacgaggtcatgagatcgagaccatcctggctaacacggtgaaaccccgtctctactaaaaatacaaagaaaattagccgggcgtggtggcgggcgcctgtagtcccagctactcgggaggctgaggcaggagaatgccgtgagcctgggaggcggaccttgcagtgagtcaagatcgcgccactgacctccagcctgggccacagagcgagactccgtctcaaaaaaaaaaaaaattgctgcccaacctgtgtttgcaccactgccctccagcctgggcaacagagcaagactccgtctcaaaaaaaaaaaaaaaaagctgcccaagctgtgtttgcaccactgccctccagcctgggcaacagagcaagactccgtctcaaaaaaaaaaaaaaatgctgcccaagctgtgtttgcaccactgccctccagcctgggcaacagagcaagactctgtctcaaaaaaaaaaaaaatgctgcccaagctgtgtttgcaccactgccctccagcctgggcaacagagcaagactccgtctcaaaaaaaaaaaaaaaatgctgcccaagctgtgtttgcaccactgccctccagcctgggcaacagagcaagcctcagctttctgccatctccacaaccaagaaagcaattcacacagaaatcagtgcgtcgtgcagtgacctcttcagaaaaccaatgagttttccacctgaggaactgtttctgagccccattcagaagaacacatccctgtaactgcagggcagatttactcactgatgcctgtttaaataaagcttccagcttctgcacggggtctgtctggaagctcctgtatctgtcccacattcttggaatcacaatgcacccttgggaggaagatatgtatttaaagggagtggatgttatggtgagaaaatgctgcccatccttctagaagacaaaagccacacaaaatacatcacaagaaccagtttttttcagagaagaacctgcacaaagaacctgctccccccacacccccacacacaggtgaattaacaggatgtatgttttatcataaaagcacaggtttgtttcctatgcactctctgaggatttggccatatgcaaagatgtacaaaaaccttctctttccccagggaaccgtaacccgtctgaaaagatgcccttctcagaagcgagttgaacgattgttggaaaagataaaatacgacgtgcacacacacagtagagaaatgtcacccatgcaaattatgtgtttgaatggaacacattcaggaagctaaatggggtatgaccacacatttgggttgatttatttgacgagtggaaggggcagatggaaatgaatactgctgttttcctttggaaggccatatatgggaataccaagaggattactttggaagtttagcttctccaggtggtctctctctctctctctttttttgagacagagtctcactctgtcacccaggctgcagtgcaatggcgtgatctcggctcactgcaacctcagcctcccaggtacaagcgattctcctgcctcagcctcccgagtagctgggatcacaggtgtgcaccaccacgcctggctaatgtttgtattttcagtagagatgaggttttaccatgttggccaggctggtcttgaactcctgacctcaggtgatccgcctgcctcggcctcccaaagtgctgggatgacagacatgagccagcacgcccggccccaggtggtctttttagcgggtattaaagcagctttctctctgagccttaaaccatgaagatagacagactcagtgtatgggttttagagttgtaattttataaaaataagaaaaagtcgacctatcattgatggttagtattttttgtagcagttgcatgcaatattaggataaggcatgttctcaaaaagaactctttttttttttttttttgagacggagtctcgctctgtcacccaggctggagtgcagtggcacgatctccgctcactgcaagctcctcttcccgggttcacgccattctcctgcctcagcctccccagtagctgggactacaggcgcccgccaccacgcccggctaattttttgtatttttagtagagacggggtttcaccgtgttagccaggaaggtctcgatctcctgacctcatgatccgtccgcctcagcctcccaaagtgctgggactacaggcgtgagccactgcacttggcctttttttttttttagatggagttttgctcttgtcgcccaggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaatttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtggatgttctagcttcctgttctcgtcttttctttgttaattgtacagtttgagggtgtgtgtgcgtgtgcgcacgtgtgtgtgtgcagtctcctgatttcatgtatttaattgttattaccaccacctccatctctcattccttcttaccctcactgtgtaaagatacatgttgtttttaaattttatgtatttatatttatttatttgtatttctgagacagagtctcactctgttgcccaggctagtggcatgatctcagctcacagcaacctttgcctcctgggttcaagcgattctcctgcctcagcctcccgagtagctgagattacaggcacacaccaccacacccggctagttttgttttgagacggagtctcgctctgttgcaggctgcagtgcagtggcgtgatcctggctcactgcaacctctgcctcctggattcaagcgattctcctgcctcagcctcccaagtagctgggattacaggcgcccactgccacacctggctaattttttattggtagtagagacggggtttctccatgttgatcagactggtcttgaactcccaacctcgggtgatccacccacctgggcctcccaaagtgctgggatgacaggcgagggccaccgcgtccagccttcttcttcttcttttttttttttttttaagatggagtttcactctgttgcccaggctggagtgcagtggtgcaatctcggctccctgcaacctccacctcccaggttcaagaaattcttttgcctcagcctcccgagtagctgggactacaggtgcccgccaccacacccacctaatgtttgtatttttttggtagagacggggcttcaccacattggccaggctggtcttgaactcctgacttcagatgatcctcctgcctcagcctcccagagtgttgggattacaggcgtgagccacggtgcccggccagacgtcatgtcttaggaaatcagaaagtgggtagtttccgcactctgaggagaaaaagagacgtccggcgaagagaaaggagagtgaaaggatgtctcctcttgtctgtagcctgttctcaatcgtgagtgagccaattgccagaaactgagggtgcttcatttggccaggcaagcttctcaacagaatgtctaagtacttgttaatgctgagaagctctccaagctactgcactccagcctgggtgacagagcacgaccttgtctgaaaacaattaattaatcaattaattaatataatgaaatcatactgaactcaggagaccattggggtgggcagggctggggttggaaaggaacataaaatatggtgcaatggactttgctccagtctccctccccatctcttctcgccaagagtctctggagggagcatggggaagatgctttgggaatctgtaacttcttgtcttgtaaacagaatatctaagtaattgttaatgctgagaagttatagatttccaaagcctttctccaggctacggacaagggtcatgggttactcagtgttacagaaagaatgacatggagatgtttgttacatcttaaggaaccatgaggggccagagtattttactctgagtgtagatggtacattggccacgcctgtcccaacaccaccaatggtggcacctaagttttgtgtttgtgccccacatttcttcttcttttctgacgtaaatacaagtgatattccttggaaaccatgctgcagcaagaggccatctgactactagtgataccctgtagctcacctacagcagctcacttgaagcagctcacccatagctcaggtatagctcacctgcagcggctcacctgtagctcacgtgtagctcacttgtagcagctcactggtagctcacctgcagcagctcacctgtacctcacctgtacctcacctgcagcagctcacctgtagctcacctgtacgtgagccaccgtacccggccagcaagaccccatttctaaaataaatacacaa

SEQ ID NO: 12640 - DNA, 7811 bp, Human
  misc_feature (1)...(7811): n = A,T,C or G
gataatgtattgctaggaaaagagaatcatccactaaggatcaaattgtctcaaagtgaccctttatatgtcagtgttcaattctagtttgtgctctatataattttgtaatttaagcctatgtactgtgtgtgtctatttaggaaaaatgtgatttaaatgggaaaattcatcatctaggctaaaaattgggtctttgaaatttaagctgaatgaagcctcttgtaaaataagaaattaaaaagggattattattatgtacataggcaacagagtgacaggaggaaaaatgagcagtgatttattagcagaaaaacaggccagtgtcatctcatgtaagaagtttaccctaaatgttacctgtgatgttgaaaaggtaccttctgactctttctcatttccccggggtaagctgagagacaatcatgagggctgtcaaggactccacaccagataaagcatgagggaaggagtgcaataagtgggcgaaagcatgctattgcttgaatctgcaaatttaggtctgcccaaggatgaaaaatacaatgtgttttcaaatgttgcttaatggagtacacatttatatgcacctttaagaaattagatcctgtgcgatgtaagtatcaccttactgaatacaataaaaagaacaaaagtaatattttttgaaaatttttattccaataagattttggaagctgaactattactaatttgtgtttccatggtggtagagataaataaaagagtataaagcctaaataaaacatttccaaaaccaccaagtaaagctgtgtcctgaaccttattcatggccaaaattaaaaagaaatcatggaataaattatgtagtttctccttctatttgttaattttactcactttttttcagcatgtgaaccattaatgtggttccaaaagtcagaactgtgcaaaaagacattcttaggaagtaacattttcacctccctttgccaaatccttctattatatccccttattatctcctcccgctgtggttaaccagtctcagcaatctctacagcctttggtttatccttcttgtgtttctttttgaatgaatgtacagatacatgtacattttcttctctttctcttctttttttatgaaaaggtagcatataaaggtactgtattgcattttgcttttttcactaaatgtcctaaaaattccaccacaccagtttatagagattttctttgttctttagctgtgctcttttttttcaagctgtgtagtactccattgtatggatgtaccatagtttattcaatcattttcctatgtatgaatgtttaggttgtttctaatattttacaattacaaacagtggacataggtgaataaccttatccatatatattttcatattattgaaatcattgaataacttttgagtaaaaattattttttctttggattttaatttaatagatttaagtgtaacataaaattaggtcctcccctttcaaatggtgtgacataacaaagtcacaagtgatcctacttttatcctagtcgcactttgctgaaagtttccatcatgaaataattgtcatgtgactcttatttttgatgggctgctctgacttctctcttactctctggctgttattttgacagtacttgcaggctgaaaagaagaagaaagagacaagaaggaaacagaaaaattcttgctcattatagtgagaagccatatagactaaacttatttgatagtgtatttataaaacaacactcaactggttacctggagtttgagttgattgtgtttatttaggatatttttcacacatgggaaacgtgattttctttcagtcagagaaaatgttagactttcctatgggactacttctggcctatgactccaaaattttgggggatgagccagaatggagtggaaatttcactacaactcccttcatgaaatacccaactttctagcaaggccatccttaaatgtatataccaattgacaagctactgaataagcagaaactgttatggctctattctaatttgagaattagggtcttcaggcaaaatggtggtgcctcccatgttaggtaaagtttgcataaaaatatcccgaacagaaaaaatatgcattaatattgaatacaactatgttataccacaaaggaaaaccaacatgtgatgcaagcaatgaatatatacatattcattaattttaaaaaaatatatattaaggaattggctgatgtgattatggaggctggcaaatccagaatctgcagagtgggccaactccctggaaaaccaagatagccaatgtttcaggtagagtttaatggcagtctgctgtaaaaccaagaagagctgatgtgcagataaagtttgaaggcagtctgctggagaattctttcttgattgtgggaggctggtctttttgttctatccaggctgccaactgactgaatgaggccagcctacattacgaagggcaatctgctttactcagaatcaacagcatgttaatttacatgttaatctcatccaaaacactctcatggagacacccagaataatgtttgaccaaatatctggataccctgtggcccagccaagttgacacataaaattaaccatcatggtaatcttggtagttacgtagaaaccgttaggtagaataaaatgaaaaagtggcttaaggtcaacaggaggatgctgatccccaagtcacagtcccagaatgttagtgctgaagggacactggagatgatttattttagctatctattttgcagatgagataacaaaggctcacggttattaaatgaattgcccaagattccacgtatgttcattaaataaataaatgaaatagatatttattgagccttttccatatgtcagatgctgtgctaggcactggggattcagtggtgaccaagacaggcactgtccttgcccttcctgccctcatgaagcttctctgaggaagggacacttaagctgagaaatgaggatatgtaggcattgatcaggtgatggcagagcagggacaggatgagaacatcttacacagggatctgaatgtgggcaggtgctgaggtgggaaggaattaagtgagtttgaagatgtgagcgaaatttggagtatgctgaaagacgcaaatcaaagactcaaagatgctatttacattgcactgtctcccaaaaatgatgttcttcccccacaagctattttttttcaaaacacttagcaatttttaagcaattagtcttacagcctgaagacagcaggtatcattattgctatttagcaactagaggaattaaggcattgagcactccaacaccttgcccaaggccactgaaaaattcatattagagaactagaattaaaagtcatgaggtaaggcttggcttctctgagacaatcttgggaaaagaaattatttattctgaaaattgaagtagtcatcttggaacctttggtgaaaccagagtgcaaaaataggccttctccccacccccaaggacaacaataatttcgtggtaattatgataatgattgctaaatgatgagtgtgcccatcaggctaggagttcccagggctgagttcccatgttgccctcctcagttccccctctgtgattttcctagggccatatcatgaccacacttacatgattctccagctgtgagctctgcttgctctggaccgaccacttccatgcaatgctgttggtgtgaacacacctgaagtgacctgatggagctaccttgttagggagtctgagtctctgcaacttcatttgatgatttactgttgggtgggagtttccattaagcatctggcccttttcctgcctatctttctgatttacctgtggtttttctgaatgtattgaaaacttttaacttttatcattcttcaatttttaatagttatggttgtcaattaagctttaatagattgtattgaaaaagataaatctatgcttattggtagactgttctgttttcattatgtctgtcaagtcagagagatgaagaaacaagggaaaatgtttatgtcttctgaaaagatgtatggcttgtgatgggcctggactttgcttgtcctgggaaaagggataattcttcaaaaccacaggatgttcagataacattcaaatgtgtctcttgcagcaaatgttctacgtctgtgattactctgagtcatttctcagtttttaccccagttcattttcaaatagagtgggaacctctgccgactttcactggtataagtagaaagagggtgggccttggaggaggagagactttgattcaagttctggtatgagagtctcctggccatatgattgtgtacatgttacttaacctttgactcaagtttctttgtaattaaatggggataatattttcctcattgcagtgttcttgtgattaaatgtaacgtgaaagcccctggcactaccctagctcgccttgccagttcttctaaccctttccctggaagttcgccactttcaagtctcatggctgagagtagttgaaattgataaaaacatggttatttgttcattcattctaattatatgtaaacaacagatttttttaaggacttagaaaactataccagaattattaaagcaaggcatctatattaccatttcagtatttaataccagtgttttgagattattttatcttttatattaaaggtgatttggagagcagcaaatatgccacaaagagaattgcaatggaacataacttatttaatattcctttttaggttaagagtcaagtacaagtgaccttttacttaattttgtccaaatcacatttggaacttgaactatatctctttttaagtttctgttatctgtacttgatatttacatccataaagctttctctctctcacttttttccaaaccaaactgattcagaatcttcagagttgtctttgttgaagccaaactgaaattatttccaatgtgaacagttcagatggttatggacatacgtaagagcagaactgaaatgcaatggtgatgataacagaataattgcttatatgtttcagagcattgtgttattcaacacacactcacatattatgtaattgctctttacagtgactctgtgagcctcttccaccattcaaaaaattcttaaaagtgtaaaagctgtcaagcttgctgagatttgtataatcttgatgccaaaacaaggcaagataatacaggaaaagaaaattatagccactttcacttataagcatagatgtgaaaatcctaaataagggttttattttattttttactttcttattgaagtagaacatgcagtgaagtgcccaaccttgagtgtacagcttgatgaacttttacatatgtatatatcgnnnnnnnnnnnnnnnnnnnncgggtttttaccaaccttggtgtacagctggttgtaacttttacatatgtatatatcgatatatagaacagtttcaacacccagcaggttccctttaccatctcccagttaatacaaatggagccatacagaattcttttgtatctggcttcgtttgctcaacatgtctgtgagattatgcatgttgttgcatatagctgtcatttttttcattgctgtgtagtactgtgttatataatgatacaactatttattgactctgataagcatttgggtattttcagtttttggctcttatgaacaaagcagctatgagtatttgtgttcttctttttttcctttttttcttttttctgtttttaattttatttattatttatttatttatttatttatttatttattttttagacagggttttactctgttgcccaggctggagtgcagtgccacgatctcagctcactgctacctccgcctcctggcttcaagcgattctcccacctcagcctcccaagtagctgggattacaggcacgtgccaccacagcctggctaatttttgcatttttggtaaagatggggttttgccatgttggccaggctggtcttgaactcctgacctcaagtgatctactcacctcggcctcccaaaatgttggggttataggcatgagtcactgctcctagcccaaaagcagctatgaatattcttgtagatatgctttataagcactcatttctttcaggtatatatccataaatggaactgctgagtcatagtgtatacggttttctaaaatagttctaccaatttacagtcacactagtgtgtgagagtgtatacagttgctccacatcctcacctcataagattttacttgaaattatcagtcctttttagtttcagtcgttctagtgaagttgtaatcatatctcattatgattttaatctgcatttccctaatgattaacaatgactgataatgttgaacagctctaatatgctcattaacaattacgatattcccttttatgaagtgcttattcaaacctttccacatctaaaaaattgagttgtctttttcttattggcttgtagtatttaaaaatatatttttgagatacttattctctgtcagacatatatactgggaatatattttcccagtctgtgatttacgcttttactctcttaatcatgtcttttgatgaacagaagtcattattataataaagtccaatttatagtcttatgattagcgcttgtgggtcctgtttaagaaaccattgcccactgcagagtaattatgatattttattatgttatctcctagaagttttattgttttaacttttatatttaagctccattttttaataagaatgttacccaaactttattatttatttattttccaaccttatttaggtataactgacaaaacttgtatatatttaaggtatacaacataatttttatatatgtttacattatggaataattaccataatcaagctaacaaacatatccatcaactcacctagttaccattttgtgtgtgagtatgtggtgagaacatttaagatctactcttttagcaaatttccagtatatattgcagtatactaactatagtcaccttgctatcattagatctccagaacttattcatcctgcctagcaactttgtaccctttaaccaagatctccccatttcccccactctctagttcctggcaaccactgccctactaatctgtttctaattcatcatttttagatcccacatataagtgagagcatgcagtttttgtctctctgcatctggcttatttcacttaacataatgtccttcaggtccatccatgttgtcacaagtgacaatactttcttctttttttaaggctgaataatattccattgcatatctatacatcacattttctttatctatttgtgtgttgatggacacctacactgattccacatctttgctattgttataatgctgccatgaacatgggagtagatgtatttcttcagaatactgatttcatttcctattggtatacacaaagaagtgggattgttggatcatatagtagttctatatttaattttttgagaaagttctactacttttatccctttttctctatattcttattattttttgtcttttgatgatagctcttctaagatgtgtgaggtaatatctcattgtagttttgatttgaatttccctggtaattaattatttgaacattttttcatatacctgttgttggccacgtcttttgagaaatatccatttaggtaatttgcccattaaaaaattagattgtttgttttcttactattgagttatttaatttc

SEQ ID NO: 12641 - DNA, 12561 bp, Human
ggattctcctgcctcagcctactgaaagtagctgagattacaggcacgcgccaccacacccagctaatttttgtatttttagtagagacaaggtttcactatgttggccaggatggtctcgatctcctgacctcgtgatccgcctgcttcggcctccccaagtgctgggattacaggtgtgagccaccgcgcccggccaagatgcagttttaataaggagtttggccatttaggcttgtaactgactggattattgcatattctttaaaattaatttgtattagtcccttttcttctatttccttatctccaactctcgcattagtatgcacgctttattcctactcaggttttcccctatgagcccaggagtattattattatttttttgcagggattaggatcaggtttgtgaagtgaatagtgtctttctaatctgcagagggaaggcagcatcccctggcttgctgctgcagcctctctttaaattaaacagcaggttcactctttctgcggcattccagaaggaacatcagtaggaacagctccacagatgctgacgtcttgtctaaggttatcccaagaagtcctgtggcatttgcaatgtgcctgtacatttttccttttttaaaaaacatattcctgcagactttgttgaaaccagaaacaaacacaagcaagcaaagccctttctagcacagcatgttaatcacacactttgccatattctgtgaaacagtaagcaaatgataacctccaactgttgcccgggccctgtaaaacagaagatcaaattctgtgttctgccttggcaagaaaagaaactgcagcattttgtctagatttttacaagtcctggggttcacattactggctgaaattgttctttctctactttacagaaaaatggaaaacactagtaaacttaaagatttaaatattattttaaaaggaatataataaaaaatggaaaacactagtatatttaaagatttaaatagtcttttaaaaggaatataatcaaaactgtagtttaaaatacaatctagctccataagagaggcaattggctgtgtgttccacttgtaatgcagaggatttgaagcatctattttttcccttgtttctatggatttatgaataaagactctgacccttctcaggatcaggaaaattacgaaaaatttaaagcctgggtttaaggtctgtagaagctgcacaggtacactaattttagtaagacgggcgccaggaaaaagaacaaaatagtaggggagaaatattcaggcatcctaaaaaatattcagtggaaacgtaaaaacattaaagactgattaaacatcgcagcatgacacagatttagcaactgagcataaataatttgactcggatactgctccaaaatccgaagaggaccaatttcttccaggaggacaactacctcgtcctctgcagacccctctcctcggcagctgaaggagtgtggccaatctgcctccacctccccgcggaccccctactctcaggacctcctgcagcaccccaaactggaagtggccgctgcagacccaaggacgaggggcacgcgggagccggcagccctagtggagcggttggagatgttgaggtgggagggtcacccaggtggggtgaggctggggtaggtagcggagtgaacggcttccgaagctctgggccgcccccaggttggactaagcaggcgctctgtcttcgcccccgcccagggtgggcgtctcctgaggactccccgccacacctgacccgagaccgcgcgcccagcctagaacgcttccccgacccagcgtagggccgccgcgactggcgcgcagggggcggcgggaggcctggcgaacccgggggcgggaccaggcgggcaaggcccggctgccgcagcgccgctctgcgcgaggcggctccgccgcggcggagggatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcgggggtttctgcatccaatccccctgctccccgcccagccccgcacccactgcatccactagcgccgcacccgggctgcctgcagcgcagcgtttcggcctgggagccgggcggggccgggcactagacccccccccccggcccgcccctccccaccccgcttctccgccggcgcgaaggtggcaggtcgggcgggcagtggagaatgaatgggctggagctggccggtggcgcacattgttccggccgggtgttgaggggcgcagtcagcgcccgccacctccccactttggccggccctgctgggcgccctccctcggtcgctctcccctccttcttcccggggggcgcggcgcgggcgtgggctgggaaggaaggagccggggaagggtggggttgggggcaggaaggcgaggggttgggggcggagagggcggaagcggcggccgggccgccctgcgcccgggcggggccctgcggtgtggccgtggcttgttcctgccgctttcgcaccctgcggccccccacccagtgcagcagtgcgggcgggcgtgagcctcggtgcaccaggaggcacttcccgcgggaggcgctgggctcgcgctaattggggcggggggggggggcggcgggggaggagggaactggcgcgcggcttggtttccattagagacgcaaagtttctgctccgggaggaggcggcggcgccgcgggctcgtcgcctgggggagcagaagcgggtgggaggtgcgggtggccttggcctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggtgtgttttccacagacccttcctcctcggcgtgcagggctgacatcaccgactgcgtttctggtttggcgggtggggagatggttccccgcagggttctggtacacctttgcccccagggctagcgccatttgggggaggaggttttcgttgtcgagaaagttggatgctcctggtaacccctctaacaagagagttctgtagcgaggtgggactgttctccccataaggtgacagtttctcttgcgaggtgtggcagcgcttcctgttgtacaagacagatgttgccttggcgttacgtaaatcatcgtgtctccgtcatttaaagaaagccaatttttagtgattgaggtagaaagaaagatccgtttataatttgtaaaaacaaattttcacccagaatcaatatattggaacaccattcctactgttaaagttttcacttaagagcataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctcgaacgaagtgtgtttattaagaacagttcttatgtcattcttaaggtaggtagggttaatactctccagcaaatttagtagatactctttgccagaaaagagaggagtatatatagtttgataattattgtgtagttttctgtgtacttaatttttgcagttttgtaacacttcatttgtaagatggtaccattttttcctggcttctgaatcataggatagtttgacccagggcattagccattgtaatggtagccttttaacaaataactgcctaatttaaaggattggaaagcatttgttacatggaaatgaagttggtggcgtacccagttgctgtatctttattttttctacttaattatttctcataaaatggatataaaagcctgttaatccaacccaatgccattatgtaacgccagtttggagatttcgagggcctggagcagtgcgcaaggtgcgctgaaagcctgcccctggatgagatccttatcctggctgtgatggcagtggcagtgggctgggtcccttgttgagtggaaagggggactgcggtgtccatggtgcagtaggtggcgctcttctgtcttagagcctgccgccactgcagctggtgccaaggggccttctgccactagaggtgccatttttcacatgatgaacttagcctagttagatcgcagagcaagctgtaagccatgggcccagaaaagaaaacttgaagtgagcagatgttgtcacttccttgtaatcctttgttaaaatagcataaggagttttctttattctatttactttcattaaatgaccgtgctacaggtttcaaaggattttaagattgatttttgaaagatcacaatattaaaagtataactggaaaatctatgttgaaatcaaccaaacatgtcgtggactgaatgataaccttttctttcttcatataggctgatcagctgaccgaagaacagattgctggtaagttgacaactccaaggagtccccagaaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtaaaactaaggatgcccacatgttaaactctggagaatttgaccatgtttcacaatgtgcaaagtttgcgtatgattaattgtactgagcctgctactcagcggtttagtttacaattcttatgccatgggtctttcagtaatctgccacgaaagcttgtgctcgctatcctaaaataaatggaaatgggtgaatatgagtgttaggaccactgtagtaattgggaagaaagttacattagttaaactctgttgcccaggctggtctctaactcctgggctcaagcaatcctcctgcctcagcctcctgagtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgtttaaaaaaaaaaaaagattggatttaggactaatttaagcatgttccagcttagccgccttgaaacctttgggaatattgtggtgtgtggcactgtttattgggagcagtgtttgctttatgggctgctgtatgaaggccagtccaacaggactattgtggtcattatttcagtagataaagaccagacttctgatacgttgcacaacttgaatggctggctttggcaagcccccggcaagtgtgtattgtgactgggttggataaagacattgattctaacgggtcaacttttgttttcagaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaagagctttaaaaccatgaatgagggccattgttgtgtaattcaagttcagacatgttacaggattgtctttcaggtccccagagcaaagcaaatgtgcaaagatcctttctgtggttgccccagggccattgacaattaaaatagaagatgatgggccttgcgtccatcctgcttagtgtctagaatgttttctgcatgggatcactattgttttcttcctgcttggtgcgacctagagctcaaatctatttttttttttttttttggagacggagtctcgccctgtcgcccaggctggagtggcactggcgcgatctcggctcactgcaacctctgcctcttgggttccagcgattctcctgcgtcagccttctgagtagctggaattacaggcgtgtgtcgccacgcccagttagtgttttgtatctttagtagagatggggtttcaccatgttggccaggctggtctcaaactcctgacctcgtgatccgccctccccggcctcccaaagtgctgggattacaggcgtgaaccactgctcctggccgagctcaaagcttttatcaactggcccatgagtctgcactgagtcttgaggggggaggtgaaattaaatagccatagaaagtgctttttaacaaacttactgtgtttaaagaggaggaggaacccccagatgaagtaggtgacgagcactcttagaagttaccataaaagtgagtacagtgtgagctgtagatgtgtttgctgcagaggagcatgtgaggtttggaggcggatgtgtggtgactccaggggatagatttgcagaacctaacggaaagggaagctgtaaggtgcagggccagagggaaccagcagtaaccctgatagcggtctgtcatctgttcctctcgactctacagcagcggacaacagaactttgattgctgatttccatcagtaagcaggctttgaagcacacttccccacccctaaaaaaaaaccacgtattttggtaaatcctatatatattctaatgtactgtatgacagtatagaacatgatttttaaaagatgagttgggaggagaaaaggataaaagaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagccccgggaatctgtgcctggggaggggagaagtctgttaggctcttggattgtgtggaagaaggagaagttgtgccaggctacagaatcctgtgtttgcactgagaaaacaggatggtacctgaccttctctgcatggctgtgagatagcttaaaataatttcttttgtttttgatgaatatgaacaatatcttaaaatttttgaggctaaaaaagtcttgaagggatccctgaggtattttctttgaaaggtactggtgaaaatgagtaacttaacctaagggtttttctttctaattttatttccatttagttcaatgacactgttagtctggagtgcttgtctttgggggtattcatctcttagttttaaagaggagttgtttggagtactggccgtagaacagattgttctgacagttccctaagtgttactagtctgagctgtgagaatgctcctgagcttttcccttaatgggaaataaagatactgagttggaagaaaacaggtggctaaccatcatagcgtggccaagaaatgatcctggagaagacttggtaagacttcatggcccatgcatggcataacagaatcaatgttcctctctcataatcttttctcctctgaaacactttatacacttaacctgcagctcagttctaggccttttttgtgttactgctgtcactaaccaaggcagagtgagacctgagtgatttccctaactcagggatggcagtcgggggcgctttcttccctcggagtggaaagattcagcctgcggagtggtgtatgctatttttcttttgaactgtacagcccttcatgacccttccatgggcttgaatccagatgtgcagtttcctttgtataattaaatactatcctgggcactgatgatgagtttgaaattatgtgaaattgccctgtgaagtgtttgaacgttttagacctgcagatgattgaacctagtaagatagtctgcccctttgtcctagtacatgtttaccgttccgtacagtggttctgaaatgattactgcagagcagcgttaatggagtgcttactttacatgagctttttgttttttaattcgaggtaatggcaccattgacttccccgaatttttgactatgatggctagaaaaatgaaagatacagatagtgaagaagaaatccgtgaggcattccgagtctttgacaaggtaatccagcatctacatagcagatggtacttaagtatggcttcttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcgtgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagct

SEQ ID NO: 12642 - DNA, 54452 bp, Human
tcctcactgggatccacatgaagaactggctctgttggagaatatttgacagcaggcaagggaggtgatggtctcagaagaccaagtttcagttaagggaggccttaacagcagctttccaagagaaagtcatgtcaggagtattcctcagcagaatagcaaacagagactcttactaaacttttattcaatagatgaatacattattggccatttttggttttggttaaagtgaaacaaaaacagatagatgttacacatgaatgaatgaatgatttgggttgagctctaaagagaaaaatggaagatggtaatagaagcaaaagtttgtcagagcccatctgaggaaagggaaggctggttggatagagatgtgagtaaagaaccagcaaagaccttatctaaggatgagtgaagggcacaggagctaaatcagggcttggccaaataaggcctgtggccaaacccaaccctaccaacctgatttgtgcagcccatgagctaccaataacttttatgtttttaaatggttaaagtaaattcaaagaaggataatatttcatgacatgtgaaaatgatatgaaactcaaatttcaatgtccgtgaataaagtgacgactgtttttgtcattttatatatatatattttttttgcagagggactggcttgcactttttaaacattagttatattattctcagtacaaccctataagataaaattcattcccattttactgatgagcaaactgcagcttatgtttcagccaaagtcagacagttcattaagggcagagtcatccatggcaatctgcctgtccagatattacactttcccccggggtaaaagcactggctctaagaatagtgagaacaaaacatacttataaaagggagttgggggctgggaatggtggctcacgcctgtaatcccagcactttgggaggccgaggcgggtggatcacttgagatcaggagttcgagaccagcctggccaacatggtgaaaccctgtctctactaaaagtacaaaaattagccaggcgtggtggcgggtgcctgtaatcccagttattcgggaggctaagacaggagaatcacttgagtccaggaagcggaggttgcagtgagtggagatcgcaccattgcactccaggctgggcgacagagcgatactctgtctcaaaaaaaaaaagagagttgggaagtgttttgaatgcttagagggcagcttgggaactcaattagaagaagggacggtttaagcagacatatttctaagagacttatatgagttaactcatttgatcctcagcactcctccatgagttggatgctattattaacaacccaatattagataaaggatgaccttcttaaagacctcttcccaggaaaaagactgtgtgtgggtactctgaagctttggctcttctggtggggacaccactgggtttccaaaggctcatccagccaagcgaagtatctatgacctcgtcgtgttcagcgcgcttagggaaggattctatggactgcacttttaccctggtgtcctgcattcttgctccaagacttctcttaccactctcattcccctaaatgcagcttctgacaccttctagctacgagttcttgggctcctccttcgtgacttccttttaagataatttctgagttacaacaaatcagcatttgaagaaatgcagcagataagttgaaaattcaagtgctgaggaatgtaaaggcccaaaacaatcccgtagaaagcacagaggcagatgacagtcttccgttaaagatttcactgctgtagatttctgagagtgctgtgtagctgtcctctttatcctggtgtttgccacttcgaacagtcactttcccacttggaacttacttgtggctttgctgacaaaacaggaagtgatttgaatacagtttgtttttatgacctttcaacctcaggaatttgaaaagttttagcagtggatttacagccttgcttaatacttctatttcttacaaaacaaccgtataggggttaaagtatcagtgcaaagtcccgttcaaatattgactcagtaatgagctctacaagccagcctttgtggcatgttaaattcaaaacaagcttagcatttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggtaacaaaagggacgttgttgtcaaagggacaagcctcagactggctgtgcgtcagtgatagatgggtctcgctcagcctcgcaggctgggcacagggataagggcgaattactgatagcagctccccgtcgtcccctcctcgctgccctgccctgcctttctcctgcagtgctttggttccacgtttgctttgaacactcaaaggctcccatttgtgttgtatttccagctgcatagagataagcgttaaccatttgaaggcacaaatccatgttcatttgggaaaagataagatgctaatcttcgaactcagatttttcagccctcctccaaattttacatcccaaaaaagtcccaaagggagtctggtatgcttttcattagaatcaaatataaataattgccaaagtacgatttgccctgaggattgagtgcctcagttctcataatatccatttaaattaattttccttatccattgttatagttatcactctcttcctcaaaattgtctttttctttcagcttaatattagcaatgtgttccttaaaaaaagaaccattttcccattatcagtgaaactcactggttcctatccttcttgcagagttcttttttttgggtgattaatgtgttcaatttgtgccagagctgataagcattatgagagtaacagattccacatgctaaagataatcaaatcacctatctgggggtgatttgctgtaactcattctacttcaggaaataataatggaaaactgggaagaaatgactatggatccaatttgcaaacagcaaaggaaagtggtattttatcttttgctgaatttctctattgcaggcctgaaattctttcaccagggcagtacctatgtctgaccagagcaggcattattagatgtacataaaattttatttccttttctatttaacatgattcagattttaaatgttagctttcaaaaaataggatattatatattaaaaattaatatgtaataggataaggatgcaaacatcaaagcaaatagcaaatatagagaacttcttacctaggaactaattatagttaacctctttgggtttctttgctcatttctaaagttaaaggtaatgagttaatttctcaattctttttcagtactaaaagtatttgctcatgtctgtagcttaccagatccttggttttcttcagccatacacagtttggtttgaagaggtaccgtggatggagataacataatcgatgatgaatgaccccttccttatcttcaaagtttaaatctaactggaaatattataaaatctgtgaaagactgaagaatttttaagggcacactgtttgtcttataacagtagtatatagttaggaatgatcagattcagtgtcatttatttttttcctgaaggtaatgtttgaaataagatttagctgaaggacttttaaaattgttacttagagttgtctataagttatgaagtaccaaaatgtgattaggatactctttgtgtatgttagggcagggtttgttgagtttgtggctcactgtgctaattgagtgtggagcgagcctattaaatttttattaaagcaagacatgccatattttaaaacatcaaatggttctaaagtgtgtggggactataacaaaccccacccactccattcttgattcccactctccggaagcaaccactttcagcactttgaaatcttttagttatttatggaattttctttcataattcaaaataacatgttattgttctatttcttcatttcgctgtattaaaatagctaagtaagcatgcatatttcccaccctatcatgtcactatatgtagtcaaaattttggttaaataatttgagtgtttatgttattttgcctatgtacatattcttaataattgagcaatatattcgactatgcttatatttccttttacgtacaactttttgttctccctagagttgactattgccttgattttggtttcttttcttagttctccatgtacctattactattttgatccccaagcagatatattaatctcctctcaatatatgcaaacatatcaaggaatctgtttattttaccccaagggaacaacttttctgaagccctctgttctttttttcagtttaggaagatctgctttggcctgctatacaactattaaggagggaatttatttcactttctgagaatcattttctttctccattatttgattccctgattctatatctcatgcctttcttttctttgtttcctcggtcctttgtttcctgaacaattctttaagaactttaagagtgaacgagaggtaaactttttgagactttgtatgtttaaaaatcccttggttctatgttaatcgtttgactggatatagaactctatactgaaaatggttttgtataatagatctaaaggtacttttccactgtcttttagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgtctcaaacaagagaaaaaaataaatcaaatgctattcaaaattctcatccttggcatgtggaataacttttacattgctatgtgttttgttttccctattttgaactttttagaatcttcttacgtctagtattctgaaattttaaaatactgagctgtgaaatggttcctttttacccattttatgggtactccctgggctatttcaattgagattcagatccttcagttatgaggaactttggtaatcattcttcaccactgttttctttttctggaacttttattcatcaaatacttcctggattgattacctaattttcttatatttccagtttgctacaactttcctctttcagcccatctattaactttttactattatatttttaatttccaagaatgttttctatagcattcttttcatcattcccagatgtaataccttcttattcattacaaaatgttcctctgctctctctgcctctttccatctctgtttcttatgttagacagctccccaaccacctaaagagccttggttttctattcaatcaaataatgaggcactaaaaggtagtcagattctctttgtgtaagtcagggcagggtttgttgagtgagtagctcactgaataattgagtgtggactcagctctttcctgggagatcctcagatataaaatcatgttaactttatcactgagatgatttgtttccctatagaggaattcttcaatcccctatttgagggtagatggtggggcagggcttgggggcaggaaaaattatagtaaataactataaatagtaaagttggttattgttgttgcatataaaacatttaaatccttggctagaaaatagtaagttttcaataattatttgatgtcattataatatgtgaaatgggatgaataatagtatctaactcatagaggaatttcaaggattcaaagagttaattcacataaatcacttacatgtacctagaatcataataattgctaatatatgtggagtgcttgtcatgtgcagatacatttctaagagatttgcatgaattaaatcattgaatcctcacaacttctccatgaattagaaacagttattaataatcctacaagagagatgatattattatcttatttcacagagatgtcaaataacttgctcaaggtaacataacagtaacctgggatttcaacttgggtgctctgcttcatagcctccctatgctgtcatagatgtaagcattttaaagaatgaacaaaaggtgtagatagaaatggatgtgttaggactcaggattatgagttggaggataattagaattgaagaaggcaaatcatttataggtgttctcgaccctagactttgcaagattcctttagaaccttacttcaatttttgttcccatcctgtgactgagcaggctttttgcactgtagacaaaacacagttttgtttgccatcccaaagtccaaagaaacaaacaccatccttttcccttcatggttctcctacagcagtcatctcttttccttctctctttcaccctgtttcaacagactgtagatctgcttcctcatttttgagctcagttttaatcccattgccatctgacttcagtcttcaatcttcttttacaactgccattactaaagacactcgtattgccaaattcgatggagatttttccttttttaagtagtacactctgctgcttttgccatgacgacgggctttctctgcctccaattactctggtacctctctgtgctttatttcttttcttctctgtcttctttgtatattcttcacaatccagtgatctttagaagttggtattgcatcaccatccactactactataactctgcaatatctttgggtgatggaatctacttttctagcactgaccattactttatgatgatgattctccagaatacatcattgaccctgatttctctcctcccagcttaaatcttgcaaatccaaatgtctgctgaattcgtatttattttttttaaaagccctgacaaaacataagcttgctgccaaactgtatttctcagcttcctttttggcatcaccctttgcccagtcatccaagcctgaaacagggaagtcactgtgcattcatatttttttctgacctcttcacatcaatctaacagcaagtcctactggcttatttcccaatctgtccactccactctatttctagtacctgagtcataattcgggctttattatctcacatttcattttgagagcaaagtgatatctgtttttttaatgcctaggatagaatacacataatgcatgtttaataaacacttgttcattaaaaggaaggttaaaaaaagggggaggaaagaaggcaaacattatagatagtgggaaccagctgagcctttcctttatctacgatgagtggcttattatatgactagactcaaaactccactttttctgttcttgttctccaagccataaccaaacaaatggcattttgtacctctgatatgtacatactgccatttccaagtctcccagttaaagattgttaatgaataaaacctatattttgaaatatactctaaagatggcaatataactgatataattggaacatttcatgttggcctagttttcattcattgtatttttagtctgttctcttcaactagactagataatcagatttcacaaagcacctaacacatttttctaaaactacataatttttttctttcaggattggagacacaaaatcagaaattaagattctaagcataggcggaggtgcaggtatgagtaatatatttttaaagttcatatttcactttaaccattatgctgtgtgatgacaatattgttcattttttaggaagactttttttttttgcttttggaagagatcggcttattaaaactagcaatattacttcaactaacattaatgcccccatagatttacagggtttaggacattagccttcattactatctctattgtgaataagtgatgtgacttgttcttttgatagatgaaaaatcaaataggataactttaaggataactcttatccaaaatgattaaaatactcacagaaaaggaaaatctcataataagcttcttaagtttgtgccatttaaaaccttgttcatggactggttactgttttcaaactgttattggtccatgtgaagatctgaaatgtgcacaggaggctgggcgcggtggctcacgcctgtaatcccagcactttgggaggctgaggggggcggatcacgaggtcaggagatcgagaccatcctggctaacgcggtgaaaccctgtctctattaaaaatacaaaaaattagccaagcgtggtggcagacgcctgtagtcccagctactcgggaggctgaggcaggagaatggcgtgaatcctggaggcggagcttgcagtgagccgagatcgcgccactgcactccagcctgggtgacagagcgagactacgtctcaaaaaaaaaaaaaaaaagaaagaaagaaagaaagaaagaaagaaagaaagaaaaaagaaatgtgcactggaatataaactgatgcacagcttttttcattgagaaagtctcaccatggggaaaaatgtgctcagtgacagagttaatttacattcttgtgaactcattctttgagtggcatgggcctaatctgttcccttcctcttactcagttccaaaactgaatgcttagaattacctctagcattcagataactcctaagcacctttttttttttgacggattctcactctgtcgcccaggctgaaatgtgcagtggtgcaatcttggctcactgcaacctccacctcccgggttcaagcaattctcctccctcagcatcctgagtagctgggattacaggcaccaaccaccgcacctggctaatttttgtatttttaatagagacggggtttcaccatcttgtccaggctggtctcaaactcctgaccttgtgatccactcaccttggcctcccaaagtgctgggattacaggcatgagtcacatgcccagccctaagcatacttttataggcattttatagtgtcattacttttagatccagtgctttcattctaggggaaaatttaaagtctggaaaggtagatggacacaggtaactcagcctccagtgaaatttatgatcttggctaaaacatcagtaaaatgggaacaatgaattttatctcataaggttgtagtaagagtgatataggtaacatttacaaagtgcttaggacattcttattgctcctggagagtgaaggctattcccttctgcaaaagtaaaataagtttcatctcaagacttttcctaatatcaactcctgaacagtgtttgcctttttttaagtcatctggaagtttgggttaatgcattaatatataaaatatgtagatatattatttatatatttatctttagttattttcttttgtctgagtgatagttcagtaatggttacaactcgatatcaagtggacactattgtcacttgtaacttaatgccaagtggtaatcccttgaacctcttaagtataagtgttctagtgccccatgaatgagttgaactgtggctcatattaacacaaagataactaagagctctctaatgaaatgagatcactgattttttgtttttgttttttgtttgttttttgagatggagtctcgctctgttgcccaggctagagtacagtggcatgatcttggctcactgcaacctctgcctcctgggttcaagcaattctccctgcctcagtctcccgagtagctgggattacaggaaactgccaccacacccgtctaatttttgtattttttagtagagaagggtttcaccatgttggccaggctagtctcgaactccttacctcaggtgatttgtctgcctcggcctcccaaagtgctgagattacaggcatgagccaccatgcccgacagagatcactaatttttaatgtcattatttgttaatttttcatgaaatacactgtgatatagtgtaataagaactaatcattaaaatcattttactttattatcatctttcaccaagaaaatagaaaccaacaaagacagacaatgaagggaattgtcatgaacaataccatagagggtatttaagctaaaatactttattattggttatactttaagtccccaaaattataatagttatgaattgtctaaagaatgtcttattaattcatttaaccaagacagttatttcctgtgtgttttggatatgagtttcaggcaaccaacaggcaatgagactatcatttgatagtgtcacttgtgcttggacaagaaaagaaggcctacaagaaaaagtaattaaaaacaatctctatcatggccaagttaattgaccttttaatataaagttaattgaatttctaatgcaaatttatccagatgcttataagctatctagagaaaggaacgtttggcctgcacagtgagtccttacataaaggtgcacatggaagctaatacagagaacttaacaaaataaagggaacaactcttggagttcttctgactgagccctaataatgtattaataacaaactccaccttggggagaatgtgggtgccctttaaggtcacttttcataagaaatcaatcagaaatgtaagaaaaactccaagaaaaatttaagttatatatacttagctttcactacccaactaagttatatgaaatcaaaagcaatgcatttaaaatccctaggtctaggtgtctgttgcttgaaagaacagtgttttgaggggaaaggacactctacttcagttagtttgagtgctcatgtagcaactgggagatggttatctaatcacctattatggcctgactacaagcatcaggcagaacaatgcattactatacagcaaggaactttctatccttgccttagagaaatggtctccccacatattctaagatctacagggtgcctgagagttttgtattgtcccatggcttgagtatccttccaaatcattcattaaactccagtccctagcaaatgaggtcattgatcctgttcactcctttgtgctcagctcctgtaatgtatctcatagggtcccatttctgtcttagtttacaggttttattacctcaagtttctttccttgtttgcacagatagataggcacatggctttggtgcaaatattctctaagcattcataatggtgctaccacttctcccaccgtgcttcaaaaacacacaaaagaaaaccagctaaaagccttcctagatgaaactgctacttttataccacttaattctcatggttttttttgggggggggtggtctatttgatttttttcagaaacatgagcagggaggggatgcacatatgccctatcgattagcctctcctcttgagtctggtgtttgtgtggaaagagttttcatagtttaagagagattgtgaggtttttgcaaaggtgcttggcacttcagtttagatgcgaagcaattattagggctctgagaagttcaaaagaaaggtagatgactctgagtcatctaccatatcaataaattataactggtaaataacactgttatccatagattacacattctaatgttaggaaaatgtatgaaataaatattatatgaacccaataggaagaaagagaggaaaacaaaccatgaacagaaaaacagaccatgtagcttttacagagaccaaacttggaagtgtaaaattatgcatgtatgttcatgtatatgagtttgtgtgctttaatgagacaaaatgagtggccagaattgctttattcagggtcttgaagtattcatgttgttaatttctgcaattgtttttaggttttgagagtaatgcatatattctaaatctcatagaacatgcttctgggtccatcaacattggtgcttccttaaattaaacctcttgatgggggttttcattattattcaacctctaatgagtgttgtcttcatgctagatggtacgtgggaaaaaagaaacccatattctttttggtaagagagaatgctattaatttacagtgcatatatttatacctgaaaacatgttccagaaagcagtcacggccaatgtgttctccttgctctgggctctgcttaaaggataatcattttatctgtcccactgtttggttcttatgttcaaatgccagaaagttttttaagagttagacagagctgtaactcaaataatcacatttaatccagcttcgtacttctattttcattaacctattgtatattaactcaaccactataccattgctataccaataattgtatatacatttatagataaattttttaacccactcaagcaactcatatatgaaatacaggtgttatcaaccctcataatattttttgtaataatttttctgacatatgttgagaccagtttgatgggtctcctgttctgcagcatatagacaccagcatttctacagaggttaaaacctagaagaaaatttacagaccatcaacactctcacttcacaaataagaaacctggggaccatcaaggcagaagaaaacccagatctcttgactttagtccagtccaacaaattgtactaaacagatttaatagttaattcttaacctggtaagggagaaagtgtctgagacagctctcaatcaatttagaggtttattttaccaaggttgaggatgcaactgagaaaaagagacctaggttgcagtagcatctgtgatctgtgctttttccaaagaggtgtttgaaggcttcaatatttaaagggggaagagcagcaggagagaaggaggaaagaaaaaaatagggagggtagggagtaaggtaagtggtcactttcttgtgagggtttgatcagtactcactgaatccacatgttatatgtaaaaggaggggggccacatggagaaatagtggccttctgtcattgcacctatctgtttaggtacaaaagggaaggcagtttttgtgtgacccagttctcaagtgtaactcttccttttaacatagtgagtttggagtcccaggattttattttcctttcacaggagagattaggtacttagcaatgactagctatttgaaaatctaaccttatcagattattaaccttgtctcctttcataaataacatgttaaggtaacacagaagcttaatactttaagctgattggatggcagtagaatgaatgtaattcaagtaggaactggaagatccagtgtgtcaggtttagaaactaggaggtggcaggaagcaaaggttaatgtttaccaatgatccatagtaagccaacagtacagatcaacaaacttaaaatgtgtgagaaaatacagggaattgaggtattttttgcttggaaaaaagaatttgattgtgcttattgccattttcgtatattttctgatgggcaaacaatagaatatttgccctcaaagccccaatggttgaaagcttcagagagtgatttcttggctcagtgtaagagcctgttggctgggcctggtggctcacgcctgtaatcccagtactttgggaggccaactggggccgatcacctgaggtcaggagtttgagaccagcctggccaacatagtgaaacccggcttttctaaaaacacaaaaattagctgggcatggtggcacacacctgcaatcccagctactcgggaggctgatgcaggagaatctcttgaacctgggaggaggaggttgcagtgagccgagatcgggccattgcactccagcctgggggacagagcaagactccatctcaaaaaaaaaaaaaacaaaaaaaaaaaacctgtctataaatagaaaataacttccactccttgggagataaaaagtcattctagtggtgtcagcacaggttggagaaatactttacagatatgttatggaagggacttaggcactgattttcttgtgtgtttgggccatcaaacgtgctttcagtcttgaaatcttgttttatgagtcaccttctagaaaagaggtaggaatatttttcggagtagtgtggctattaccatgtttgctgtattgaggaagcggtattctaatggggtttctagacctgcagacaactttgggaatggattttaattgcttataactaaaaatgagtaaaaactagtacttatatgcagcatcatagcagttaactcctttaccagaaggatatagattataatcataaactaatctacaagatttagaactactttacataaacacagttatagtttggggcatcattttattaaaggcatttgttaaatatatgattaaaaaataaagtattcttcataaataattttaccaaaatagcttaccccattgtattgtatttaaaactttcagtgagcattgagctattgttaaagacagataagttacagattcaagagaagggagcatagtgttagaacactggagtgattgtcattaaaagcagagtaaacaagattgttttggctaattcaataaggttagaaacagcaaaacaagggataatgaaccaagtgaggacaaaactatcattgcagattaaatgactgtatacttacaaaagcaaataaacttagttctaaagccttataattaataagaatgcagcaatgggcttaaacaggtaaaatagaaaaaaagcagtatgttaggttcttattttgttttgttgttgttaacgtttgagtgttttccattcccaattttgattatttacaatctacataaaagtccatggcatgtgtttatctgtaattttgctgaagggcaaatttgtatcttgccagtttttgtgccattttggtctgcaatctcttaatcagtgaataagtttcctcctgacagtcatgctgtataaaactttgcaatttaatatacacagtcatgcaactctggtgtaggtgacttgttgttatcttcattttatagatagtgaacctaataatatatgcctgaaggggattgggggggttgcagggattgagatcaattccttgggtctccttcagcttgatctctattaacaataacaatctgagagaaacgacgaaaaaatatttggttaattagctaataatatattttattcaaaatataaaaaatttaaagaaaagttcaaatgtttgctaagaataattcaaaaagacttaaaaagctaataacatataatactgatgaggttacagtgatatggaagttttcatgtgcaaaaggtaaaggtatgaaattaaaatttccctgaaagtaatttggcattatatagcaagaacagttctgattttcatctaatatgccctggcctggccctgctggttgttaaaaatattgaaattcttgataaacagctactcttcttccatattatcacagccccagatactgcttcagtgctttctcctggatatcccaccttgcctccccgccccccatctccagggctccagcaattggcctggccttgccagtccaggagggctgctaggactgtgctacagttcctcagcctgcatcctttctgagcacctgccacccttggacttgagctttttgtggtggttgttattgttgtttatcactgtttttaaaaatatcatcacagatcaagagtcttattccaatcattaattcccattatggaaattaacttaaaaaagtaagatttttgcacaaaaatttatggctcattttcagtctcctcacaataccaaaatatctaaaactatatatgagaccaacgatagtgaattttaagtatatttatatacgtatatattaactatactatagttatgtatgtatatattaactgtaatataatattacataattatataatatatgattatataatatagtattatacaatacatatgattatataatatagtattatacaatacatatgattatataatatagtattatatacaatacatatgattagataatatagtattatacaatacatatgattagataatatagtattatacaatacatatgattatataatatagtatatacaatacatatgattagataatatagtattatacaatacatatgactagataatatagtattatacaatacatatgatataatatagtattatacaatacatatgattagataatatagtattatacaatacatatgattagataatatagtattatacaatacatatgattagataatatagtattatacaatacatatgattagataatatagtattatacaatacatatgattatataatatagtattatacaatacatatgattatataatatagtattatataatactttataattatgtaatatagtattatataatactttataattatgtaatatagtataattatataatttagtattatataatagtcttatataataaatagtataaagtatactccatattacataattataataggtagtatacataaaataggtaatctattatattacatataataagtaatatataatatatataattggtaatacattatataatattcttatataatatactatataggcatactataatagtaaattgtataatatatagcatagttcatatatgtttatagtatagttatatatattatgtgttatatatagtacataatatataaagtataatttatgttatataagacaaactatatgtaaaattatatattcacatataaaatatatccatatatatttccatatataaagtatatataaatacaaatataaatgaattttacataaatgtatacttttatttatttatttatttattttgagacggagtcttgctctgtcgcccaggctggagtgcagtggtgtgatctcggctcactgcaagctccgcctcccgggttcacgccattctcctgcctctgcctcccgcgtagctgggactacaggcgcccatcaccacgtttttagtagagacggggtttcaccctgttagccaagatggtctcgatctcctgacctcgtgatccacccaccttggcctcccaaagtgctgggattataggcgtgagccaccacgcccggccatacttttattttatttatattatatatgaaagattaataattaaatgaattatttcacatgtccatttaagagaatatagtatagccactacaaataacacattaaaataaattttgatatattcatagtttaacactcaagagaaaggcaaaataatttatatacataataatctcacctagatagactaagaaaaaaattgatttgatcaatggagaaaaataaaagtttaggaagcagtgagatgtttcttttctactttttacctttctctatgtcctgagttttctgcattattaatttttagccagagagagaaaaaaacaaaactataattttatatacgagagatgatggtaaggactagacctccggcctctccttcatctccttcagctaaacagctgaagcccaaagcactgctcccacaagtgtgttttcctgacagtttttcttcagaagattttgattcacctgtaacaggttttttttttttttttgagacagagtctccctctgtcacccaggctggagtgcagtggcacgatctcagctcactgcaagctccaccacccaggttcatgccattctcctgcctcgccctccccagtagctgggactacaggcgtcagccaccacacccagctaatttttaaatattttttagtagagacggggtttcactgtgttagccaggatggtctcgatctcctgacctcatgatcctcccatctcggcctcccaaagtgctgggattacaggcgtgagccaccatgcccggtcctgtaacagttttatacctgtgcaaatatttaaagagcaatcccagctatgttgtagattagcagagcttttcttcagagcctatagattctcagtgcctagcaccgagtatacttcagctctgaggacagtgaggatgatgctgatcaagagaatggtggctatcctctgtttcttgaggtatttgttgtatcttttctgagttttccatcaaatatctgtacatttcagtcttcagcaccctttgaagcattttctctaagtttgtgttttgtagaacattttggttgcatgacttttcttagacttcctgatgttgcaaaaccctcaggcagtagatttcctgggccaagaaccagaagacacatgaaaacaaatggcaacacccttttgactaagaatttatatttataacccccttcttgaaactctacagctattttaatattttatactcatattttcatatagacagaactgctttaatactgaggtacccagggtgttggagggagatagagagagaaaaagagaagtaaagaaaagaaaggatcttgtcaggaatcttctgtctttcatattgcagttcacaatcagattgttctttctctggctgcaaacccacacctgaaattatttttcatctccaagcacggagttatatgagcaatcgctcttcctagaaaccattttttttctgcctgatattctagtagagggaacaaaaatgataataatcttaatgcaacatgtaatagaattaaatttttcctgctgataatatatattttgatatgagaaaagaagcagggataggctgaaatcgaatggcaggagatatggccacagtctttaatcccctattttcttgacctgcagattgtctcattcggggaagctccagggttctcaagcggaattcgtgtttcattttgtgtagcacccgtcagaaagacaagccaggcatgaggatccatgatgagcgctcttctgagttgccatttggagctgcccgtttagaaagcaaatctgcatttccctcattcctagtttccttcatcctcttttaagtgtcatcttttccatgaagcctactagatcacacagttgaaaattgcaaagtcttcacaccgcagcttcccctttctttgttgctttggttttctccgtgggacttcccaccatccgtaaaattaggtgtttttgcctgttttattcactgctacgtctccaatggttagaacctgacatttagtgggtgctcaataatatttgttgaagtaatgtataataacttcactttcttgagtaattactatatatcatgaactgtggtaaattatctccatataatgcctgtaatctttacaacacctctaaccctataacataaaccatgttatacccattttacacatatgcaatttaaaggacagagagacccacacatttgcataggataattctagtgaataagaaatttgcgttcttttgtctctctacaggcttcttcttattattattatcactattttgaaacagagtctttctctgtcacccaggttggagtgcagtgccgcgatctaggctcactgcaacctccgtctctcaggctcatgtgattcttgtgcctcagccacccgagtagctgagattacaggctcacgccaccacgcccagataatttttgtatttttagtagagatttcaccatgttggccaggctggtcacgaactcctggcctcaagtgatccaccagcctaggcctcccgaagtgctgggattacaggcaggagccactgcgcccagccttaattttttcttttcacgatttttttccattttaaattaaatgcctttggattttaaaaaatgcaacattcctctgctatcttattaaacgtatccttgaacttcagggagtggagaataggtgtctggaaaatgagacactgcttttctttgtttttgaacttaacaagttccacattcagagatctcaattacatgcccttcattgaatgtaagtgtgatgcatttaacatacagcttgtgtgaaagcaggatattataaccacaaacatatctgactttaaaattaagtaaaatactcaacatagcccagaatggaaacatgggaattaattctatatctgtggcagatctgagggacacggtggtaccaaaaattgagatttacagagaaggagatttttaataattcagttttcattaacttcccaaatcagaaagccagcatattctgtttggtaggaaattacacaggagtgaagaaaaaaatccacaattcagctgattagaaaacaagttttcattaaactaaaatttattgaatttttaagcaatgtatagccagctagcttccaaaaatttgctcatcgatattgcttaataaaaagtgttttctttccctttatatgctgtaataacataaactgcctaagtgctattttggaagctgaatcatagaggggctaagtgttatgaaggcttattattttccagacactttgctagccacttgacatatgtaatcacattttattctaatggaaactctgtggggacttcctttaaaaatgaaagagctgaggttcagatattttgaggctcagatggtttaagatgcatttcatcaagtaatagacggtggagccgatctccaagcccaggttggatttttcctgaagcgcatgattttttcctattatcccaaagcctcatccataaatatcatgcagaacctatgtagttgctcattatagagaaagttctagagcctaaagtagtccaaagtaagtgacccaaaaccaggaagacagttaacagtagaatacacagacttgcccaaggggtatatcctccacatcctccacaaagtatttcctgctcttcttcttggactcagcctcccctgtcctcactacagtcactaactctgcttttgtattttcactgtttgccctgaagaattccattataccattgttgtaatttattgcacttaatgtgttttatgtttccgattaccaatctgtacatttttattctcctattgtatatttttatacaatatacatatagtgtatacaatatatattgtagggaacaaaaaaaaattccccctcaaccctcatgaattcttagctgggatgggtccctataacaaaagatagattaataagagggaaacaaacacgtttattaacgtgcagtgctcatcatacaggatacactccaaggaaaagtaactcgaagtagtggtttggaactctggctcatagagcatcttcaacaaaaaacaataaatttgtggggaaatgacaggacaaaggaaaattattttaggcttccaagggagggaaactgtgggaaggtaaatatatgggtggaaaatatgagtaagtttgtttgcagattcctctggtgctgtctctgggacggtaagagtttagagttgtctccagtaaaggagaatttataacctgcccttaggcagaagagtaggaggatagggaaaattttccttccatttgctgcttcttaattgcctttagctcaaaaacaattttcttgtcaaagaggcagatgtcgaggtgacctattctggtttccctcaatatattactctttcttgcattgtcatggagtactataccctgaagattaccgtattgctaagtattgatctgatctatggattctgactgttacagaatactgagtgttgtgcatccaccacaatttttctgccttataactttccatctaactcccttctatcccaagcaatgctgtagtgaacgtggttcagtatctccttatccacccatgtgagaatttctttggattatgcatttttattacattctcaattcagaactcctgggtcgtaggttatgcatatatttaatacgaataagtattaccaaattagtccccatagtggctgctccagtctatattctcagtggcctggatgaagtttctctatctgaatatccctgacatcacttagcattctttagctttctgatgttttgcaagtccaacaagcatcaggtgatattgtattgccattttaattttcatctctttgattattaatgagtttgagcaatgtcaatgtgcctattaactttttaagaaattatctctataagcccaacagtgggcatttcctggcatataatggatccttagtggatgtatgattgaaagaaagacattatagcatgcaaaattcccaaattagtctcaggctttgatttttgatacttgttggttatctcgaaatctgaacactaagtaaatattggaattaagtttttgaggtaattaactatattaatcagttgtcctgattttacagtcgaagattgttggtaagtttgacatagggaaattaaacttaaaaaaatcataaaaataacattttttaaaagttaccatatgatgtaaggagtgactgtgagttatattttcccattttgtagatgagcaaatgagttcaggagagatttaaataccctatgaaaagcatgcagaattctggtagcactataaggataaataaaaagattgggccatttggctagggctggcatgagttaattataatcattatgtgattaataaaacatttgacataccagcaatcatgtcatgaagttctattctctgcctttgaatagtagcaaactaggattataattttataatgacagaccagtttaagatagaagagacatgacacgtaagactctcagcttctcactatctgcctaaaacgtgcatggacaaaattggtgtgtgctaaaggcagtgccacaggaaccgaaactaaaaaaaaaaaaaagattaagaatgtataaaaccgctctaactccatcccttgactgccttgggatctcaaatagcagaaatgtatgtccatcaacaatgcaagtggaagtgtatgtctaatttaaagccgtgtcctaagaataggatttcacataatgtgctagctaaagcgtagagggttggtagagcttttgttagggatttccttgcagcctatcttcacatcctaccctttaaacatgcttttttaaatgtaacagcagagcacctagaaaacctatttttccaagttgtgacttctctctttcctacatacttttattcttctagtcatccaagtaactatcttactagtagcagtctgtgagtctgtctatgcattcatgcatccatctaaccagctgtctacctacttatccatattttttaagcaataaaaatttcattttgtagcctcttttactagtgcacttgcccagaacagacagtctcccactcagaagaccagttctttgagtcaccagataaagttcatatatgatataaggtatagtcacatcttcagtatactaacatttactataatacagcaatgccttttaaaatcaaatacacgtgattttacaaaaccaaatgtaagcctccaggatgtaagagaacaacttgcattataaagtatccttgaacccaggaggcagagcttgcagtgagccaaaatcacgccactgcactccagcctgggcgacagagcgagactccatctcaaaaaataaaataaaattaaaattaaataaaaatgtttaattagatacataatggtaaatgtggtactagtgttagtggtaaatatggtaattagcgtagagaggttaaatgattacagtaagctaaaggccaaattgttgttaatttgagttgttttatatatgttgataaatgccttggaatagtcacttgcatacaaaataataaaagaaaaaatttagacctgtagtaattagtcagggttctctagagaaacagaaccaacgagattatatatatataatataaatacaatttatatatatataccttaatatgtaaaataaggaattagcttatatgattatgaaggctgacaagtcccaagatctgcagtcggtaggctggagacccaggagagcccatggtgtaagttctagtctcaaagccagcaggcctgaaggcttgagactcaacaaaggctgatatttcagtctgagtctgaaggccagaaatgaccagttccagctcaagctgttctcttctggtcttggattgattggatgagggagggcagtctgctttactcagtctaccaattcaaacattaatctcatccaaaaatgccctgacagacacacccagaatcatgtttatccaaatgtctgagcactccatggcccagtagagatgacacataaaagtaaccatcacagaaaggttttctaattggaagataaacacttcgaaaataattaatttgaataaatttttatagaaacatttcaaattatagataaaaaaagaaaattaaaaataagctataattctatcgccattagataactcttgatttgaatttggtgcatatctttctaaacattgtatattgaaatgaagtgctgtgtatcccattgatttatgctgatacatacttggatttgcccagctttgctaaaattacacacaagggatcaattgagaaaatcagttacatcatcatcacaagcacagaatgaaaaatcattaatttgccttgctattcacagaaggggagaaaagaaaaaaagaaagaaaatactatgatatgtttgaatagagtttgtttaatcatcaaaattatttctctatttgtcacagaaaatgctgtagcctttgtttctttagggagaaacatttaatgtcatttcttaatagggcttttgttaacccaaacagctgttggtgtgtatgtatctaaaggccttagggggtcaaaaataagtagccttcaatcatcagagttatgaccaagcaatggtcatgagaggtcacatgtgggaagagactgactataaactgagcatgtattgccctactccccttaaatgccattttctggatctcaagtttaagattcctagaaagttttgcaatgtacaataaaagtagattgctgcttccacatttttttcacttacccctgaatttgttgagaatttctgaattatttgactcaagtctagtttactttctgccattattttgacacattagtttggcttgtgttctctctgaaagcatttgtaaggcattccatacctgattctggaacatagtcataacattgtgggtcctgctctgaaggattcagttagaaaggacaatggccactttttttttttttttttttttttttttactttgaatctcttatactgatggcttatggttctatagggtatagtaacccctcatatgcctgcaaagattaatgatcaaatcagctcagttattcaatccagcatttaagtatccttagttctttttaacaaacttgttggaagcaagcctttgctagtacatcatataaatgaagaagagcaataatttagatcaggaaagacaagtgtgttttatctgtgttgccaactccagtcaattgatgggtagttagtgtctggaagattctcatgctgcttctgggctctgtgggaaagaccactaagattaccagctatgagtggtagagttttagatgtgtaggagttagccagctgaagtgaagaagtgagggagacctttttaggcagaggagaaagcatgggagaggatggtacgtaaaggaaagagggtagaatgcaagcaattcagggctcctggagccgcaaaattcagaatataaaactgtgagtgatgagaataaggaccaggccagatagtctatgtttagtggagaagcttgaccttcatccattttatagtcactagaagattttaagcagggaagtgataggtttgcttagcagggtttaaaatggttatcatggtaagtgctttgaggaatacaagaccagaggtaggctgaccttttaggatattattgcagtattccaaatgtgaataatcttgacctgaataagagcacagctagtagggacagaattgagaaagtaaacttcttgatggccaggaaaggaagataaaggaagaagaaactttgagtgatgatggatagcaaacagcatgggtgaatgtttcaagaaaagataatactttaaaactaaatgttaaatggttaaacaagactataatatgacagatctgaactattgacccccctttttttaaacaggcaagaggattatatacatctttttgttggccggacgtggttactcacgcctgtaatcccagcactttgggaggccaaggtaggcagatcacttgaggtcaagagttcgagaccagcctggccaatatggtgaaaccccgtctctactaaaaatatgaaaattagcctggcatggtggtacgtgtctgtaatcccagctacttgggagggtgaggcaggagaatcgcttgaacctgggaggcagaggttgtagtgagccgagattgcaccactgcactccagcctgggcaacagagcaagactgtttcaaaaaactaaaaataaatatttttgtcattgttgttttattttaaagaaaggttttttaaaggaagtttagggtttgcagataaattgacagcaaggtacagagattttccatacaacccctgctctcaagcatgcattgtctccccattatatatatattccctcccagaattacaatctgctacaatttataaacatccattgacatataattactagaagctcatagtttactttagggtttccttttggtgttgtattccacgggtttaaacaaatgtataaagacatgtatccaccattacagtattatacagagtagttttactgtccccgaaatcatctatgctccaccccttcacatccacccctcagcccctggcaaccactgatcttttcactgtttccataattttgtcttttccagaatgtcatctagttgaaatcacacagcatgtaaccttttcatattggctccgttcagatagtaatatgcatttaagtttcttccatgtcttttcatggcttagtaactcatttctttcttgtactgaatgatattctattgtctgcatgtaccacagattctttgtttgtttgttcttttacttatcagtttatatgctgaaggacacatcttggttacttccaagctttggcaattatgaataaagctaataaacatctatgtgcagatttttgtgtgactgtaagttttcaactcctttgggtagaaaccaaggagcttgattactgaatcatatggtaaggttatgcttcgtcttttaagaaactgccaaactgtattccaaagtggacccaaagttacctttcccaccagcagcgaatgagagttcctgttgctccatatctttcccagcatttgttgtcattagtgctctggattttggcccttccaggtgtgtaatggtattttgttaatgttttaatttgcatttcattgatggcatatgatatgaaatatctctttatatatttatctgtcatctgtatatcttctttggtgaggtgtttaggtctttggcccaattgttaattgggctggttgttttcttatcgttgagctttaagagttctttgtatattttggatagtaatcctttatcagatatgctcttttcaattattttctttcatgcttgtcatctcattctcttgacattttcttttgtagagcagaagtttttaattttaataaagttcagcttattaattacttatttcatagattatgcctttggtttctatttaaaaagtcatcgccgtacccaaggtcatctaggttttcctctgtgttatattttaggaattttacagttttatgttttacacatagttctatgattcattttgagttaatttttgtgaaggatgtaaggtccttgtctagattcatttttttgcaggtgggtatccagttgttgcagcaccatttgttgaaaagactatctttgctccattgtattgcctttgctcccttgtcaaagatcaattcactatatttatgtgggtctatttctggtctctctattctgttccactgatctatctgtctattcttttgccattaccaggctgttttgattcatatagctttatagtaagtcttgaagtcagatagtgtcggttctccaactttattcttctctttccatattatattggagattatgggtataaattattttttaaaaatacatgtctgctatttctgagggatactgaaaagcaaatcatgtagaatacaatgtcaaggaatattttattttatgattttatatcttatggatatgtatatatacccacacatatttatatgtacatacatatgtatatgttctgagggaaaaactcaaactttttcctctgctctcacaccacaacaatcaacacagaagacttctgtgaccaaatgcatgagttttttttttctcccaacaccaagcagcagatacttccaggtatcttccaattcaattcaattctgatgctgtctccctgaaaataatgtcagatcccacaggttgagggctcagtcccacaagactgtcccctttcagacaccagttgcaagtttgggcctccagaatttctcagtagccagcttcaagttgaggtttccacaacccctctttgggtttgattaatttactaaagtggttcacagaactcagggaaactggcttaatttgctggtttatgataaaggatgttacaaaggctacagatgaagagatgcatagggtaaggtatgagagaaggtacacagagctttcatgctctgcctggatatgccacctgccaggatcctacacatgttcactatctggaagctcttcaaatcctgttctcttgggccttttatgaaaacttcattggataggcatgactgaagcatggacaaccatgtagtaatgtgattggatgaaaaggttataatctaatgctgataggctgagtgggaaaacccagtgaggcctatctgttcagattcttcttgatctctctgtgcagcattaattcctctaggatatgggacaggacctcctctgaaatgaggtcttatgaccctcaatcacaaaggtggaaacatgttatagtcctgccttgtataggtgaaaggttttctgaggtctgctcctgaggccaaaagcaccataaaattataataaaagactattaacaagggctatgggaatcataagccaggagccatagataaaaacatatagatatataaaataatatcacacacatatatcgatctatgcatatacacacatttctataaagatacatatatgtatgtaaatagatagaagtagatatttatatagctagatatagaagtagataattgtattatttattacatatatatcacaataagaaatactatacttattataaaaataacacagggcggggccaagatggccgactagaaacagcagcgtttggaggcccccattgaaaaaaaacataagcttgtgaatacttcaccagcaaccaaggcatccaggttctctcatcagaactgactaggaggttggtgtgacccacggagagaaagaagaacagtgtggtgtggcagcccacatgagagccacatggagtgggggagccccctccccccagccaagggaggcaatgggtgagcgtgctttttccacagaattgtgcaacccacagattggaagatcccactcgcgaacccacaccaccagggactagcgtcccaacccaggaatgcacagactcttagcttctcggttggaaggaatctgcttaagcctacggaactcctggagggaggggtgaccagaactgggtgtggctgcctgctgtcaaagctatttgagctccttgtgggaggagcagcagccagtactgggatttgcatctgcctaacacaaagctccctgggcaggggaagggaggcatccatctctatagccccaggctgtgcttttcctctgttggagacagggaggctggacggcttggtcccaagacttgtccctcacagtccaacacatctgcttgcagtctgtggccagagtgcctcttcaggcctgaccctgacccatccttcctcattgggtgaggcttcccccaccaactccagtaacaccagccagaggctcagggacagaacctgcatctccctggtcctgtgtccctagggggagggatggctgcagtctctgtggaccagcagacttagcctttcctcctggtagttctgaggaatccaggcagcccagacaagtgggttccccgcaagtgaggcactgtgttaaacaggttctgttccccatgccacccaactgggtgagaccctccaatagaggttgtcagacaccctatacaggagtgctcctactggcatcaggctggtgcccctcaaggtcagaagtcccagaagaagaagcaggcactcatctttgctgttctccagcctctttgagtgacatctccaggcacagcagcgaatcagataaataggtcctgaagtgaacccccagcaaactgcagcagccctacagaagagggacctaaccattgaaagaaaaaaaacaagcagaaagcaacaacaacagcatcaacaacaagaacaacaaaaagtctccacaaaaactccatccaagggtcagcagcctcaaagaccaaaactagacaaactcacgaagtcaagaaagaatcaatgaaacaatgctgaaaacccaaaaggtcagagtgccttttgtcctccaaatgatttcaacctttctccgtcggggtaacagaactggagggaggatcagatggacaaattgacagaagtaggcttcaaaatatgggtaataaaaacctacactgatctaaaggagcatgttctaacccaatgcaaagaagctaagaaccttgataaaaggttagaggaattgctaactagaataaccagtttagagaggagcataaacaacatgttggagctgaaaaacacagcacgagaacttcctgaagcatacacaagtatcaactgatgaatcaaccaagtggaagaaaggatatcagagtctgaagacaagactagagaaaaaagaatgaaaaggaatgaacaaagcttccaagaaatatgagacttcataagaagaccaaacctacaattgattggagtccaagaaggagatggagagaatggaaacaagctggaaaacacacttcaggatattatccaggagaacttcctcaatctagcaagactgccaacatgcaaactgaggaaaaacagagaacatcattaagatactccacaagaaattcaaccccaagacacataatcatcagattgaagattgaaatgaaagaaaattgttaagggcagccaaagagaaaagccaggtcacctacaaagggaaacccatcagactgacagacctctcagcagaaactctacaagccagaaaagattgggggccaatattcaacattcttaaagaaaaaaaaaattcaacctagaatttcatatccagccaaactagcttcataagcaaaggagaaataaaatcctttccagacaagcaaatgctgaggaattttgttgttaccaggcctgccctgcaagagctcctgaaggaagcactaaagatggaaaggaaaagccaggagcagccactgcaaaaacacatcaaaatataaagaccaatgacactatgaagaaactgcaacaactagtgtacaaaataaacaaatagcagcatgatggtagggtcaaattcacacataatgatactaaccttaaatgtaaatgagctaaatgtcccaattaaaagacacagtctgacaaatcggataaagagtcaagacccatcacccatcagtgtgctgtattcaggagacccatctcatgtgcaaagacatgcataggctcaaaataaggggatggaggaaaatttaccaagcaaatggaaagcaaaaaataagcaggggttgaaatcctagtctctgacaaaacagactttaaaccaacaaagatcaaaaaagacaagggcattacataaggtaaagggaacaattcaacaagaagagctaactattctaaatatatatgcaccctatacaagagcacccagattcataaaacaagtttttagagacctacaaagagaggtatactcccagacaataatagtgggagattttaacaccccactgtcagtattagatcaatgagacagaaaattaataaggatattcaagacttgaactcagatctggatcaagtggacctagtagacatctacaaacctctgtaccccaaatcaacagaatatacattcttcgcaatgccacttggcacttattctaaaatctacgacataattggaaataaaacactccttagcaaatgcaaaagaactgaaatcataacagtctctcagaccacagtgcaatcaaattagaactcaggattaagaaactcactcaaaaccacataattacatggaaattgaacaacctgctcctgaatgactcctgggtaaataatgaaattaaagcagagatcaagaagttctttgaaaccaacaagaacaaagagacaacataccagaatctctgggacacaactaaagcagtgttaagagggaaatttatagcacttaaatgcccccatcagaaagcctgaagatctcaagttgacaccctaacatcacaattaaaagagttatagaggcaagaacaaatgaatccaaaagctggcagaagactagaaataactatgatcagagaagaattaaaggagatagagacccaaaaaccctccaaaaaaaaaatcaatgagtccaggagctggttttttgaaaaaattaacaaaatagattgctagctagactaataaaggagaaaagagagaaggatcaaatagacacaataaaaaatgataaaggggatatcaccactgaccccacagaaatacaaactaccatcagagaatactataaacacctctacacaaataaactagaaactctagaagaaatggttaaattcctgggcacatacaccctactaagactagaccaagaagaagttgaatccctgaatagaccaataacaagttctgaaattaaggcagtaattaatagcctaccaaccaaagaaagcccaggaccagatggattcacagctgagtcctaccagaaatacaaagaggagctggtaccattccttcagatactattacaaatgattgaaaaggtgggactcttccctaactcattttatgaagccagcatcttcctgataacgaaatcaagaagagacacaacaaaaaaaaggaaacttcaggccagtatctctgatgaatatcgatgggaaaatcctcaataaaatactggcaaaccaaattcagcagcacattaaaaaaaattatccaccacaatcaagtcagcttcatccctgggatgcaaggctggttcaacatacacaaatcaaaaaacataatctatcacataaacagaccgaaagacaaaaaccacattattatctcaatagatgcagaaaaggcctttgataaaattaaactactcttcttgttaaaaactctcaataaactagatattaatggaacatatctcaaaataatgaaagctatgtatgacaaacttacccaaccaatatcatattgaataggcaaaagctggaagcattcctgttgaaaaccagtacaagacaaggatgtcctctctcaccactcctattcaacatagtattggaagttcttgccagggcaatcaagcaatagaaacaaataaaaggtattcaaataggaagagaggaagtcaaattgtctctgtttgtagacaacatgattgtatatttagaaaaccccatcatctcagcctaaaaacttcttaaactgataagcaacttcagcaaagtcttaggatacaaaatcaatgtgcaaaaatcacaagcattcctttacaccaacaatagacaaaaacagagccaaatcatgaataaactccaaatcacagttgctacaaagagaataaaatacctaggaatacagctaacaagggatgcaaaggacctcttcaaggagatctacaaagcatttttcaaggatataagagaggatgcaatcaaatggaaaaacattccatcctcatggataagaagaatcaatattatgaaaatgaccatactgcccaaattgatttatagattcaatgctattcccatcaaactaccatcgacattcttcacagaattagaaaaagttattttaaatttcatatgtaatcaaagaagaccacatatagccaagacaatcctaagcaaaaggaacaaagctggaggcatcatgccacctgacttcaaactatactaaaagtctacagtaaccaaaacagcatggtactggtaccaaaacagatatatagaccaatggaacagaacagagacctcagaaataacaccacacacctacaaccatctgatcttcaacaaacctgacaaaaacaagcaacggggaaaggatctcctattcagtaaatggtgctgggaaaactggctagccatatgcagaaaactgaaactcgaccccttccttacaccttataacaaaaattaacccaagatggattaaagacttaaatgtaaaacccaaaaccataaaaaccctagaagacaacctaggcaataccattcaggacataggcatgggcaaagacttcatgacaaaaatgccaaaagcaattgcaacaaaagccaacatttacaaatgggatctaattaaactaaagaacttctgcacagcaaaagaaactatcatcagagtgaacaggcaacctacagaatgggataaaatttctgtgctctacccatctgacaaagatctaatatccagaatttacaaggaacttaaatgaatttataagaaaaaaaaagccaccccatcaaaaactggacaaaagatatgaacagacacttctcaaaagaagacatttatgtggccaacaaacatatgaaaaaaagctcaatatcgctgatcatcagagaaatgcaaatcaaaaccaccatgagataccatctcacgccagtcagaatggcaattattaaaacatcaggaaacaatagatgctggcaaagccgtggagagataggagcacttttacattgttggtgggaatgtcaattagttcaaccattgtggaagacagtatggagattcctcaagaatttagaaccagaaataccatttgacccagcaatgggattgctgggtatatacccaaaggaatataaatcattctactataaagacacatgcatatgtatgctcactgcagcactatttacaatagcaaagtcatggaaccaacccaaatgcccatcggtgatagactggataaagaaaatgtgcatatacaccatgttatactgtaaagccataaaaaagaatgagttcacgtccttcacagggacatggatgatgctgggagccatcatcctcagcaaactaacaggaacagagaaccaaataccgcatgttctcattcataagtggcagttgaacgatgagagcacatggacacagagcggggagcaacagacaccagggcctgttgggggttggggttgaggggagggaacacagaagacaggtcaataggtgcagcaaaccaccatggtgcatgtatacctatgtaacaaacctgtacattctgcatatatattccattctttctcagaagaaataaaaaaaagcacagaatgtaatcgcctatgagcacagtggtattatttattgtccaatgtagggtactttagagaattagttggaaagagtaggtaaaataattaaaattattataatttttgaaatttgtatgcattgaacaaatttctcatattagtaaatttatgaaatgttcttttttaaaaactacttccaaaactaaaattctgctaatgatattttattaaaaatgaacaagttaggaccaaaaaacgaaagcagatggacactaagacaacaggtataaaatggaaatgtccctgacaaacaagtatggtcaccctacttatgaggtcagaaatagattttacgttctaattgactcttaaggaaatagttgcattatcacctcttcttaaacttaatttatttttgtcaggaatccagcacacatgagcttatactctagaggctgttatgcaaaccaatggtttccatatgtcaattgtgattctagcattgtgtcctctatcagtgccccagggagagggactgcctggctctgaacatgtcccagactgtgctagatatattttgccaaccaggccaacctgaaatgtcaaggtccatctttggaggagagctcatcaagccctgaggggatataattgcatttcagttatctttttcaaaatgtcgaatttgagatcctcataattgataatttttcatttaaaatgtatggctaggttaatatgaggcaagaacagaaaattttggtctctagtcttttgggggcaagctggaatctatttcccattagcccacagctattcttaccagccttttgtcttagttgtctttttttcccttcagaatagttgctgaacagaagaataaaaggcttttcatgtctttttagcatttgtgatctttctacttcttagttgaatgagttagaagaataaacattgtagatttagacaaatgtgacttaaacttcaggtatatcaatatcccttgaatgtcaacatactcaaatcacctaatccagttgggaatattaataatatcatggaacttgctgtcaggattaatgagatgttccaggtaaaaagcctagcacagtgtttggcaaatagtaggtggccaataataaatggcagctatagtcatcagtgaagaaatacatgatttcaagtaggtagggctggctgtgaagaaaattgtcacataagtgacttcatactctatttcagcttccttcccactctccctccttccctccacacacaccatgtacgccatctcctattgtcagtacttgggactctcatatgcacctggaccactgtcttttcccagtctagcatcttctgttcctggtttatcttcctcatctctttccttccagacctcccagtcttatgacctctgcttttgcttcctgctatgtgcagccttggaaagtttctgctaatgtcatttatgccaaatgttaaagactaacatcattttcctatgctaatcttgccaggaggtatttccattttagtgaaggtcaacatcataacctaactgaataaaagtgcaaaacataagttggaggcatcagcaagagggagagaagagatattttcaaatagatgtactcaagataacaataaaaataatgaacagctaacatttattcactgccaactttattttgcactgtgcattatatgcattacttcatttaaccctcacaactaataaattaagtactattattatttttatttttctaataaaaaaaaaaagaagcttggagaggtaaagcaaattgcccaaagtcgtatacaccgagtaagtgaagaagacaggtttaaaactcaagtccatctgacttattgtcatctctcttacactaacccttacaggctgaattttcaccagggcagggattcttgcttggaagtcctgccttgctcaatattctaagaaatctagactgctagtagttccaaatatactcttttattttctgtgtgtgcatctgtcatcttgtcccctgtacctgcaatccctcacttccccacagtttctgggctaactcccacttaccctgggagtgacagagttcatgagtgatcttcccccatgaagcatcatcactctggcatcatctctcgtcctctccccatatgttctcttccctcttcctaccttgattcaactgagccagggctatttctgtgtctgtgaacaggtaatagtgtttatgagggcagatatctgacatgtttttcttctttattttacctgacatatgcttgtaccctttatttaatctgacattttttttgtactcttctggcctagcctactctgccagttctgaggtgcatttttttttcgtattttaatacctctgatattgttatgctctccagttgataaaatcttaaaattataattgacagtggcttttttctaacttggtgaaacaaaaataagggttaatttccttctacaatcaacagcatctttgatttgatgaaatatagtgatagatgttaaagatcatgtaaacgaatggatggcactcacagccctccttgagtcacattactatgcctacttagaacctagctgccctgcatcatggcagggcagcagttgaacattattctttatttatgttaggctttcctagtaaaggtagggcagataataaatcagctaaaattgtttttaatcatttcttgctggaatgatgtgacctgtcccatatgtttatcttctaggtgaaattgatcttcaaattctctccaaagttcaggctcaatacccaggagtttgtatcaacaatgaagttgttgagccaagtgctgaacaaattgccaaatacaaaggtacctgtaactcctggtcctctacaccagatcctatcccaaaagacttaactcaaattgttcccttgaatgattaaaaatatagttactgtggtatgcttttcacaagcttattgggagaagaactgaattagttcttggcaggcatgactaaacatctcaaaatgtgaacagtgaataataaactcccttttctattaacacttcatccattccccagttgtcatcaatgattaccttttgatgtttatgcttaagtacagattcattcattgatccagaattatttaaaccaaccttaaagagcttatgtttagtgggttacagtaaaagttcacaaacttttcctggcaaaggccaaatagtaaatattttagattcagaaggtcaattcagtctctgccataactaatcaacctgccatgtgccacaaaggcagccaaaaagaaaaataggtaaactaacaagcatgggtgtgtttgaataaaactttatttgtaaacactaaaatttgaatttcatatcattttcacatatgaattagcatccttcttttgtttttttaaatcattcaaaaatataatgacgtgaaacatgaatggcagtgacacaaagtcaggaagtagaacgatatatgtttttagcttgcggttcatacaaaaataagtagcaggctagatatagtccctggactgtagtttgtcttctcctgaattatacaaacatatctgtttccaattcactttccattgataaaattcaccagttgattcttcattaatactaagacaatataacctattctgcccagggttcttgtaattatttcttcctgactctttctttcacctctaatttcattaaatactagaaaccaaaaaaagcagtatgaactctctggtctcccagacataagaaagaaaaacgttctttctatctgtttgtatataacattgattgcattaaaattctaaatggaaatggtttccacatttgcaattaaaattgatggtgtgtcacctcttctctgtattttagagcttgtagccaagacatcgaacctcgagaacgtaaagtttgcttggcataaggagacatcatctgaataccaaagtagaatgttggagaaaaaggagcttcaaaagtgggactttattcatatgattcaagtaagaaatatgtattataatatatactcagaaagaagacttttcagaatatatatataatgaatatctactattctaatttttaaaaggtaaatgaaaatcttctgatttctaattttacaagtgaccatgatctgcccaaataaaaggtaaagatgtttattatactaagattctctttaacattccaaaaaccagttttctctaatcaaaatacctctacaagttatccatttttaaaaatgttggcttaattcttatttcttttttgagatgggagtctcgctgtgtcatccaggctggagtgcggtggcatgatcttagctcactctagcctcaaaatcctgagcttaagcaattctcccactgcagcttcctggttagttgagaccacaggtgtgcaccaccacacccaactaattttttattttttgtagagatggggtcatactatgttgcccaggctggtcttgaaatcctgggctcaagtgatcttccctcttcaacctccaaaagtgttggaattacaggtgtgagccactgcacccagtctttaatttatttttatatcattggatgtttatatagagatttgagaatgatagcatcataacatattctctagtggctctaatggtttgggtggaccaatgtcccagagtgtttctgtagtggacatatggtcgaaggggcaggttaaatgatgcctcagttcaataaatttttacttccattatccagatccgacaaactgactcatacatgttatagaaagggagtgacgcaagaacaaaaaaccaaacaccgcatattctcactcataggtgggaattgaacaatgagaacacatggacacaggaaagggaacatcacactctggggtctgttgtggggtggggggaggggggagggatagcatcgggagatatacctaatgctagatgacgagttagtgggtgcagcgcaccagcatggcacatgtatacatatgtaactaacctgcatattgtgcacatgtaccctaaaacttaaagtataataataataataaaaaaaagaaagggagtgactattgagtagatagcatggggttggatttccagagataactaacatttctgaatagcataagggatgtatgggttttggaagttggttaccaacgggaaatgtacgtattttggcaataccacttgattaacgacaaaacactatttttcttcctggtctacaatgatagtcaccccaaaagaataaacttacaagaagtcaaaggaagaaatactccaattgtgtcatatacaggcaattctatgtctctgcttctttagctgatgaaatcttttgcctgtcaggtagtacttatcactgtccaggatgccaagatatttctctaccagacttgcttttgttcccacttcctcacataactatttcataactcccctgtctccttaccactcctgcaatctctcccagaccattcgttctgagccaatgacctcacttcataatgtatagagaaaatagaaactgccagatactcattttttaccctctaactttgcaaacataactgcatttgtgcatcatctccttcttccatcttattgcaaaaacctcctcttatcaaaaaccactccctctgcttaaccctggatcccattcttttctctgttataaatattgtgatttcaggaatcagcttctctttcctatttctcttaaaacttccatgtttgttccttctttcttataacaactctgtttccctctgaatctctatcctgttcctctctctccatctctgtctatgccccatttttctgtgcagcgtctctgcctctctattactcattatagtcctcacactcttatgatacttttacaacctcactgtcaattcagaaaatttcactgtctttgagaaaaatttaaggtaatcttctatggcccacttccacatttctagccaggtcatatcgtagattgttagccatcatattgattcactatatttgggtacctgcctatggtccctgtggtggaaaatgtggagtgtggcccctaaggcaccatgagccatgcacaggtcaggtccattttatttcattcattcatatgaaagaggcacagctaaagtacttttcctttgtgcaatgaattctctaaggacaggctatatggaatattgaattcttgtccaacaaagatgaagatgagatataagaagtgtctatgggggtggggtccaaagatgcaagccatggggaaaaatttcccacgtcaatgcataagtccaagttctgtgttgggtggaaaggcctgtacttcactagagattgatccagaattattaaaaatgggtgtcctgacccctaaacaccctgtgaccaagcagataacctcatgctttatttagtccaacttcctacagaatctgtcatcatcagaggctgtcacattttctgtgattttaaaaaagcatctgtgagcatatggagaagctagtgcaaagggcttaattgtaaagtaacgttccatgaaatggggtctgtttttatggtgccagaaccattttctcccagaagaactgcaattcacgaattatagaataggcataggattcatgtccccatgtggaatggtgactaagtgtctccagctataaatgtctgtgctatggaagccagaaagagtaaatttaaaaccatttgactctagtcgaacaaataccatacttttccatttccccaaatattttctcacattattgttctatgtcttcatgcaacgtctttaatctttaaatttcttaagtgttttcttgggtaaaaattcactcaactagaaaatcaaactttctaggagtatctagcccaagcaataaagacttcaacatacagaagcagctcatttctctttttcctcctttctagatgctgtattatgtaaaagacatcccagctaccctgaaattcttccatagtctcttaggtaccaatgctaagatgctcattattgttgtgtcaggtaagttattttcattcagcctgaattttaaaacagcaataatacacgtatgcatggattcctgtgtttgaaagaagcttatatattttgtcttcattatgaaattcttgccttggcctctaatcatagccaattaattttcacagtattagggaagtcattcacaacagttctcaatttagaaggtatagtggaattaaacatctgtctacttctttcttttgggaaaatatgcctttgtcttctatatatgaatcctttttatatagcttaaattcaactgacaaaagattttaaatgagactaaaaatagtaaacatttattttacctacttcgtgtcatttgagtgtttcttttccctctatgatgtttattaataaataaaggttaaactatttcagatgtcatcatttttaattgacttgcattcttagagccatgatcaacactgcttgctataggttttttcaaatgcctatcaaaaacagttcatttgttttgttttgtgttggtgttttattttccaaggaggcatgtgagcatgtccagttgctgccagggatttagtaagtatcacacagagaacccaagtaaacatttttagataatgaaacattgacattgttgaggacagtatttattacttctttcattcagcaatctttatggattttctaccagtacttacaggttgattttagatacacagcagactctgtcttcctaaggttacaccagaccccatactttaacaccatatgtcacaaaattgacttgttcttaaatatgaagaattgctttaaagatggcaagcatggttatagcttgtaatcctgggtttgaccttatgtgaaagtttggcaatagagagctcctgtacacaacctctcctgcaagggaacatttagatatactatttttatctctatttagttaaaaatactcatttatgtgggagaggtctcatttcccatttagaagggcttatggaaactggactcatcctactaacctctctctgagctagtaaagcactataaactgcatttagaattgcaaagtaaacttagttatcaacattgtaggcagcctattcttgattatattcatcaatcatacagaaaaagtattgtagacggaaataacaattcattgagaagtcatgtattttttatcttagaatatatttcatctcaatagtaggtctaatctcttatttatatttggcttattctaacatattttcagaaattaagtatctgagcacccagaagttagctttctataagtatatattaccaataagacaaagccagcctgaagtttagaagggagcatgaatagtccacaagtaactgagaactgattaagtgcccttatggctacagtattctgctggctgtatcatgaatgaattaattgatgattattggcatcaagaaatttgaagaccaaaataaacccaatgaaatgtgttgtatgttaatacatggtgcaagaatactgaggcacttttaactatgtgaatttggtctctgcatctcagtttattcaagggctatttctggacaaccttatctgcattatattacatcttttcatatatgtggctcataagtaccatctgtaaataagcattcatcataaaaaaaatcaaaagaaagggagtaaagactcaacaatcagttagctttttttgaaaagtatttttagtcaaaaattatttaaccaaagtatttgatgatggaaatgttttactcactttctcaatatgcagttaacaattcttcattactgcttatagcacaggagacagctgttccaaagaggaaaacattgttaatagaatgcaacgaataacatttgacagatgattaaagagattctgatgatctccttcctttaccatatcacttcttctgagaagagatttacacagctatagccatctatttcttcctaaaagaaaaaccacttcacaaaagtagaagaaagatttcgatattttatttggggctttctacgtctctctctcctaagcctaagaatgtcttggctttttttgcctctatttgtcagaatgctaagaaaataaataaattaaatataagttaattttttttaaaacctacttttcccaataatgaatactttgcagtgaaaaataattctacctgaaaagagaaatagaattgtgaaatatgttgatcattgtcatcaatttagtagaactggaatgtccccagattctccaatcctatcggcatgtcatacttaactcttaaagatccagagtaaatgatggagttctcatttcaagtaacttgggtaatccatcccctcatcatcactcctttactcctgagggttcctgggggtcagacttaaatgttcctggtgattgccatccactgtgtgctccaagttcaacttttgatttcttctccccaaatcttgcatgtgctgcagccgccctttctcatcttgtttcacattgccttaaacatggacatagtcctacctccttccttctccaaaacaccattcttgcttttgacagattttgggacctgtgggggagaaagaggaacaaagaacagaatttagcattaaggtcccaccgtgactctttttctcacctttctcttgctcaatctggacacacttccgttgaacctgctctcataacttctctcagtcttccctcatatcctcttagttcagtgctaagatgccacctcctcattttctattgcaaccctcttttttaacttttattttaagttcaggggtacatctgaaggtttgtcacataggtaaacgtgtccggggggttgttaaacagattatttcatcacccaggtattaaacccactacccaataataatcttttctgctcctctttctccccccaccctccatcctcaagtagacctcaatgtctgctgtttccttctttgtgttcatcagttctcatcatttagctcccacttataattgagaacatgcggtatttggttttctgtttctgcattagttttttaggccaatagcttctggctccatccatgtccccagaaaagacatgatctctttattttttatggctgcatagtattccatagtgtatatgtattacattttctttaaccactctgtcactgaagggtttttaggttgattccatgtctttgctattgtgaataatcctgcaatgaacatttatgtgcatgtgtctttatgacagaatgattaatattcctctgggtatatacccagtaataggtttccaaactatactataggggggtacaataaccaaacagcatggtactggtacaaaaacaagcacatagaccaatgaaacagaatagagagaccagaaataaggccgcacacctacgaccatctgatctttgacaaagctgacaaaaacaagcaatggggaaaagacttcctattcaataaatggtggtgggataactggctagccatatgcagaagactgaagccagtctccttccttatactatatacaaaaatcaactcaatgtggcttaaagactacctaaaactataaaaacctggaagacaacctaggcaataccatcctgcacataggaacaggcaaagattctgtgacaaagacactaaaatcaataaaaacattggcaaatggcatctcattaaacttaagagcttctgtacagcaaaagaaactatcaatagaataaacagacaacctacggaatggtagaaaatatttgcatagtatgcatttgacaaaggtctaatatccatcatctataaggaacttaaatttacaagagagaaacaaccccattaaaacgtgggcaaaggacatgaataaacaattctcaaaagaagacagagatgtggccaagaagcatttgaaaaaaagctcaacatcactgatcattagtgaaatgaaaatcaaaaccacaatgagataccatctcataccagtcagaatgactatttattaaaaagacaaaaaataacagatgctgatgaggttgtggagtaaaaggaacacatacattgttggtgagaatgtaaagtagttcaaccactgtggaaagcagtatggcaatttcttagagagctaaaagcagaactaccagttgacccagcaaccctcttatagagtagtttaaatcccttttgttctatttctatcacctagataaacctgtgcacacatgaacttgtcttaacaacaacacatttccctgagataaattgttttgcccccctcagtgtatgatgagggtgatggtagtttcctattttaaaaaaatagcaatagttgctttgttgtattaacatacccaatagaaatatattggtcagcttttggaaaaatagatcaagtctagtttccaacattggaaacaaatttgatcacaagaaatttccaatcagacattttcatattgatgtcagtgaacacacataggaatgatccacaaaattactactcattgttttctttcaatgatgtagcttcaaatccctatctgctagactagtcagtggaaagaaaacaagtttgagaaacctcatcagccgaggtgttccatctacatccctccttacccctgtttaggaaccattgcctagcttgccttctccaccagagctataattctttaaaccccatttttcatttactcaacagattgaaacatttcctaaagttgaatattgacccagaacttggaatgtctataccacattggtttacactaagttctgtttttattaagattctttgggtcactttcttaatggaatttgcttcataattacctaaaagggaagatgcttctgtgtatgttcatttgtttcagggtaatattgtcatccatagctgctctccaatgcacaaaactgagtactcatggtatatagggaggcatatagggacattcatctctgttcctacatctttgtaaagactttggcacagagacaatacttagtaaatatgttttaattgaactgaataattgtttattatttctgccttatgatatcagaactacaataagctctgaatatacatccaaaaaaaagagaatatatttcagctaaaactgacttgacgaaatcagagaacacaggaagttctggatatttgcagatgaagtttaataaataggaataaaaggctcaataaaaaagacacacgcacacacacacacacacacacacacacacacacacacacaccaaatggaagcagccagacaaaagcaataaagaacaaacaactaaaactatttgtgtatttttagggaaagaaaaagaaattgaaatcagaattaaatgacaacatttactggtcagcttatggaaatatatgttgcttgatggaaatcaacctttcctctgtgtttctaaatatccattacagaattaccctaactcaagagactgtcatttagtgataactagtagaagttcctgataatggagatgaaagaaatttgatttggggataaaaaagaagagatataagaacaagagagttggatttctttaaaaaatgtggagtatcccacactaaaatggtatcaaagaaaagtttttttctgcaaatgtgatagccaagcatcaattgggagggttgctgtttaaaaggcagcctgtctggttaagggagatgagccagaaggagatcactgaagctttctgtctgtcctctccttacctgagtaaggaaggaggaaaatcattgtgtgttatttttagtgcagtgagaaaaagaaaatctggcttacatcatgttgaaaacaaaagtaacaccatatgttgtgcccaccgagagccattatgataatgcattagtcgggaagtgcataattgctcagctcagaaatggcaccgagtcacagcactgacaccagcaaattttttgcaattagtgtttggttcttttttctctgccaggttaaaaataataataatgatgataacagagcctctcttcaaccactgaaatgctgattttcttgtaatgtcttgtttgccggcaaactcttatttaggaagacaatccactgtctttggaataaaagatttttaaataaatactcacaaccctcatttattttcattgaacagaggttttattctttctgcttcattccaattccaccttctcctagagcatatcctgcagttacctctccctcttctgaaatataagtagaacatcaattatcctaggctatttattatttagcctattatttgtcttggttcatctcttgagttaaattagatctgggaactttagcttaatccatgcatgagcgccaagggtctttgagcattctataatcttatgcagaactgtgtgggtatgtattgtttgtgtatttttctggagagtcagttactctcactagatcataaaggggacttgggaaccaaaagtatctcaagacatttaatcctagaagcacaaagaaagtataagttgtctcttatattgcttttgccaaatccagtttaacacttcagtaacgttaactattgtgtcatggttctaagggtctttactttattaactcagtgaatccttgtagcagtctataaatggattatattatcacccctgttttacagatgataaaactgagacacaggttcataaagttggtaagaaggaaagccaggcttcatactcaggcagttgggttttagagaccatgctctttattactgccctgtactgactgtgtatgtaatatgcatgtattagaaggcccataaatagaaactcattattattattatagatttctgaatagcaggcttgcttttttagtctcaagaatgcaatcagtggaaatacactagcaaactaattcatgtattttataagcacttattacacatctttcatgtgcgtaccattacgcaataattcacttaaattatctcatgtaatgcttgtagttgcattcaaggtaagtttgataatccccattttacagatgaggaaatttaagttctgagaggctagataacaagcctcatctcattcataaagcatcagaagaagagttcagctcatgtctgtctccctcagataaggtattccgtagcttctctgcagggttagaatttcagtttagtactacaaacattgctaaaaggtcttctaaacttggggacaagatttatagaaatccacctagttattgtcagtccaaggcagcatctttttttatatagagatgagagtaaaaaatcattgatttgagtaaatcaccatttactgtgctctttctttccattttaattttcactgttaaagattcttgtctgaattccagactaacaactaccttcctcatatcaccacctgaatgtccagtaggtatctcaaatttatattcctgaaaccagaggcctgatgatacaaaactgctcgtcttcattcttctctccaacaatggcaattctgtcttctcaggcgccctcacagaaattactggggtcatcactgattctttctttttacccatatcctacatccaaattgttggcgagccctgttggatctcggagtataacacataaaaactcccaccacttctcttcacctcccagctcactggtctgtgggacccacccccacctatcccccaggtgattacagtagccttctcgctgttctccccacctctgcccttatgcgccagtactctcttcccatcggtgaggccagggtgaccttattaaatgtatattgagtcattctaatgtgctgttccatacagaaaccatgttttagtagtgaagttgaaactgaaattaatttaaatgaatgaaacttaaaattcaggtcttcagtaacacttgaaactcaagtcctaagccacctttcaagtgctccatagcaacaagtggtgagtgacaatcctgctggacaatgcagatatcgaacgtgtccattggttcagaaaattctatcagacagcattacagtggtttcccattgggccccaagtgatctgggcccttcatccactccccacccctaatctctccaacctcatctcttttccctctgccctcactcattcagctccaatttcactggcttcctggctagttctttaatgggccaagtatcatcctgtattcaggtcctttgcagctgctcatctctctcctggagtcatcttccccctgatatctccatgtcttgctgtcaggtctctgctcaaatgtcaggttattagacagactctgcgaccaccctagttaaaacagcagcccatcaaagtctttaaccctcttagcatttactcagattactttttcatttagcatttatcaccatatatttacttatttttctctctcctcctgtactccttgaaatatgagctgcacaaaggacaagattattattttgttctattctaagcatctagtgtactttctggcagactgcaaatgaaagaaagaataaatgaaagcatgacttgtgttttattgcacaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcttataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccattaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcttgcactgtatgataataccaaaatttgggacagtcacatactaacttttcagatttgttcttgtgtttcagaaaaaagtgctcagcatgaatttggaatgttgttttatgtatcgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaacttatttaggactctttcagacacttttttgcatgtattgttggggcatattgccaaaacccaaagagaaagcatgatgtggagcacagcattttagggcttgatatttgcttattataaaaattggtgacttttttatggccctgccattctgggccataaaagttaagtaatttctaatgcacatccataaaaagagatgcaagggccataggagaatactagatcttaagtctgtggaactgcacagacccaaatgtatatttaatgtattttaaatgtttgtttaatgagaatagctggcac

SEQ ID NO: 12643 - DNA, 21168 bp, Human
tgaaactgtcttgcttaacagcagatttgagccaacagagcacagaactggaagataggtcaattgagattaaacagctgggaagagaaagaaaatgaagaaatacaaacagagacttggggacactgtcatgcatttccacataagcataatgagagtcctaaaaggagaagagagaaagtcatagaaagtttaagaaagagtggccccagactcaccaaatttgatgaaaaactttacacatcctagaagttcaacagtatagggttggggtttatttttggggtgctgaaaatgttctgaaacttgatagtggtaatgattgcatagctctgagaatgctaaaaaactagtcaatcatatactttagtgaattttatggtatgtgaattatatctcaataaacctgtttctttaaaaacaaaaaaaggaggagcatgatatttatgtagggatggaaagatctccaagatatatattcaattaagaaaaaggaacttcatggtgtatatagtatgccatgttttgtaaggagggagagaaaaatttgtcatcattccatcttacattaacaaacaccgtaaggattctcaggaaactaatagatatggtcacccagagaggtggaaatgaaatgacggtgtggtttacagtgacatggatggaagcaaggctttgcattgtatgtcttttcctgtcagtttctcattttcttaaatccctgtgggaatttagtggagaaatctcatagggaatctagtgaaggaaataggctacaaagaagtaaataagtattttcagaattttccttacctgtgggctattttgtttcatgaattgatgtttattaacgtggcccaatatgtaggagataaaggccgtttgaacacctgaaatctattgtgggtaggcaatttgcagattggcttcttgttcaaaaatttcagttcaagtgagagacattttagatgctgaacacgttttcttgtgcgaacaatgcaatgagggatgagtgagtcgatcataaatgatagattccatagtcagatcacaaaagctgaccacaatatcaccgaactgtattgtaacaggaccatgagtatagaatggacttaaatatgtactgaactgactaatgttttttagagtttaagcatctgaaacaggagttggcaaactatctgtaaatggccaggtagtaaatgccttcggttcaacgggccatactgtctctgttgcagtgatactataagcccacctttgtagcagaaaagcagccacagacagtatgtaaacatctgggtgtcgctgtgttccataaagatttttacaaagcaggctctgagtttggcccgtgggctgcaatttaccaactcccgatctggaatattgattagaggtagagaaataaatgtattccagttcttaacaccaagaatacatcttcctttgttctgtcaatgggagtgtcagaagaacagatagtcccaattctatggttgtggtggcagcatggatatcttttagggaatttatcttaggtgtcagtgctgaagcaaaaatctctgaagtatgaatccttgaaggagagagatgagctgaaacttgtagctgaaagaggaaactatttgtctgagtacctagtcccctgcattcccatctttaccacttgccatgctgccataggacgcggtagggaatgacactgaaatggaattccatctgggcttgtgccacttagcagcttgatgacctttcctgggcctcagtttctctaactgagctttagcatccccatacatagtatgaagagattggactagagatgatatctaagatcccttctggctctaaagatggcatgtaggggattctgatagcagcagatgtactgcatatgactgttcttaaatcaggaacttgagatatagtgtttctgaaaaatttttgcctggaaaaatagagacatggtaactaattgtcacacatgcttattttttaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaaggtaagaaatgtttttacctattttctaacgattaaagtaaaaataacaatatgatatatttctgagatttttagattaagctgattatatgtaaccattaaataaaattttggagaccaaccacaaatgggttagatattttcatgagggttaatccctgctctccttcccttagtttaagcaaatctaactttttaataaaactataagtctagtatcgtatcttgctagatgcatattggagcatttttatgctgatattgatgagtaaataaatgcatacatttatgtaattattttaatatatgattttcacaaactgaaatgtgtttttttaccatgttttgttttttggctagataggggattcaaactcagtagttttaaagttgtttacaatcatttttaaatttcggttgtttgtacttgtcagtgactccaaggactgaacagcaaaaagaaaaaatagagaggattggggatggaagttaattaggaaagaaatggttattccataaatagaagtttagaatgcagattttggaggaaggaaaaaaggtttcagaatttgaaatacttattgcattttctcagtacaaaaggaatgattttcttacatacctatttttatgtatttaaaattttaatagaaacagtttggaggtaagccccttcatgtaaaagagattttaaaaatccagtccagaacagttttatgctagttttgtttaacatggattttgtgatttttaagtattggaaatttcactttcagaatcaagtccgtcgagagattaagtttactgtccaggcattgccatggataagtattcttactgttgcactgttcttgctggagataagaggttacagcaaattacatgatgacctaggagagtttccatatggtaagtaaataacacgagtgtcaggaagagagtagtctaagcacaggttagtttccttaaaaaaacaagtctgcccttttttttttcatcttttaaaataattacaaattattcagttgttttttaatgttctattttcatgtgttcatgtcttgccacatgtgcatttctttagtttttctatcaatctgaaagtctgctgtagatgagattgtgtctggcggaagattggagtgatcagagatgggtccttgcatttgttttctattaattattgaattcaaccttctaaaaaaaacttgagtagcttatgtcattgctgaaagttaaaaacagatttttaaaatgcattattctgcttcttagaaactgtaactcttctggcatacaaccacccacttttctgtgcctgtatacttcattgtttacattacacaaatgaagtcctgaggtgcatagtggtttgggctctgaattttgtttctcttagcaacttacatggttgtattttcatgtcaaaaaaatcttgagattatgtaatatattagtcatagtactgtgcggatattcataagttatgtaaatgatacctaattgttagaccttcagattgttactcttttttgtattataaacagccctgtagtgagtaaacttttgtgaaattctgaaactttttcaagatacatttctaggatctagtatgtaaaaagcaagaatcatagtatttattgaaggctgatatgtgtcagtgacagttctcagctcttcacaagaatcagtccattgttttcctacaattctatgagataggtactatcactgtgctccttttataggtgagtcaatgaggtgtacagagagtttcagtaacgagttggtggtagatctgagacttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggcgacagagcgagactccgtctcaaaaaaaaaaaagaaaaaaaaagtcagttattcagaagaaggaacaaaaaattatatactagagtaatgaattggctgggctttgaaaaatggatatgattatgagttaaaataaagggagagaggacattttaggttcttgaacccctatgatgaaagatacagaggtaaaacttccaagacagtgggaggacattgagtaaacctgcctggttagagtagaaatacaggagtgatgaggttggaaagatccgaaaggggtggagtatggaataaatgctaaatttaaagtatttagtggaaagtatattttaagcagggagataatgtgtaaagatgggttttaggaagattaatatgaaggaagtgatgattcccagagatttaaataataaagatgtcttaggagtatcctgtctcacaaatatctttatagtttaattaagaagtactttaggtagaacatttcaagtacttatgcgagggaaatgaggaaatgaccagattccaagaagccaagagagattagtttataatatactgaattagccagaacagatcatttataatgtttgagtctaggatcccattttgcactcagatggacatgtgaaaagtgaactctaatcccaggagctgagttttgattcttctgtttcccgttttcttttctaggattgtttgaacttgtcgttagtataatatctttcctctttttcactgacatgttcatctactggattcacagaggccttcatcatagactggtatataaggtaaagtcatttgtggtgaaaagagaaaaaaggttacacatttcagcaatgtatgattataaattctgttctctatttccaagaatttcctctacccatattaaatgtctaagtagccataatcataacaggtacagggtgcattttgttcatattcttctttatgggtctaaggggctgtcttaaaattcgtctgttccggtaacaggtacacatggacttacagagggaacaatagacattagagactccagaaggtgggaggatgggagaggagtgagggatgagacgctccctattgggtacaatgtgcactcttcaggtgctaggtacactaaaagccagacttcaccactgtgcagtatatccatggaacaccactgcacttgtactcataaatccatataaaattatactgttttagggcgaagaaggacattttatagaataaataattttgctgatctctacaggatttgttaggttgtttccaacatgagtgtgagaagctaagttgaatgttgcacggggtaaagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtatcagttgagtattatagcagcacaaagtattctttgtacagattttgtgccaatttgaagccacagaaatgatgtggattgttaattgtgttttagaacatccccggacactcagtgtcacagggggaaagaagtgggtaccacattctgtttatatttcacattttaactagatttgagtgtttttagcaagaaatcagtcttaaaatctaatgtctgggatccagaagaaaatgtctttaatctgtgagttattgtcacaatgtcatcttatttaaatgtaccaattagcattttgtaataggcaaatgtcatttagtgcttttcaccaatcccactcacccccggtgctccgccttgcctaagaaaaagaaattaaggagaagtaaactttatttcctaatataatgtcagctgatatttattgagcttttcctctttgcccagagactaggacccaaagaagttaagtaactattcccaggtttatttctctctcatatgatgtcccatgtggatgtttgtggtcagtggacagctttccacctagtctttctgcgacccaggctccttcctcttggggctctgcctttctctcagtccatagagccctctttgttgaaagagcacataggaaaagaaggaaaagtctgtgtggaaaatgtttctgggtcaggcctggaagtggtgcatatctcttccgcccatgttcctttggacagaactccgtcacatggcccacctagagagattttgggaaatgtgtccagctgtgtgcctgggaggaagggggcaccattttcttgagcagctagacagtttgccgtatttgtggtgttctcctcttgttgatgttgaaatggtgaatgagccataaagtatttcaggttatccacacactaatcatctcagtgtctttaattcttaactccaatatgaatgtttaaagcttcctctagattcttattcctatataactaatagagaagaaaggacagcttcctatggggaagacagaggcttcctcatagatgttaggaataatcaaacttgcccctgccctttcacccgtctcaaattctggtcttttaaagcagcgttatgttaagtagtcctaacattgtaatatacagtactgccacattctcctactttctattagaggaagtcagagaatatttatggaagtgaggacccaaattaccttctacagatgacttttatagttacaggacagaaagtgaaaatcaaggttacgttttctacttttgtggtagaaattgagaagtgggtggatatggttcgagaagacctttcagaaacacagagactgagtctttgtcttccatgctgtctctgcagtactgagtgaatttccttatacccttgtatcatgttttcctcccatcttctagaagctggggacagatttggaagagaattacacaagttcagttttttgatacatggattttacagtgcatgcaggttatttatgtagagaggaggtctgggagaaagatggaaactagggagatgactgagaacaaagatatttgggattaacacagatagaagaaaagtttgaaaccatgagattgtcacagcatgaaaaaagatattcaaagacactaaccaacttgaggggtgcagtggtctgaatgtgtcctccaaaattcaaatgtggaaatgtatttgccagtgagatagtatgtagaggtggggccttgaggaagtgattaagtcatgagggctctgggattaatgacttaaaaagaggtgtgaggcagctgttcagcccttctgtctcctgtccctttttttttttttttttttgagatggagtcttgctctgttgccccaggctggagtgcagtggcgtgatcttggttcactgcaagctccacctcccgggttcacgccattctcctgcctcagcctcccgagtagctgggactacaggtgcccgccaccaccacgcccggctaattttttatatttttagtagagatggggtttcaccgtgttagccaggatggtcttgatctcctgacctcatgatctgcctgcctcggcctcccaaagtgctgggattataggtgtgagccaccatgcccagccccttctgtcccttctaacgtgaggacccagcaacaaggtaccatcttgaaagcagcaactggggactcagcagacaccaaaccaactggtgcttaaccgtgacttcccagcctccagagctgtaagaaaataaatttctattatttatagattacccagttgaagatactttgttaaggcagtacaaatggactaagacaagggggaagaaatttgcattcctgatcttcccaacttcttcaaattcacaacacttgaatgacagtcttatttcagcacttactgctatcacctattacttttatgtgtgtcttacctatttgagatgccagattccttggaagtagagaccgtgtctgaatcatcattgtattaaaccactcatccttaacaaatgcccaagccatggttaaagttcaataaatactttgttgaatttattaataaaatggcagaaatgtcattctcttccatatatgtttaataaatccctgataggtgctaagcactgcactaggtaaaaattctcttctgatgctgtctttttggccaaccatttttttatcatttattcattagctgacatttgctaagtgctttggaggggtcaaaaggggaagtaatgagaaatcaaagatggtccctacatcaaggataaactatctttttttagtcactcaaagtcataaccctttggaaacaaaacccaccagtaccccagattttgaccacagatgaatcagtactacaaggactggttagagggttgaatgaatctgtatactcagcacttaacacagcactctgggtaaaagaaaaaagatcctcaaagatattagttggttacatcaagaaaggacaaacttaggttaatctataacttcatctcagaggaacaggaactttggagataaacagggctctgccacttgcaagttgcaccatccctggtttctccatctgtaaattgattaaaacactgcctatctaataagattaaataagttagaagcattcagttaaatgtcaactgaaactattgttcatgtaaattgtgcttgatgctttttctttctagattcaatgattattgtcattttacctccataggccctcaatagaaatcagttgcagagggcagaagcctagatattttcaccttaaaattggagggtgaaagacattgaggtgaagtagagatagagggtacacagaaaaatcgtataagtaaaactaacatcgttaacattatttactgtaagttatctttgtaagagtggtaaaatacattgtgttgttaaataatttcatttaaaaaatgcatcactttgtgtgtttttatattgctaaaaccataaggccagtctacaaggtttgtagataaaatagaaacataccttccttgaaaagcagaataaattttttaaaggcaggaaggaagtgtttgaaccatgtgtcaacaagctttactgtcaaagcaggcttttggtatgggaagaaaaatacttataaatacttgttttaatatttgctttattaaaatacatttaaaatacagcatttttaaatctctaagctcaacttgaagatataagaacagtaaatttgataaaaatgagaaattacattcccatttctttaacaatttgtaaattccaattatcctgaacatttaataccatttacatattttattaatcacattttcttaaacatttgataagagatttaatattttgatccaactaccaaaaaagcagacttgtgtacttgacagatttttctaaacacttcacaactcacgattcaaacaaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacttgcccccctgacatgtggtatgaaacaaatagaaacctagaaatttagtgcatattcaaatattaagacagacactggtgtggtgacttttgtctgtcgcttcattgggacgttttttctttctgatcaacttaatgaaattataatttactataattaagtgtagccatttttactgtagagttcaatgatctttgatgaacgtgtacacccatgtaaccaccacccccaatcaaagtaaagaacattttcttaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtatacaagtctttgtgtggctatatgttgttatttctcgttggtaaatatctattagatttgctgggtcatagggaagagatatatatgtatacgtttaattttataaaacactgtgaaactattttccaaagggttgtaccattttaccctcctgctcccaatgatgagaattccatttttcccgcatgttcactaacacttagtatcgtcagtccttatttgtaaccattctagtgggtgtgaggtagtgtcccactgtggcttaatttgcattttcctgtgactaatgatgttaagcaccttttctcctgctttttttttttttctttttcaaactttttatatcttttgtaaagtatctgtttaaatctttggccattttaaaaattaggttgttttggtgttattgacttataagattttgtatatattgacaaaaattctttgttagatgtatgtattaccaatatttactccaatttagcttgtcttttcatttccttactatcttttgataaggaaaaaatgtttaatttttattcagaccactttatcaatttttatctttcataactattgcattttctgtccaacctaagaaatctttgccaatcccaaagcaagcctggaatttcctttgtgacaaggtttttgataatgagttcatttcttagaagataaagacttcatgttttcctctcttcctttctcaattctgatacattatttttcaagaaattgtttactacatttaagtaataaaatttttttgccataaagttgtaacattccctatttcccttttaatgcctataggatcagtagttatatttcctatctaattcctgatattgatgatttgtgtttgctctttttcttgattagtctgagatgaaattaattttattgattttttttttttttttttttttttttttttttttttgagacagggtctcactctgtcatccaggctggagtacagtggtttgaccacagctcattacagcctcaacctcccgggctcaaacaatcctccctcctcagcctcccaaatagctgggactacaggcacgtgccagcacacccagctatttttgtttgtttgtttgttttgtagagatgagttctcactatgttgccagggttggtcttgaactccaggactcaagcaattctcccacctcagcctcccaaagtgctgggattacaggcgtgagccactgcgcccagcccaatattaatcttttaaagaaccaattgctatgggctgaatgtgtcccacaaaattagtatgttaaaacttaattgccaatgtgatagtattaagagatgtgacatttaggaagtgattagatcatgagagctccgcccttgtaaatgagattaatgtccttataaaagaagctatagagagctgacactccagttttcctgttccttctgccacatgaaggcacagtgttcatccctcaaccccatccccaggggatacagcattcaaggtgccatcttggaagtaggtactgggcccttgctagacacccaaccagctggtgccttgatcttggactacccagccttcagaactgtgaggaataaatttctgttgtttataaataacccagtctcagctgttttgttttagcagtacaagcagactaagacaccaacttgtggctctgttgatttttctctattgcttgtcttcaatttcatattttcttcatttttttttttttgagatggagtctcactctgtcgcccaggctggagtgcaggggcgctatcttggctcactgaaacctccgcctcccaggttcaagtgatttctcccacttcagcttcctgaatagctgggattacaggcacgcaccaccatgcccacctaatttttgtatttttagtagagacggggtttcaccatatttattggccaggtgggtctcgaactcctgacttcaggcgatctgtttgcctcggccttgaaagtgctgggattacaggcgtgagccactgcgcccagcctcaatttcactaatttctgctcctgtatctttctttctacttattgtgtatttaagttgcccttttttcccctagcttcttaagatggaagctcagatcatttatttttttctttataaatgtaaacatttaaagccacagcatttcctataaggactgctgcagctgtatcccacaaattttgttatgttttcattattagttcaaagcattttttatttctgatgggatttcttctttgactagtggtatggtgggcttgtattgtgttaccttacctgagccagagctctgtttcccagaattacttttatgcatagttacaggttagcatggctacaatgggatgggggtatacaggctacacgagactaagatttagaaggtggaagtggagcagtagccatctttctatgcttgggaagacggagcggtccacaaaaacacttgcaatccacccaagtgttgtcacttcattggcctgaggcagcagctgcagctcctttctgatcctccttcagcttctccaaattccaggcctgatatgtgtttaacttcatgatgaagggctgcaacctctgatgcaggacaacgccacctcaaagttgaggcttggagatggtgaaagaatgaccagcgggccagtctaccatcctgagttgtcctgctcaaccttccaagttctggtttgttcttgcctcccccacctcacaatcattatctttccttcctgacatcctgctcttcagactcctgattccaacaccagacagaggaaaagtcatctcacgtagaccatgtaagtagcctccacagttgcctgtggtcagatctctttcactgatggaacaccgataaagaatttggcactgaaagtggttccagcgattagaaacttacaaatgtgttctctgttggtcctgtgttatctgcaattggttttcttatatgattacattttaagtcaatgatcttgtttgcaatggtaaagggggtattggaagtccaccatgtgcacaaaaacagcaaaacagttacttaaactatcacctatagatacttgtaatcatgtgccaatagaaggcaaggcttgagaagaacaggtgtttgctgcatagactgttttagtggaaataaggtgtatggtaagtttcgttgattgcttctaagtgtcctgaggaacttggacaaagaaaatgatgagcttatgactaaattctcagattagggtcccattaaggaactccaaagcttctattactgccctataataaaccctgaactcctatagttgtaatgccgagatttctgaaagccacctcaaagtttaattctgccggcagaaaattgagcctcccaaatttactgagttttgcatgttaaagttatgtcaatgattgggaaggagtgagactctgaaaatgagctagggatatgaaggtaaatttctatgaaactggggagcttgaacctataaattctgttgagccttccttgtcaagagaaaattacgtagtaggcaaggtgtattgggggagcactgtttagcagaaagaaatatggcataaaattaacatgggttcagatacttgttcttatgtttagggattaagcatttccaatattgtaaatagctgccattattgaatacctgtttcatgtaatgtattttgcagagacgtttacatgcattgtttcatttaatcttcccccaaaaaacatgggcaaattctttacattacagatgaatacacctgagactggaaaggttaaggtaatttgccccaaattacagagcaaattagaatttggcaaaatcagaatttgaactcgggtctcaaactcaggtctgtttcatttcacagcctgtgattatgcactggggtacactcctataatgtaaagatgaactgaaataatatttgcaaagctgtggttgccactgtttttattcattctaaccctggtaactaaagccctatttcatattttacttccctcaggtgatgaggatcttcaaaatctgttcaactctcagtactctaaacctctttccctaggttgaagcctgtataattcatttataggtaggggtgaagaactaacatattaactcttcaagaacattttatggaatcacaaaaggttagacctatctaggatatcaaggatcatgagtttgaccttttacttgcagaggaagaaacaagttcaaagagagaagttgaattactcctatgaataggctggaataataactctgttgagaaggttaagagaaggacaaaacactaaagcaggtgttcccattccccctaaaggaactgtgctaatgatatcatccagggcaacttcaattgtaaactctgttgcagtgctggagttgtaaaaagtaaccccttgatgagtgtgaaatcatcaaggatttcactggatagttatggataatccttacaaaattccattgttctaagtcccatcctacaggaaattaaggaatctgtttatcagacttctgagtgaggagctagcatgggaagttcccattcccttaggggtgccaggcttccagctacttgagtagcaattagaaattggggccagacgcagtggctcatgcctataatcccagcactttgggaggccgaggcgagtggataacctgaggtcaggagttcaagactagcctgaccaacatggagaaacccatctctactaaaaatacaaaattagctgggcttgatggcacatgcctgtaatcccagctactcgggaggctgaggcagaagaatcgcttgaacccgggaggcagaggttgcagtgagctgagatcacatcattgcactccagccttggcaacaagagcaaaactccgtctcaaaacaaaacaaaaaagaaagaaaaaagaaattgggtgtttttagatacggaaaggcctctgtaagggcccagccttagaacttaggactaagaatggggacttaaagcagcatggaagtgttttctctcttcatcttcctgttttcctttctcagtcattcagtcctaaagccatcaggttgggtcaggcaagtaagacgtccacattgttgatggccaagtggaggagacccagcaggttgaggaggacttttgtgctttgcacactgtttagtatatacatattacatttcaagataagtacaggtctaaaatacagatctaactgatctttagaaataatgaaggaagaactcatggggtgccgtttcagataaggtggtctaggaagccctctcagaagctaacatctgagcagagacttgaatgaagaggaggaacaggccacatggcatctgagagaagagcattcagggcagatttttggtatgtctgagaaggaacaaaggggctacctcatagaaacttggaaggttatagaaatgggaggaagatgataatgaggacaaaggtgagaaatgtcaggaggccagaagagacaaggtgtgttcaggtgtcttgggacacagaagagtgagcagaggggctgtgagtgacggagaaagaatgtgaggtgtaaaagttgaagacagcacagcactgcaaggttgggtaattcctggaagtagagaaatcttctgatctatatcttatggtagtcagagcgcctgatcttggtggtcactatgttaactgcacagctaacatcctcttccagtctttgttccccacgtgacaaaggaaaggccaaattttctgtctcctccttttctcatggagtggcatttcctattagacattaaatatttgaatgaataattattgataactctataagacactgttattaaaattatagtcactttgaaaggctagatgaaaagtaagtctagattcttggggaatattcactgttatggactctgaaattgcatctttccggtgggctttttcctcccctgttctgtttgttttgttttgttgtttttcctggctgaggctgagcagtttctaggatcagactgtaggtggagcagttatgcttttcacccgtgctgtagcaataaaagcagaagcatccacatttcatgtctagacagaggacgtgcatggaatcataaaatcttcagactggagggatccagaaaggtcatctactccctcccttgtctttagaaaattgtgctcctaaaccagcctggtggtgatgcatcctccctgccatgttcctttcaactgcatttaaagctccaccatcccattcctggccatttattttaggctcaacacaacaacaaaacacaaaataacagacttcaaatataatcaagtatgtgtgtgtacacacatgccttccccgtgggacaaaatatcaccctgggtactgcagggtctggatagttctttacattctgatgctttagtaaatgttatctatggattctcgtcaaacattttgtttatcttaggttaagatttccttgtgttttaggccctgatacagagggggaaaaacaccaggtaaatatctttacaaaaaggcaggattgaaagtcagtagggcaagatttagatacaacacctccataggccccaggaagacccatgccccatgacttatgtctcacccagaaggatgtttatggaaagatttttctcaagtatgtgaagctggttgccctggaagttttcctatgaaggtgttgtctgatatctaatcctttttttcccattcaaaatcacagtttgtttgttttcctttgggaaaaacctagatataggagctaatgagcccacgtttagggtttaataaatattttttagaggtttaaaggacaatgttggccaggcatggtggctcacgcctataatcccagcactttgggaggcccaggtgggtggatcacttgaggtcaggagtttgagaccagcctggccaacatggtgaaaccccgtctccctactaaaaatacaaaaattagctgggtgtggtggcgcatgcctgtaatcccagctacttgggaggtggaggttgtagtgagtcgagatcatgccattgcactccagcctggaggacagagtgaaactccatctcaaaaaaaaaaaaaaaaaaaaaaagaaaaagaaaaaagaaaaaaaaggacaacgtttgtgatcatctattaatcataatattcaaagcaggtttcagagtatatgtacaaactactcagccggtctgaagacaaaacagccaggagttgtttgaatcggatgttagacaccttttcaatgaaactcacactgcatcctacacctggagatcaacacagctgcctggatgttgcagccttttcctccacaactttatggaagaacccagttgctatgaatgagcaggctggtttggaagcagcagttgataagcaaatgggagactacccaagggcgaccctcctgaagggatgtgaaaattctcaaaacatgaatcctcagataatgttattatcatttaggtacattctttcaacaaataattttgattacctggtgtgtatcaggtgttgtgctagaaggtaggataaagcagtaaatagttaagaaggaatatcaataaagtatagtggaaatttggataggaaatctatggacgtgctacgagatagtaagttagcaggaggtaacataccctagggaaaattctcccaaaaggatgcaacgcttaaccagaggtctgaaggtgacaggcaggaaggccagtagaagagggttctgggtagaaataattggttgaaggaaggttaagagtgggaagagcatggaccattcaagacactgaaggaggtccagcatgactggaatgtagaattctagaagactggaaagagatagaggctggacagcaaggtgagccagatcctggaaggctttgttgttcctgcaaagagagttggttttatcataaacgcaatgggaagacactgaaaaggatattctgtgaggtgatggaatcaggtttgtacatgagaagtatcacactgactgccgtgtgaatggatgggtgccagggggatacagatttgggaattagccggtatagatgtgaataaaagccagaagacatggcccagagagtgtgtgccgagtgagaaaagggacaaagatggaatcctaaggaatatggaaaagtcaaggagaagaagagcaagtaataaactgagaaggagccagagaaatgagactaaccaggagaaggttgctttgcaggaaccaagggggagactgtttccagaagaaggaaactgtcagtggtgacaaatgtcaccgagaagtcaaggaaactaaggactgaggagcatctcatgcatttaacacagggaggcgatgggtaagcttgataaaaccagcttcggtagagtggtggcagcagaggccagactacagtgaagaaatacgatgactggttggggagggatggagatggctcttctggaagtacagttccaaatgtggggacagatagagccaatagtcgataaaaggggattgggtgaaggtgggaggtgttatataaatacgagaaatttgggggatatttaagtactgagggaagtggcaagttgagtgggagaatggaagaagtctcagatgaaggttatcaagaaggctggagaggctgtgattcagagcacacagagcagtggctttggctgggaagagggatgggcttctgcatttctgtgcatttctgggttcagtggcaatggtttgagagtgttcctgtctggcaactctcattctctctgtgaggataaaaggtactacggactacatttttctacatacccattgcaaaagtttaaaatccttctcaaagaggaaggttgttttttttttgtttttgttttttgttgttgttattgttgtttgtgtttttttgaggtggagtttcgctcttgttgcccaggctggagtgcagtggcaagatcttggctcactgcaacctttgcgtcccaggttcaagtgattctcctgcctcagtctcccgagtagctgggattataggtgcccgccaccatgcctggctaatattttgtatttttagtagagatggggtttcgccatattggccagactggt

SEQ ID NO: 12644 - DNA, 8824 bp, Human
gcactttgggaggccgaggcgggcggatcacgaggtcaggagatcgagaccatcccggctaaaatggtgaaaccccgtctctactaaaaatacaaaaaattagccgggcgtagtgacggtcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaacaaaaaagtggtagtgagtgaaataaaaatagttgctttcacagtaaacataaatgtagaaagtaatcggaagacttgtttattatgcagaaaccaaacaaatgtaattaaataccaactggtttgggacaatttgtgcattataaaatgccaatgttcatcaggccaacaactaggtaacatttttttcttttcattgaacaaatacattaaatacatattgtgttataaacccatccttaactcccacattataggtaactaacttcactgaggctctttttatttgtacatataactatgaatggacaagcttatcccttacaaactatccaagtttcagttctgagtgcctaaaggcccctgaggtcgagttaagggtcagttgctctccttccggaactactttttctctgtttaactctagttgcaagcatgcaactccacattccaggcacttctcaaaaatggggtgcactgggttctacataaaagcattaaagcgaagttaagcaatctctttatgcctaagtttctaggtctaccaaccttatcgggacaacgcgggagttaatatggagggctgtgttttacacccactttgaaagcacggcattgtctgtttctaaagaattgtaaactttcatgtgttacattacagaaatctgaacggagaggattaaccaaataccatttggacttaaaagcagcttgaggccgggcgcggtggctcatgcctgtaatcccagcactttgggaggccgagacgggccgatcacgaggtcaggagatcgagaccatcccggctaacacggtgaaaccccgtctctactaaaaatacaaaaaaattagccggtgtggtggcgggcgcctgtagtcgcagctactcgggaggctgaggcagaagaatggcgtgaacccgggaggcggagcccagatcgcgccactgcactccagcctgggcgacagagcaagactgtctcaaaaaaaacaacaaaaaacagcttgaaacctcttccagccactctcccagagtgacggacatgcagaaatctgtattccagcctcaattcaagacagccttctagctgcagtcccattttcaacatttcatcagtgaaaatcctttcatttaaaaaatacttcagtgccttagtcttctcaccacaacaaaaccacacagctgtggcatggttgaaaaaagaactcgaacatctaggagctccctgctttgagggcaaatttaaattgcaagcagcaagagctaaggaaaggccaggtatttctgcaaagctaagtttctcctaattagtaatcttctgggtgtctaagaaaaactttagatacaagaagggttgccacttttctcaggagactcttctgggagagatgatgatgaaccgaacgccaaggacttagcaggggcgaacgacgtcaacagatgtccctccagactccggcaccagccggccgagcccaaacgagttctcgcccccgaccccacccaccgcgggagcagggttcggtcactcgcagtgtcagagaggcccacatcctcctaaatttccggccctcccaaaacttccgtcttccctaggtccaacggggtggacccaaggcccaggggcgtccccggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgaggtgggcgctggggcacgtctcccttttggcatactgtttgaggggtactgaggtgaaagggcggtcactgttcgggtcgtttttacacagcggttgtgcgcccgtccctgccagtcttaatgtcttcatctcctggacacgtagaatagtgggccgggatctccctgactttgctggcgatgcggctgggccttttgtagggcggccgcagtgacccccgagaagggggttgctgggaggagaagggaagagggaatttggcacgcgcagctctgctgcctttgattccaccgccgccattttgtggccgcagagcgcccgcccgctgctgttggcgcaggcgcggtcgaggcgtcgcgagattctggcttccacccgctgtgacgcgcccgcgaggccgccattgggctggctttgcggagggcgcgggcggctccgcccgcacttctcggcctttcctaactgcggcagatgggagggggccggagagcccggagagtgtgcggctgcgcagttggaaaggtggcagtgggcgttgcggttgctgcggtctgggcccagtagcggaccgtgttgggagggagctgggttttcattttgtctgcaggtaacctggcctcattagaggctctgttggcaatctcgttcataacatcactgtgtaaacattttatgccgttgatgtttttgattgtttaatcaggcgtttctctgtgacagtcattgctattatctcgattgaattactttctaataggaagtactagccggacatcatgagtggctgtcgggtattcatcgggagactaaatccagcggccagggagaaggacgtggaaagattcttcaagggatatggacggataagagatattgatctgaaaagaggctttggttttgtggtaagtatttagaactgggtgaattatctgctaagtaggtagagttttgataagcagttgttttcgatcttgagtccgggtggaatatttgccttcagaaaatgttacccagccttatgtctgaattttattgaggctgaaaacaactttaacttgccggctcactggaaccccactcccagtggctccttgattaggtttgactgtatggcagtgtcgttaagatactcttcccattctgtctcctgatttcagtgctcttaatgtgttgtagaatactcttctaaagccaatgttaagagtcttatgcttacattttaggaatttgaggatccaagggatgcagatgatgctgtgtatgagcttgatggaaaagaactctgtagtgaaaggtgagattcctgtgtaactagataaccctgggacatagagcagactgggtctgctggcatatttttctaagtagatttatgtagcttaagtgtgtaacggagatttttcttccctttttgtagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagggtatgtactggaaactgtgaaagtctttaaaaatatccggaaaattttactgtgaacttagttttgaggacttaaaatttgaatatgttagaatgcagagattctccagagacaattttgctgcttccctcctcccccccacacctttggcagtgtctggagacaagtttggttgtcacaactggttgagagaggatgctgttggcatgtagtcagtaggggctaggcatcctgctaagcatcccacggtgcatagggaaccccctcaacaatgaattggctcaaagtataacagtgccaaaactttgctcttttaatgctgtgttatccagaaataagactcaatagtagcaatagcaaaagtgaacatagaaacgacttacctagactgctgtgtgcaatgtgtgagactacaggatgtatatactttaaaagtggctgttttccattttagggtggttgagtttgcctcttatggtgacttaaagaatgctattgaaaaactttctggaaaggaaataaatgggagaaaaataaaattaattgaaggcagcaaaaggcacaggtatctctaattttttaaagtcaaaagttgtatttaatgggtttgttgtagagtcttatctaggctgatttcttttcatttttcatagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaactactttttgtctgtttgtctgaagaagtcctatgctgattatttctcatccttatacagtagatttaaaacacagaacacatccagaatcctggagttggttacggtctctctttaaaaataatgtttttgacgtctccaggctagtgaaaagatacagaagtaagtgaatgccaaaatcacaattgttgagttttgtgtccgtggcccccctgtcccccaaagttctttctctatctcctgaatttattggcatcaggttacttaagcttccagagccaagaggaggatagtgtgggaagcagtgtttcttgcctaccttaaagattaggacaggtttttttgttttgtttttgagatggagttttgctcttgttgcccgggctggagtgcaatggtgcgatcttggctcactgcaacctctgcctcccaagttcaagcgattctcctgcctcagcctcccaggtagcagagataacaggcatgtgccaccatgcccagctaatttttatttttagtagagacgggtttcaccgtgttggccaggctggttttgaactcctaacctcaggtgatccatctgcctggcctcccaaagtactggaattacaggcatgacccactgtgcccggccttgtttttgtttttttttgaggcaggatcttgttctgtttgtctaggctggaatgtggtggtgtgatcactgctcactgcagccttaacctcctgggctcaaacaattgtcccgcctctgcctcctgagtagttaagactataggtgtgcaccactgtgtgtggctaattttttatttttctagagacagggtcttgctatgttgcccatactggtcttgaactggcctcaagtgattctcctaacttggcctcccaaagtgctgggattataggtgtgaaccactttatccagttgtgatgcagttttggtggtcagataacgtgaatgcttaaggggctttgacatgctactttttgtcttgagatatgtatgggatagtacatgtttaagggaaaacaatagtgcaaaatgcctaaggtcctatatccacattaaccttagacttctatatgtgatctttcaagccctgtcttagatgtgtagaaaatgagctttgttaatacaggagtctcaagacacttagatatattcttagttctgtgggggctagactacataaatactgggaaccagtgaataacatctatatagcatctgatagtaatagccaggcactgttttaagtgccattacctctgtgttgactgaatctaataccatcattttactggtgggaattcaggaatttttcaaagaacagggatggattggtgttaaaatctaggaagtctgattcctaagacccccacaccacactgtcactgttcacgtaaagatttttgcccctagcttttcagggatttggaagaaggcagaattagaagcactagaaaaatgtagcttttagcttcccgaaagcatgcggattgggaagtgggaatctccatttgggagaattgaaaggtttttggtatccttaatttttaaaaggccactccccagctgtttctaagactagaacaggccacggaagcttaaaactgctaattgcagtaagaggctgagtttaggagttggtatacctgttgaattagttgagagaactaggtttattttaataaatggttaaatctagattttcttagcgtctctgaaggcagtacttagcctgaagttgctatcaaaagcagcttctcacccttgggcttttaaaacatgctcctcagtgcagtatggtagtatgttgatgttcttcccctctacccctagacaatcagacaaacttttttttttttttgagatggagtcttgctgttgcccagtttgggcgatcttggctcactgcagcctctgcctcctgggttcaagcgattctcttgcctcagcctcccaggtagctgggattacaggtgcccatccccatgcc

SEQ ID NO: 12645 - DNA, 14315 bp, Human
agcgatgcaaaaaaatgtcctctgtaaaggacctgacccgctgttgctggctttgaagatggagaaagagggtctctgagctaagatatgtgtatggcctcagaaactggaaacagctctcaggttacagccagcaagaaaatgaagacctgaaccctacaactgcaagaaaatgaattctgccaataactcaaattagcaggaaactgattctcccctagaacatccagaaaggaatgcagctttgctaataacttgcttttagttaagtgagacccataccaaatttctgatataccgaactgtaaaaataatagatttgagttggtttaagacactaaatttgtggtaatttgttaaggcagaaatagaaaatgaatacaacctatttagttcaatcttaattctaaaggccttctactctgagatcacataatctttacctgcttcttgaacaaatcaggatcttgttagcaaggagaaaggagtgagtggcagggagaatcccaatgaccagtgcttgtcacagacggctaatcttaatctggtttaagtctctagttctgtctctcagaattctacctcatgctttatgatccaccactttctaatctatggaatagatgatctcttgcttctgtgctcttggtaattgagttccgtctgcctggaacacctccagcccactgcccattacaagtaatacttaagaactaagtgcttgaattcttcactccttataagaatcttattgaacagcactcactatagacacacactttttatatttcgcattatgaaatacttaaaaatgcgcaaaagtagagagaacattacaatggatccctatcaaccagaattcagcttccataatcaaaattcacattgataagtcagaaataaccagcaatgtattcccacagcaggctgacgtgttgtcaacagggatggtttgatttatatctaagctgagaaaatggattcaattctccaggatcttagttatcgtgaactctaacagcaaaaatgacaaaaccactctcagaggagtcattaagtgctaccagtgaccaagatgcgagaaaaatcctacttcagactagaacctgaacagcatgtcacaagcgtcctaaaatggctgtcacgttacaggacttgcccataaggtcaattttggccacttaagacttacttgaagagagagctaagggttttctttttaatttcgtttttgtttttgtttttaatggcccacgtcagtgctagcaatagagaaaatgtgtccctgatcccttggataaatcgaattgactgaagaatgcttgaattcatttatcccaaaacaaaggcagacggctgagggtcactggagtttcagggctgctcccagcgttggagcacggacgccagagccgacttccctcaggccccgcactgcggcagggacccttctacggaggatggctggggctccgggaggctataggaacgccatctagaagctagatctcaggcaaacgaacgcgctttaaaaggaattaaaacgaaagaacacaaactcgaatcctggacctgattaggggcacgaccaaagaaagaaataactaacggttctcaccctccctttcattccctcccgcggaaagagaaaggctggaactccgcttcccagaatgcaaagcgcggggcggggctaaagagatagcctgttttccctcaagtaggatcgcgggaccacaggtttgattataaacgccagtctctcgccacggcgctcctccccctcagtctcactggtcctgccggccgttgcgtggaagggggactcagtcgtcactggcagcggttgaatggaggctctttgccccgcgccctcacggtagatgaagtccttgctttggtcagagcgatagcttctccgattgcctcagagcaagcggactacatttcccagggggctgcgggactgccgggaggagtgggggcggtgcctcacgtctggtacagtcatcacaagcctgttcggcgggactgtgatggccagagagatgacgatcttaggtgggttcccgggggtccttgttgctcttgcgggcgtagaggcgatctgaggatgccagagtgggcaggggtggttgactcacctcctggatctagctggagcagcggaaggggagtcagaaaggtgacttagagacggttttcggctgttcggagtggatgggggcggggacgcctctaggagggccccggcccctgcaggccaaggtaggatagacggcgaccagctgtgtccatcccagggacatcaggcttagggaggcgttcctttcaacagcacctaggtttttgaattgcctgttgaattggggcaagctatggaaggctgcgagaacgtgcacctccaggacccctttgtggaggaagggggaggagctacatccggatctgtcggctcagggatgctgaatttggaggctttttccatcacatcgggtttggaattacctatcccccacccacacacacacccaccccgcgtctccaaggtgatgaaatgcttctgaaatgttgcctgtagctggaagtggaaagtgggattcgcacttggttttatttctttgagttatgtgttgatgaggatgagctaacaattagtaacacagagccctgaaaattcatgttttgggtcatatgtaatatgagcggacacaggtgtataacacagcctcctgataccaaatacgagattcattaaaaactaaaggggcatctttcttcgcttatgtttacaatctgcgtggcatttgttcctactcttttttcttttttttttaaattagtatttgttgggcatctgctattcctggtctgggggatacaacagtgaacgaaacttgtcttcaagaagctttcatagatgttgccgtcagggttgcccacctttatgcttcttctcccctaaatattaccactgcaagaaggaagtccctagttcatacttaaatacataaaaagttaactgtgttctgttttgaagtgacagtttcatatctaaggaactttcaaaatcattttatcccatttattcatttcatccttttgaaagggaaaaggaggtgagatacgaggagagaattttagacttataaaataataaagtttttcttgtgagaattttaataatggagcttttaaaaaaagataatcgaagctttttataaagctgtaaaatctaaatatcaattgatcaagaatattagattatatctggcttttgctccagataaatgttgtttcttgtcagcatctgcacaaatattattgaaatatttttacattttattacatttattagagaatgacacaaacatacagttatagggttttttgttgtttgtgtttacttcattttaaattttattataaccagtttacattttgaaaaacttgctgtctgagaggagtgctatcagcagtcctataaaaaattttgaaatttgtcttttttagccttgtttcaacgagtgatattaaagggactttgctacagtaatttagtacattgtactagtttgataaaatacatcttttaattttcctttatttcaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggtaagtgattaatctaaaatctatattaattttagtgtactcttttagttaatgctttggcttcatgtcacaaaacattctatctcgtctagttttatctattaatacatgaaagttctgttatctcacataaccagaaattccacagcagctataggatcagttaatcactgactccataatgctaacaggtacttaaggccttgccattttcttgctgtcccatcctcagcatgtcttgcttagctctttcaaggtagcaggaaggttgatgaagccctgtgtaccatagatagatattctgtgtgtgtatgtgtacatatttatatacatataaagagaacataccaggtgtgctattttttgctatttaatatgtcatggataattaataggatcatgtcattatctttaatgattttgtggaatgactattccattattaattagactagtctctatcagtgtacttttttgtggtttttcactaatgttggagattccggtaatatccttacttatctttgtacacttctctgaaagtttcctaacttgaatgctagaagtctaattgataggtcaaatgtgtacgtttttaaggcttttgatttatttttctggtttgctcaccagaaaggttatatgctcttaaccataattttttagagtggctgtatcttcgctagttattttttttaatctttaacagtcagataagtgaaaaatagtatcctgtattaatttttatttattttgattttttttagtgagatcagaatttttagaattttattgatattttaattttcttttatggtccatttttctttgtccttttttgttttggtgtgtttttcttttccttagtgagctataaaagaccttcattatatgtttttgttatcttttccttaccttttttttttcactgatgtttttgagctggatgtcaaagttttaaatttttgattttagactcttatcatgtttactgtagcctatcccatcctatccactgctacttttttttccctcttaatacgtttatgtatttgttggtttggatttcgctgctttttttttcttttaaacatttaaagcttttttccatgtggagtttttcttggaagttatgaagtgaaattctaaatgaagtgaaattctaaatgaattagtttttgtttttttttttgagacagtctcattctgtctctcaggctggaatgcaatggcatgatcttggctcactgcaacctctgcctcccaggttcaagtgattctcctccctcagcctcccaagctggcattacaggcgtgtgccaccacgcctggctaatttttgtatttttagtagagacgggatttcaccatgccggccattatttagtttcaaaatagacagttgtatcagtgctgcttattgaataaacctagccataaaaatgttcaaatttttcatccgttttcaaagaaaaaaaaattgctccctgcatttcttaggtttattactttgttgttttttgacttcttttttgggattctttactgacttacaatctttaatgaaaaaatcatctaaagctatatatgccctctgaattacagctttgggtacgttacttattgacccaaaaactacttaatgtttctaagtgatctgatttttttgttgttgtttttgtttcatgtgggcactgatggttctggtatatttgtatcttagtttaatattgtccatgtagcttctttatgttttccccagactagtgaagtactttttggaaggtcagtttttcatgatggaaacctaactatgaggcctgaagtgagaaaacattcttataatttcttagattaattctcttttttatttatattaatagaatcttggtaaaactaggatagtattttttagagttaaaatagttttttaaatgtacacccacattatcggggacaatgagctaatgcacaatacatgttttcatgggaaacaagaatgtaaatgagatttgattcttggataagtacataatgatgtactaaaattattcttgttaatatgtactagaaaattctttcagctatccattactcttagaaacaagaaatttgggaaaaaaagggaaaagattctgagttacatacttgaatgagcaacttttatttcttacatttcatcatttattctttctttattcagcaaaaatatattgagaatcttttgtgttctagtcatgtgcgtggtgatgaattttattctgctgttattaaaaactagtgtgggccaagcacggtggctttcacctgtaatcccagcactttgggaggctgaggtgagcggatcacaaggtcaggagttcaagaccaacctggccaacatagtgaaaccctgtctctactaaaaatacaaaaattaaccaggcatggtggcacgcatctgtactcccagccacttgggaagctgaggcaggagaatcgcttgaacccaggaggcggaggttgtggtgagccgagatcatgccaccgcactccagcgtgggcaacagagcaagactccatctcaaaaaaaaaaaaagtaaaactaatatggattcattgtacagattttaatgtataacatttaacaagttctaatcttggtaaatgtactagatagatttcaaatgcattttttgattttgtaaagataagggtaagttctcatgaaatctagtatttatgtatatatgtatgtctgtatgcttttactcttttatttatttacttatttgcaaatcctattcacaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggtaacagtacccttgactgagatgcatttttctcaaaattgtgttgggttgaaaaccttctgtagtaaggtttaccacttcccaaaccacacaaccatagtcaaaataaacaaactatatggtaggtgtattagggttctctagagggacaggactgatagtatatatgtgtatatgaaagggattttattaaggtgtattgactcacactatcacagggtgaagtcccacagtaggctggctgcaagctgaggagcaaggaagccagtctgagtcccaaaacctcaaaagtagggaagccaactgtgcagcttttagtctatggccgaaggcccgagagcccttggcaaaccactggtgtaggtacaagagtccaaaagctaaagaacttagagtccgatgttcaagggcaggaagcgtccagcacgggagaaagatggaggccagaagactcaggcagtctaatcctccgacattcttctgcctgcttttattccaggcacactctggcagctgattagatggtgcccacccagattgagggtggatctgcctctgccagtccactgactcaaatgttactctcctttggcaataccctcacagacacacccaggaacaatactttgcatccatcaatccaatcaagatgataatattaaccatcaatgtaggtaaagtagatagatttttatacaggtttataattttgaaagctctatagcacaatataaaatatgtatttaacaagaaccaatcagatgctacaggacaaaggctcaaagagaaaatggacacatgttagcagtgaggaattctttcttctaaattccgttaatgttaaggtgaatataattttttaagtaaaatctgagatagatcatttaatgatttaacatttaatgccattgaaccaatattgagggccttactaaaaaaagaaagaaatctttgttctcatggaacttatgttctaccagagggaaacacagaatgagcataaaaggtaaatttaataatgttttcagcctctacattactgatattttgggccagataattctttattgtggaggactgtcctgtaaactacaaaatatttaacagcgtccctagcctctattcaccagatgctagcagcgccctcctccaccaagtggtgacaatgaaaaatgtctccatatgttgccagatttcttctggaggtaaaatcctgtcttgttgagagccactgatacaatgtatatcagaaagtaaccactatgaagaaaagagcaggctaatgggtcaaggttgcttttggtggtcaggggatggatgacttgtagaatttaaatagggtgatcaggcaaacctcattgagaaagtaacatttaagcacatttgaagaaagcaaaatacttaaccatgcagacgcatggagaaagtgtgttgtaggaagaagagatggccactgcaacagccataagctgggaatttgctggtacatagaggataggaagttggtcagtgtggccagagtagaataagtggtaaaatcagagagctgaagtgaagggtgttatgatctctggaataattctttagagtttgaatgttgtcatagctcctgatacataatgccatactactttgcataccgctcataagtatggcatttagtttaaagcaggaatttcattcaaagaaacctgatcttttacctgctcaacataagcctctttaatttccatagcacttagtgatagtatataatgattaaattttttatttttttttattttttgagacggagtctcactctgctgcccaggctggagtacagtggcgcgatctcggctcactgcaagctccgcctcccgggttcacgccattctcccgcctcagcctccctagtagctgggactacgggcgcccgccaccacgcccggctcattttttatatttttagtagagacggggtttcaccgtgttagccaggagggtctcttgatctcctgacctcgtgatccgcccacctcggcataatgattaaatttttatcgctcatatattccaaagtagaatatgaatgttagaaaaggctgggagactttttgaaaattaagtgttaattaataaagagtagaatgacttattgcactgaaccttggattttatttctttatattgtaatctttcagaataattttaaagatagcatttagaagagcctatgtttactgttcccatttcatgcttctgttcggtttgtgactgctctcattattactcagtggtggagttcatgtcacagaagacacaaacatgctgtaagtgggaagagattacttgatcgcatcctctcatgaatttttcttcccttaaccaatcttacaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggtaagaaaaatgcagggagaggctgggcgcagtggctcacgcctgtaatcccagcactttgggaggccgaggcgggtggatcacgagatggggagatcgagaccatcctggctaacacggtgaaaccctgtctctactaaaaaaaaaaaaaaaaaaaaaattacagaaaaatgcagggagagttgaagaggtttgggcagtgctttctttaacatatccaatgtgtaatgcatcctttttttcccccagaattctttgacttcattttgatagttttctgtatatgtaattttataccatttgtatatatttacagcaaaaagttaaatctcaaaaaatgctgggcatcctataagtcgcataaatacattgccagttacccaattacggctcacatagccagtaggacttttcatggtgatggtgaagaaagggaacagagggaagaaaaatttctttaaaatgaagggtgatcagtatatttcatttaatatgttttataaagtagatgtctttagaaagtctaattgtatttttccctaggaaatgataggattatgcattctaaacccttttttaaacgtttttattttgtcgaatttagcttaagggattcaacctgtttgacacgttgagttgtaagttacaggtattctaacctctgcatttttttttctctttttctaatcaagttaaataccaggaaattatattacactactcttttcctttgaaattatttatctagttttcaggtagaaaagtagaaagaccttttcaggtcctaatcaggcaagaaaaaatgaaaggaaaaaaagagattaaatacctactttttcattataagaagcactttcttctgttgagaatgacattcagtgtttttaaatagctacttataagccaatctgtattcttaatctctatttactgaaaaattatttgatattgtgaagagatacttccttttatataatttaaaattttgaccctgatgtgcactagtttttaaatagtacttatttgggttaagatagctttaacccagtcattattttttaaatttttatttattgatttattttatagaggcagggtcttgctatgttacccagtctggtctccaactcctggcctcaagcaaccctcccacctcagccttccaaagttctaggattacaggtgtgagacaccatgcccagcaacacagttatttttaaccagtctctgtatgaataaaattgtaatgatacatgaaacagggatttgttattcccagaatataatttttacgtatacataataacatacgtgtatacatacacacatatatgcataactatattaaacttttatttttcactcaggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatataatagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccgagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgtttttgttgtttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaattgctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttttttaaactatgtactttttcattcaggactagtctggagtatacttttcaggcatataaataagaaagtgaggatggaactgatttgatgccaaggcactcaatctcagtagctgttgcctagttgttcccgaaatgtacatttctctatatcctttctattgcttatatgctttccactggcttctctaatttagaaaagacaacttgtagcatatgaacagtatcttcagaattctaaatactaattcatggcttctgaccacgatggagccagaaac

SEQ ID NO: 12646 - DNA, 12453 bp, Human
aggaagaactcatctctgaaaaacaaacaaacaaacaaacaaattagctgggcatggtggagcacacctgttgtttaaggacttatcaaaagtgtaagtccagccttccataagcatttcaagataaattattacagcataaaatggaggcctttaaataggagaatgaagtggtttgatttgtaattttaaatgattgcatcaacagctgttttatggtataaaatgcccagttaggaggctgaggcgggaggatcactgagtctgggaggttgaagctgcagtgagccaagactgcaccattgccctacagcctgggtgacagagcaagaccctgtctcaaaaacaaaacaaacaatataatcacaggaaaagggttttgtaaaattttgcaacatttttaacttcctcaaggttaggtttcagatttattatttttgttttccaacattaattagatgtaaaaactcttaaaacaaaaatgccttcagctagcctttacaaatcagataagagggaaaggttgggaagagcagccaagttgcttaggggccgtatccaagtagcagagtgaaaaggctgtacttctgaagcttcctgcaatggagagaagtgttagcaggggttgtgagaagagctctggtcggaatgaaaagcagtggtataccatcagctgctcgctcacttgctctctcatgcacgaatccagcggagcctgacggcacttttcagagggcattttctccaatgaggcaaaaagtcaaagcctgaggatcttgaaatgcttatgttaggctggatctacacttttgaccagtccttaaacaacagggctcctttgtgtggtgtctgatgccaatcatgtgacctagctaaaggcagcaatgtaaccatcccacaattcatttatttattcaacaaatatttattgagttctctatttaccaggcagtcagcttccaggatctaggatgggatactgtggtgagcaagacagacaaggtccctgcccttaagggacttaaagacaaaacaaaacaaaaaataaaacaagtaaataaatgagatcacttccattaataacagtgccatgaagggtcatgcgccatgaaaggcaggtggtgaggctgaggatcttgggccacaatgagccgaggagctgaggtgactgggggcgccagggtctgggggtgcgggcaggcaacagaccacaggggacttacaggccattataaggagtttttatgtcataaattattatgacataaattggagggctttaaataggggagtgaagtggtctgatttgtaattttaaatgatcgcgtcagcagttgttttatggtataaaatgcccagctttaagatgaccatgcattctacaaattcaccgtgacatcactgccaaaactcttaacctgtcttaatctagttttcctgacagataaataggtcggaataaagctccatgacataactagtgggagccaaagatttgaatcacgtcttggtttcaaaacttgctacccacaaatgagttgtgagctcttgtcaggttatttactgtatttgtgcctcaactatctcagctgtgaaatggggataatgaaagttcctacatcatttatttgtggaaaaaaaaatgacatgtaaagcacgacgagagcgcctggcacaatgtagtaagctttcacaaacactcactttcattccttcttgcaggggattactgagaggatccacaagataatgcacgtgaaagggcttgcgaaattgtaaggactatcttaatggtagagtcctctttatgttttcttttaaacggtccagaggacgctgggctgttcgaggagaggcgcgaggccaagcgcagcctcaatgcggtcattgtcgtggggccgcccctcccccgcccggggcgcttctccatggcaacgtgggctttacctctccccgcctcctcaggcccgcagaccggaagcagcccgcgccgggggtttctgggaaaaggcttgtgaacggcgtttctgcgtctgccgtggacagcgaagctgctgcggttcctgagccggaggtttgcgccggtgtgcggggaacgttatgagagggaggggggacaccgggctagggtctgcggacctcttagcaggagccggcggggaagcctgtccgggaccttcctcagcttcccgggaggcgcggggaacaggccgcggtctccgcgcctagcagttgtggggcggggaggggtaggcggcaggcctgcttgggtcttcggcatttgcagagagctctctaaccccctgtgtcctccgagaccctcaccttccccctcccccaccggccggttttgttctatttcgaggccctggcgtctcgcggagggttctgggagtcgtgatgggagggggtggtagtgggacgagacttgcgcggggcttctgggatttgtagtctcaccggccgcaggcggaagtgccgtggttccgacgctgttgtcacagggtggcctttggtcatctgaaatccgcggtcctgagtgctgggaagaggggctagaggacgtcgggccggggccggggctggggccgggatacacagcaggtctatgcagcagtaaggtgggcgatccacctgggacgaggtaccctgcccaaacattgtcgggaccgtgggccttccctccatttcccacaagcggtatgctctacagcataaaaggaagagaaaattatgtagaaatacttgcaccgttgataagcagggtcttggaataggaacgaatgaatgttggctagaccttatgtataaggccaccacactccagggtatttaattaaaccagtatgtattacttgtctgataaggccttttctgattctagtcttcatcttgcttgggttacaataagtttttttaagttgttattgttcagattttgggccctgaataaataaataggctgaatggctcattgctagtatgtgtcgtaaacaacagcacgggcatgatcgtgcaaataataaaggtccagaagcagtatacagtttccctgaaggtagaagctggggaaactgtgagtcctccagtgtaaggacaagacactggaccactgcaggaagtcaaggtgcttatgcgagtgccttttcttaatagaagtttctgtgattaatgcctatcattataaatataaatgtacgtatggtgtggtggaagactgaatatttacgtattatgtgcaagataatttttcaaaattatgtgatgtttttcacatatgatcttttcaatattatgtgatctgctactcagcaagtgaacattttttcacatataagtccaaggagttcttaaacaccttaaaaatattttttaaatggtaaagaaaatttttttaagcacataataataaagcgaaccttccttttgagttgacttgtgtgtgtcaggaaacaccaatcctgaattggaaataatgcgttccagggtcaggcacatttagaaagcactgaagtagtctggttcttacttggattcttttgattattgacatagggtttgtcgtcttagtaggtcatgattggcaaactttttctgtaagcggccatatagtaaataaggtcatgcataactcaacgatagtgctatggtctgagaaatgtgttaggctatttcatccttgtgtgaacgtcatagaatgtacttgcacaaacctaaatggcgtagcctactacacacttaggctatctggtatagcctattgcgcctaggctacaaaccggtacggcatgttgctgtactgaatactgtagagaattgtaacacaatgctaactatttgtgtatcaaaacatagaaaagataagagtaaaatatgatataaaatgtttgaaaaaaaaaaaagatatgcctgtacagggcacttaccatgaatggacctcgctggattggaagttgctctaagaagtcagtgagtgagtggtgaatttggaggcctgggacattactgtacattcctatagaccatataaacactgaacacttaggctacactaaatttattaagaaaacatttttcttcaataattaaccttagcttactggaactttttcacttacaaacttttacatttttttttaacttttttactcttttgtgataacacttcacttaaaatacaaacacattgtacagctgtacaaatatatttatatccttattctgtaagctttttgcttttttttttttatagacagagtctcgctctgtcgccaggctagagtgcagtggcgcgatcttggctcactgcagcctccacctcgcgggttcaagagattctcctgcctcaatctccccagtagctgggactacaggcgcaatccaccacgcccagctaatttttgtatttttagtagagacagggtttcaccatgttggccaggatggtcttgatctcttgacctcgtgatctgcctgcctcagcctcccaaagtgctgggattacaggcctgagccaccgtgcccggcacagctttttgctatttttaaattcattttttagagacagggtcatactctgttgcccaggctggaatgcagtggtgtgatcatagctcagtggagccttgaactcctggtctttagtgatcctcctgcctcagcctcctatagtgctgggattacaggtgtgaaccattgcacctggccaattttttttttcttttggaactgtttttgttaaaagctaagataaacacattagcttaggcttacacagggtctggattatcagtatcattgccttctacctccatatcttgtcccactggaaggttttcaggagcagtaacatacatggagctgtcatctccataataacagtgccttctgtaatacctcctgaaggacctgcctgaggccattttgcagttaacttttttatttagtaagtagaaggagcacactctaaaataatatagtataaaaagtatagtaaatacataaaccagtaacatagtcgtttattattgttatcaagttttatgtaccatacataactgtatgtgttaaactggcaacacagcaggtttgtttacaccagcatcaccacaaacatgtgagtaatgtattgaccttacaacagctacagtgtcactaggtgaatcttgaatttttcagctccattataatcttatgggagcactgtcatctatgtggtccttcattgacccaaacatcattttgtagtgcatgactgtgttgggttttttttaggccatctagtctgttgaaactactcaactctgctattgtagcgtgaagtatgagtaagtacaattatttatggacacagtcatgttaatttcatatcattttcacgtgtcatgaggtattcatttgattttggggagctccattccctaaatatcattaggtattcatttgattttagggatctccgctccgtaaggcactgtgatgaagaccacagccatttaaaaatgtgaaaattattgttggtgcaagtgttgtacagaaatgggtggcaggctagatttggccgtgaagctgtagtttgccaattcctggtgtaggttattgattggaatttttaactcaaagaacaagtatcttttacttttaccagtataagttcaaattcttaggatatttttgcttatttatatatcttttatttcttatgcctcaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtgagcctgcttgtgtcatttcctgtgtcagaagcactggcataggtagtaggcaaagctgctgaattaattccactcaactaagttagaattatgtttatgccttttcccccattcccctaccactccttgttatctgtgccgctttgccatctaggcttctgcagtatttgtttcatggggtttctcttacgtgtttttagttctgattctcattacagttccttctctgaatcaaatctttctgtttccaggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtggtgaggaccagaactctgtgtgggctagagggtgaaagagagtataggccttttgttcagaactttgcttgttctcactggtggggggatcatatcactcttaatctaatatctcagtttttttctgattaagttgattttgctggcctcagaccttttattcctagacattaacatcttcagccttttcttccctttcagtctccttcctaaaaagagttgcccatgtcaggctagcatttgccttactttgagccagcacccacccatggaccaagtccctctattttgcattcagtattacttgtcatctgttttacatccttttactttcaatctcctgcctaattccattggtacagtaagcttacctgaaaacctcttctaatctctttgttgtatatcactgaaatctttctaaatatttatttctgatttccttcaacgtctacctagagtcattttcttctaagaagcttcttttgtagaaatatttggagtaatttttttcctttttctaagtatttatgcaaaaaaagcctccttagctataacatgctttaaatgcagaaaaagcttttttaaaagctcaaagttgtattaattcacgagaccagtctttcccaatatattagccattaacaccatatacttatgtgtatcctttgatatggcccagtatattcctaaaactgctagattgctttctcatgtttatgtgaactaaaatgaaattttgtttgactctgctttagtaatcattccttgaagtagttggagatggtgctggtatgccactgaatgaggtctgagcaggttttcttcacatctgaggggacagtgccagccagtcaacttttggggtggggctgaagtctgctgaaaatctgcagttttacatgtttcatgggacattcttctgtgcaataaagtttgagaagtatcattcttgatatatggggctgatattttcaacttctcatcatctgaattttagagtgacttttcacctgcgttccttatttcagctgtctagtctcttccacacttgggaatttctgtttcctgtgtgccgtttgtctccacttaatcttcacgctcctctgtttttcaagtctccaagcctcactatcctcctctaacctttcagtctgtctctcttagccttatctcctgacttgatctttttgttaattatttactgttttcctcttcgctgaaggcagttgctaaccctatatgaactggatctttactccttaaggcatgaagttttagaaaagtcttaaatgacacttgctgttatctctgcctgcgtgtgagtgatgctaacccatgttggtaattcaggcttttctttcattggacacgtttcactgaggcttagaaataaccatttttctaagtaccatgacaaataccacatgggagaagctgcttttattggaaaactttcatttattaggggcatactgaatttttatgtcatgtctttggttaacacaggaggcccccagcttatcttcagccccttcttgtcaagactcctgtgttctgcttttaggctaacattggctgtgacctgacttggcttgttcatttcagaaatagccactttctgacatgtttttctaatttacatctttgtattttgatgtaatttctccctttctcaaagtaaaagaacattataatgatttcctagtggccaattttattttatttttattcttacaaagtttcatccatacctagccacatcattttgactatctccctaaccatcttagaatctaccatctttctgacctttgttttctgactaccatttgtaaaccacttgcctatgttttattcagatatcccttatatcatgatgttatactgttattcagagtaatttcattttttcttttttgagaataggccttaacaccagtgtcagagtggtttatagatgtgtgctagctattttagttcattaaaaaaaaaattttttttaggtttctttttcccttaatagataatgaatgatatttacattttctgtttatttcagatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctacc

SEQ ID NO: 12647 - DNA, 47184 bp, Human
ccggtcaccagacctggtcgaaccgagtccaagatggcgactccgcccccgccccctccgcactcccggcggggtcagggcgccccctcacgcggcgggctcgcgcccgagacccggctaaaaatagccaggcccgactatatttggttcggccggatcctggcgcggccgcgcgctccccgccccgccccgccccgccccgcgcgccctgccccgccccgcgcggcgttgaatggagaaggggcgggggtgaccgaggggaacctactccgctatctgcggcgcgcgccggcggcgggtcccggccaaccgccgaatttagtaacatcgcctgcgtcaatcacgcgcctcgcgtgcgtcagcgccgcgcggctccaggtcctgctcccccccttcaagcctttgaatggatacaatgtagcagcgccctccttccttccgaggctggattggaacccgccgcagtgcagagactcggttgctctcggctgggtcaactttcggggcattctcccacgatcctctccgcaccaccgtgtctgaattggaagtggaggcgaagaaagatatacatgccatatttacctatatgtagtttgttttcaagtttctggtcctagctcgaaccttcttcgattctgaaatgtgtgctgtctacaaaggaatcttgtatctcccctcggcgcagcgccccccgcccccgccacacacacacaaattgggacaggtcaaacatataaaacggtatttgtgattcaagcggaccacatggggaccactctatctgcattgtttcactcaaatattttctcctgtccaaaaattcatttctgaaagagactgcgttcactcagcagcaacctttgggactaggggtctttaactctgataaattttgttttcatcaagaaatttacacttaaatttatcatttccaggaagaaattgctctccttcatacagtcacccaggctttcggcacaccatttcatgacaaatgtgtccgaggagaccaaagcaaatcccctagcgagggactgactaataagtcctgttgattgatttcgaaatgtttaatttgggagatgtgggcggagggcatctacaaccatcaaaaagtgaaagtgctagttgagagttccatttctgacccggtgccggggaggaggaatgatttgcaatagtcagacccgctcagctgttcaacacgtgtgtgtttgttttacacacagagtagtttctgctgcagcgcgcgtgtgcatgatggatgtgcacttcgctgggttataacgtgtccagttaagaaacccacgccgtacgtgtaaagaaatcaaaccttatccccggaaccatctgcatccctgtgtgaaacacgcacccagtaaatgatgcggggaggggggattagcctgggcgcagaggaccggagcaacgtaaacagctttagaacctatgcaagaggaaagtgcagctgcacctcagggcgtcttcgggctggtgccagacgccttctgcaccggctgccaggtcactggagctggtcagaagctggctggcggagccttccctttcggaagagctgtcctctcccttacccccctcgccctggctccgtgcctcggggcagcctcggaggcgcgccagcagcactcctccaactctactccacccgagcctgacagctgggcggtcccgcctgacccgtgggcaggccgctgcaccctcccgcagacgcacgccctggcgagcggttccgctgcaaaaagagaagcccccaggccggggccggccgtgcggcggagtttccattgtgcggccgtgcgactggccgaggaacgcgcgcgcgcgcgcgcgcacacgaacacacacaccctccctcgcacacgcggaaccggctgggccaggggagggaggaggagggtgacgtagcgtcccatggcgtcacattgacgtctcgcattccaggcactctatggagaggccgctagggctcctgtggcataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaagtacgtatgagattcgcccagttaataaggggacttgctaaaaaagttggcttgctgggaagcgtcgctcctgaaattgacaactttgagtgtggggttccctcccctgaccttgccgcccggctccggctttgctagcccagcggcccgtaggttctgatctgaaacttttcccctgtagtgggcccgcggggatctctggagctcgtgggattcctccccccactcgaagaggcgaaaagcctctaacaaagaggaggaccgggatttgtgctatagcggctccagcgatgtaattcagggtatttcggctctagttgtcatggtaatgatgctctcggcggcggcggcggcggcggcagcggcagcggcagggagttgcagctccggtgatgaacggcagtaattttcctgccttttaagtaggattgaaaataggagctctggtgggtccaagtaaatgttgctaatggtggcaccgagctggttctctggaaggaagcttaggagggaagggcctaggcagcgacggccagagtttgcagacgcactcggaggacctcaggaaagagggcgtaattgtaggaatgtggcttattgtattgaaatgagcctggggttccactaggcacgtctgcctgtcgtcgctgacatgccggtttacacttttcccttaggaggtaaatcgggtgtaattggcgactcccgcacactgacacgtgtggggacggtgtccctctcctctggacgttggctcggtgtgggaaaggcatgctttttcacggacagaactcgcgcttttggagaagttgctccgagtgttttactcttagtagaaatgaaagttctcggtggtgagacgagagcggtcatgcgagcgcagcctgcggagactgacttccaaaggcacctctccaacctgttggaagcctcggggcagtggtgaggaagaacgcatttgtcccttgatttccaaaaacgttcttggagattgccttttatttatttatgcgtccggattctccagagggaagagctgcgaggagttagtaatcagaaatgtcgggctgtgatcccagggccttgtggtgctgggagagaagaacagggagccgtcattccatcgcgagtccagtgccggatctccttttcccacgaccgggaaatattttatagaatcaagttagggaaagaaaaagctgcctaacgtggctgatgggcacaatgaatgaagttactttattcgagttattttcgctgaacaagatgctcgcagagttagtatcaaagcctccttaggccacagcaacctccacgtccgctccgccccccaccccccggcacccatccacccctttgcctgggaccgtgcgctcacagaaattcttccccgcggtttgtctagtctccctcggtctttctgagaatctcagtctttccctttctgtcagtctctccctcgctcctcttgcccccgcccaacctccgcccccgctccccagggttggaaactccgcagaggagccccggtcacaatggtgcgtttcacggtttcctccacacacttcaccaccgggaggggaacacgggggtgttcctttcgtctgcccacgagaaagaaaggggctttgacagaggtagttatttcttcctaatttacaaccccaaggctctgtgctcccggccccggcggccgcaagcaggagcggcggaacgtgtttccaggcactgaggctttgcctaggtaaccggccgcttgtggggtggagagagcggcggggcgctgggctgggctggaggaaaggctgtgtgggtccctcccgcgaacgctgggcgctcgaggggaactccttcgttggggagaggcggtccccgcccacccgagttctgaggcctcctctcagagaacgactccgcttgaaaggccctcagggaatgcgggacgggaatgcgggcacccactgaaggggcgggtgggggattgctggagacccccattgaagatgcggggagacgggaagcacgtgctacagccgtgggaagatccgcttctacccgcgctacatcgagcgcaagctttccgtccgagcagctccagctggggctgggggtggcaagggaatcccccatttcctggtcgtcgagggtttcctggacctgggagccccgagtccctttctctcttcctgcaggcaagccccgggctcaggggcgccaggagatgaccctcgtggccccgcgcacctcggaggtttttggtttggtttgatttggggtttttcggtccctgttcccactcttcgagctgcgcccaccccgggcaaagggggcgctataggccggagtttgggcacccagttccttccctgaggcctgctgagctgcgctttcagctacaaagtttcgctgaggctgtgggctgagacgctggtcccggagctgcgctcggcgccctcaggaatgtgcccccgctaggccgctgggtggccaggagcctccaagccgcccaccctcgaagacaccgccctctgggtgcaggggacctgcctccgctcgtcccatcagccgctaacgccgtccgcttcgtccccttgcttccagcgccagccttctcatcgctgtgcccttttgtttgcttgacccctggccctcgaaactcgcggctaatagaagcgaagctccattagcatttagaatgaaaagcgcagactttcttaattcctcggggcattcatgcattcgttccggaccttgtgcatttcctatgcaacgtgtaaaatttgtatttgaggggtgggggcgggcggagctggaaaatggcttttttccgctggtgaacactcactgaccccccgtattcgggcggagctcgttcctcaagtgttctgctttctttggttttcctgacttcgtaagctcggaatcaattgtgggggcagagagatcaatttctgggcaataacaggctgcgcgttttttttttagcctcggttttggtgccacaaaacggtggtaggcgcagtgggttccaacaacctttcctcggcttccccgaggccgtgtgatgcttcttgcccagggggactcctgtaccattaatcacccttaattttacgataattctttgtaattaatgtaacatttctagaggttgccaaccaattcccccagtccccaatgcgcccagcccgggccgtagtgacccatcctggtctcactgtgacctatgtcctctttcaccttgcctgtagagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccaggtaggtccgaaggcaagacccttttctcctccctggctgagggaagtgggtgggggaaccacacactcggcgggcagcgtggtcgacctgcccagtgccaggacagtgactgctggccgcgaatttcacaacacaggtggcttcctcacaggaagctcctctgtataccacaccctgttgctactgagtggagcagccaaattaaattaagcttgcattgctcaaaattaattttcctaagagaaatacaaatacaccaatagattagggtattttatacatttttaatttcatttttgctcttcttttatagccagtgtgcacatgtaagagttatggaatcacttagagcaatactgagcattttcatttatataaaacccaaatcatttgggtgcagaagtttggatgattgaagctcagagggaaggagaaaagcatttgagatgaaaaccaaagagtaaatttgagtttggcaaaagaacagattgcacttttggtttgtaccacctctttacaaatttgttaaaggaatactaggtgccaagcctgtgtgggcaccatagataatgcagataaatagaatacaatcccagcaagctcatcttctagctagaaacctcagaaagacacaaataagagcagtaaaaagggattggccggaaagaatgacagaaaagagtaatggagaaatcctagaggtgctgaagggagaaggagaatagatcaaagatcaggcagtgttctttcttttaaatgattagcctttcatttcatcccaacaactggacagcaagataagtaactggacttcaaactagtgagtgtatttttaaggccctgcttgttaaagaaaggcttgaactggcctctcctcatcactgcttcttccaacaggccctcatcaccttttttcaagtcaagatttcatcccatacatgcatgactcaatcagatttggaaatgtgggtaagagaaagatgtcaaaggaaatgtgaagtattcacttctctattagtcacaccttttacaccatagactccaaagaggcgttaagcacctggttttcctttggctcagaaaaaccaaccaccaaaaaccgccgttttttaccatttatatttagccataaagaaagaaaaataattagataaatcatccactacatccaataattctcagcgccttctcactcagttcagcctctctgaacaatagtaagcaccctggataccagccactttgggggcaacatagtcaaactggcagagaaatcaagtctattgagaaactgctttttttcatgggtactaattctagtgtcataaggaaatacctatactaacttgcctattatgatagttataaactgttatcacaaaacagtcactgatatgttttattagttagaattgggatatatatatgtgtgtgtgtgtgtgtgtgtgtgtgtgtgtatatatatatatatgggtgggtgttttgttgcagctgctgatctttttctttgcagatggtacaaactctcccgagtcaatttcctgggcctatgtccccacctagctgactgaagttatcaacaggggtccagtttgtgcaggctgctagccctattggaagagtggggatgaggtgggagaaagcaaccacaacgtgtgtgggcaacctcaattggcactcataaaatgttagaatgtcaactctctcccttggccactaaatctctcacagggtagtttttcttgcctaactcaggtttacaaatcaatgtgtatgccttgggggaccaatggcctctttcctcccaaataaaccactggctttctctttgtccccctaggttatagctgaggagcccactccaattagtttataggattcaaagcctctttttaaaaacatctctgagcttatgaggaaagacttcaagtttcccaaatctagtggaggacagggcaagggaggaaagataggtacaggagtccacaggaggccaggttttggcacccctttgtcaggaattcagcttccttactagggatgaagaaaataagtgtggggctttgtgtctatgctaccagaaggaggagaggatgacacttcctctctgtttcccagattagagaacagtgaacccaatgctgcctgttggctagaaaacaagtgttaacttgcttctgagagacccttttctctgtccctgcagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaaggtgagcgcacgccgccccctcccctccgcacccagccccctcactgaagggagcttctaagtgagtgtaggagcatccttgttcttcccggtttgagagctgtaatcggcacatcatgctttcctacagcccttcctagcaccttcacatccattttctcaggggctttctactgaggtccatgtgcagcaggccaccccagacggactccgggggtccgtgaacctcctggcctgacactgccctatgaacatttttctggagagctttcagcagagtcttaaaaggacctgtgacttcgaaaatgcaaaaacctcattgctttgtctgtccatccagggtgtctgaggggatagtgtgtgcgtaccaagccctggacatttgtgtctcatttaatccttacagtaagagctggggctctagagtcagacacatctaagattgaattctggccactcactagctatttttagtaacagtgttttaaaacagtgttttaattttctttgttttgtagatgaggatgttgaggtttgaagaggttaatcagctgcctcaggacacaccttcagagaagggagatggaggcaggatgccaacccacgtttgcgtgaccccaaagtccattcccttttcacagctctgcagctctaggagacagggacaactgtcttcttctatggaaagagctgcctctttccatagaagatagaacttggggtcttgtgtcctctaggaacctttccctacctctgtatcacatgcggtgccaggtgtagacataattcattccctcataggcctaacggagaaattttacagtgggagggccatcagcctcccccatattttacccacgaggaagctgaggcctggagcggtgaagccttatgcaggctgtaagcagtgatttaactgcccatgagatgtttccagctgatttgtcctgactcctgagttcagtgttatttctgccacttagggaaaagaccttgctcttttgctgtgctaccttttgctgttgactcccagactttatcagacacttacttctgtgccatccttctcactcctcaccccactggccattatttcagtcatttacaaacccacacaaattattccttatcctctagtgctggacagggtagaaagaaagagaaagcaggatgctgactgggtaacttggatttgggaggccaataggatatatctgggagtacaccagaattagtgagagaagactcaaatagaagaccttgatcttccaccttccaattgtatcatgttgggcatgacacttcattctaagcctgtttccctatcaatgaataaaactcagagaagagctgtgtattcaatgagataaaaatatatatgaaagtgctttataatctttaaagagctgtacagatagttcattattaaacaaaagctataaagttttgtaaaaatgcacatttgtggagggatatacatagcaacaagcaacaattatttttgatcttcagattgtaaatatcactacctgaattctgcagagaaatgagaaaatgtttggggaaagactgcaatacgttaagtgccctacagatatttgggattatgatgttttaaatgcagaatcttggtcattttattttattttttagccactgagtttggccattttttgttttaactactcaagctttatcagagctactttcaagtaactgcattcctttagcagatttgatttttacaggatttcagtggaaaatgctgaaggacagtgaaactggcagcagaaagggggaaagaaaaaaacaagaattatgaataatctacaaatataattatctctaaataatggagagttgaccaaaataccagagtggtaatacattctgagtccagaaatgtcaattaagtgttccccaacagcttctcttttctgcagcaatccctcgaaaacaaatctatacttgaaagggtgggggcaagatgggggagaatcaccccacagaactgttaattaagggaaccggagcaggttttacccagtggctttctaccattaaattgagttctttaaaaatgtgacatgaagtgcagttaatgataggaattcggtgattgaaccataatgatctctccctgtccttaaacacaaatgtagggaaggcttcaggttattgggaaaatgtatacctgaagcaaaatgccatcagcactcaaattggcataaagccttgaggatgatggcaagaaatagagtgttagaaattactgcatgttcaatgaaagctttattcaggaaacacacgtttcctacccttacagactgctaagaatttaaatgctggaacctcagaagtatgcctgtgtttcagaattttgcattttaaactaaaatcacctactatggtgggagaaacatgtcttagacttgacataggttggctttgttatattaagttttatataagcaatctagaaactatcccctaaaatgaaattaaaaggtaacagggtaaaactgaaacatgggggttgagaatgactggaagtaaatgttaaaaagcaaatctagatgtttgaacacaaaatagatcataaagcccaagttacctggatttattttctttttttattaatgcagcccaggcttcccaaataaatttcaactttctgctctatttggagttgtatagatccaggtaatttctgaacagtttcaccctaagtggtaaaaatacgttcatttgcacaaatgttttcaatttaaaaagcaagcatttgtttaaatttggaggacgaaatatgtttatttctccatgtgtcatttccaaattatatggattctgaaaaatacaacatcatttttctatccaaccttaagttttatgattttttttacaatatggttactgtgtctatgtcaatagacatttatgaaatgacctattaataggaattttcactgaaaatatatggctgtcatatatctttctttgtctcatttttcgtttgtaccttggggttttttgttttcttccttggatataataatgatttgtaataactacttttaagattttgctttgaaaaatcaggaatggactgtttatcatatatggtctttaaagataaaataagctatacaggctgattaagttagtttttttgcattaaaacattatttcctatatgttttaattagaaaaatcctgattttggtttttatgatttcatctctgttgggtaacaaagccagttactgtgatatttgacttacaatagtgatagcaaacaaagtacatcccagataattttgattttattttaataaggtcagcaataatcaggggagtggaacaagtagaaaattgttcccaaagggatattaaaagtggagataatctaattctccaaggtatgatatgttgacctggtaatttcagatatgattttatcattcagagttgggtgtctcctgagacttgctttagaacaatccgagatgattttcattgtcagcagctaacactaataaaattgtttttcctgcaggctagcgttttaggaaattaaatttatcgaattatacgaattgcactgtcgcttttcacattgtaattaaaatacatcttgtcaggtcctacctctttccagaaactatcagttgactatcttgtattatattttctcagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaaggtatggatataatgctttttacccagtttgcttatacatattatcagaaatcagtgaaaaaaagctaatatttacattgggatggtgaatttttctagttcctttttcctttcaacattttatttttatcatatatatctacattttaaaataactgaggactatttattctaatttctcaaaattaacagaggacttgtatacatacatctttgttctatttaagaaggagacttttagggctaattcattaccaaatgtaaatatcggtggcttttatgctgcttgtttcaactctcatgaaatcattgtgtgaatattattccaaacttattaccacttttaaatggttggtctcattaatgattgctcaactgtaatgtgtttttattcctttttgcgatttatggtcgttcattccataatctttgaagattgttttctttgtctcttttggcatcagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagagtaagttttatgatttcctgctttcaaatgaatgatcagggtctctatttatggctactagtaataagagttgattgaatgattttgtgtctggcaccatgttagacagttttcatactttttctatatttctcgcttcatttagcaattcagtgcatccattgcagcaaataatttttgccttattgaatctctaaatgccttaacaagtgaccctgacagtgctgcacctgtcatacacattgttgcaggattcctggtggttgtgccaatgaaaatctgcacagacaaactacaatttgtagatttatctcgtgatctagacaaagtgactactgttttttttcatattgtgttcaaaccatctgggtgagcctcaagttattactaagcagtttatccaattgcatcagcattgattgacctgctgcttattcagagggattagaccattggtggagagaagcgagctctggctgtgacatcagttgtcaggagaactgggatggaacgccacctctgctacttcctgcctgtgtcacctggttcctgcttttggctctctcctgcctacagtggaaatggctacaatatttaacctcagaggggtgttctgaacaccagtcacacaagaatgatggttgtgaaaatgtttttaagaccataaatgacgattggtgttgttatagttaagtcaaccaaaacatatcaacatttttatttcatatgggatatagtaaaatcccatcagtctgaaccctgcaaattcctcaaaatttggataacacagagaagaaccatgagaaaggatttcctgagcaaatgaataaacagctctgtaaggcaatttctttaaaggacttagaaaactaaacttctagcaaaacagggtctcaatgaagagggaagagaaggaaaaaaaatcacaattattgagcagtttctatatgctagacattgtggtacattatctcatttaatcctttaaaccaccatgaattgtaggaatcattatccctcctacttgaaggaaaacaaaaacaaaaacaaaaacaaaaaaccttagaaacacagcttgcactcagataaagaaataccagtccagaggcccccagtcggttgatctgtcttggtggctactaccaaactgccctccccaggtctaatcagtgtttcaagcttctggctgaatggctggcaaacagtgtgagtgtgtccctgctatgtgcccttctccttaggttgcagtgttgatagaaatgattagtgtacctgctgtgatcctctttccctcttccccaccctcattataggctgcgaagcctcctctctgcacctgataacaaaacgtcatatgagaagcatggtagatccttagcatcaaaggttgaggactcttattctgattataagtagtggctcttgactacaatcaagtctcaaataatagtgtaagagaataaagcagaataataagactaagttaacagtttaggcttctttggaatcatgcgggcctagatgaaaatcccaacactgtcctttactagctaagtgaccttgagcaactgattacaccctttgatgcctcagttttctcctctgtgttgtggggtaatagtaatatctacttcctggggttgttcgtgaagattaattaacaattatacttgtcaaagctttagcacagtgccctgtatgttatttccttggccaaactttcttactctgccatttgttcaatgtcctaatgagcatgaacactacattaggtatcatgcagaacactctaaagataagtattatgatctctatttcacagataaggaaatttaaactgggagaggctaaagggctgacttgcccaaggtcactgaactaatatgcagcagagacagaattaggagccaagtatattaagagccaagtgtattgaacctaaaatctgggctcctaaataccaagcttcactgcctctctggttccagtgagagtgggtgctagaaaagtattcaggaatgaagagttctcctcccagaagcaccctggcctctccaaaggcagttcatctgaattagtgaagcttcttagcactgcctaggctaaggctatagcacacaatctgacattgctccagggcatttgaaagcacaatagatggtcagtacagataatttaggcctcaaaagtaattttttggccccaaattatccaattatcagtctacatggcctaattagtcattcaatggcaaacctttcccagcactttgagttgtcccagctgggaactgtccccacactgaaaaatcaatctagtgtgtttgcttgcctctgcaccattcagtctgttagtctagagtcatcatcctcatcaacaaacatttatccaatttaattgttagctttgtccaaaatagcagattgaccatgccagagcctgggtcacattggtactacctttggggcctggctcaattttgcaaagcatatttattttaattgcattattttggaatcaggttgaacctcataacttggattcccctgcttttagatggcattacacaattatcaaaaattggacccaaatcaactaaattaaaagactttttaaaaatacagtgagttttcatcaaaaacttggatgaaagcataaaagcatgctgatcacatttgcaaatgacagaaagctgggagggatcgctaatatgatggatgtcagtatcaacattcagagtgatctcgacaggttggaacaggaagggctgaaaccatcacaaagaaagttaacaaaaataaatctgaagctcagcatttagaatttaaacaaatgggagagccttggcaaagtggttcatgttaagaagatctggggagtttattccatatacactcaaaatgaaccaacaaagaacgtgtgtggtagaagggagggatgccacattaccttcagctgcagtagtaggagtatgggcagacccaagttgatgatggttgcatggactctgtcctgtcagactgttcttcgtgaattgagtccagttctaagctgggatttactgtttctgggaacttgtaatggatgattgggggaaacagaaatatgtaggcaagaagggaaaagatttggtgaaattgggtcactcttttgccctatggcaaaaagaactattctcccaaagacagatctagagagaggaggggggcctcttcccgctcacttgtctgataacaagtgttggccatactagctgctgtggaagtgtgagttcatcaacacagggagtaattaaggtagttttagttttagctttttggggaacccccatactgttttccataatggctatactaatttacattcccatcagcagtatatgagtgctcccctttctctacattctcaccagcatttattttttgtctttttaataataatcattctaactggggtgagatgatatgtccttgtggtttggatttgcatcttcctgttgatttgtgatgttgagcatttttaaacatacctgttggctatttctatgtcttgttttgaaaaatgtctatttaggttttttatctatttttaaatagattttttttctgctattgagttgaattccttatatattctggttattaatcccttgtcggatggatagtttgcaaaattttctcccattctgtagtatttcactttttaaattgtttcctttgctgaccatcacatatattcttacataatttcacttaagactccagctctgtgtggtattatttatggtttgagtaatttccttaataatgtcattcactgaaattcagttttcataataccttccttcttaaagttttacatatacaaattcataaaactggagtgaccttgggatcatctaatccaagtcccatattttcagaagagtaaattaaggtttaaaggggttaactggcttgcctaatgtcggtgacagagtagaggacaaaatccagatctcatcactcaataggtttctatttcatcatactgtcacttctatttaatgacaatttattatatttttgaacatataaactttattaaatatttttaaattacaataatagtaatatatatccattggggtttttttttaaaggcaaccatttacaagtggataaaatgaaaaatgaaagtctctacttcatttatagctgcccgatcccactccttagccgtgttttagtgtgtatccataatctattacattataaataagaatttgccctgtcaagtttgagagttgatttgagccctacaatttattaaagatgctagcttcccccagtgagtcaggtcaatagagaaaggaggaaatgtgttgccagcccagtatgttttaatcttcatgtactagcatgtgttcctttaaggtagtaagtgagcagttttctccatttgtgggaatgggaggtggaggggttttgttccaagtcacagaggaaatgaatgttttagaggccagaaagagctcctgagttctgtgaagcattcctggctctgggaccttcagttctcctttgggccaaacttctctccctcaaaagtgagctcagatcattgtacatcagtgcagtcaaaacatgtcacgtttgatttgtctctcctcaaaatgtttctgttctctgcaccacagttgcttttaatttagcaatacaagtatgtatagatactgggattagcttcagagcctgcataattactaatgagaaaacatacttagtgtcctcattagttgatcatttcaagtatttttcagcatactaggatgttttctggtaatcagtgccacttaacggagtaacagacttgcaaatacgagaggtgctgctcagataaaaccaggcaccagcaaatggcatttaaatgtgttcacaagatagcctatgaaacaatgtggcttaagacacgttagaactacaaggtaaacagaatgaagctgcaaaaagagtggtttcatgaagcatctcagaagaccctctcaaattgttaccaattcaccagatgatttcacgccagttcctgcccctctgtgggccagtttcctgatccaaatggtaaagagattaagctaaattcattcccattatctctccaggcttctcattccctgatattctgaccataatattaataactgctatagttccactatgagtacaggtcagcatttcctaaaacatggtgcccagactgctcctacgagaaagaggtggggtgtttgctttaaaatgcagattcccaggccatacccactcagacatactgaatcagaactgggaagaaggagaggcaggcaaaaatctgtactttaaaaagtgccattggatgattctttggcacactaaggtttgagaaccatcgatatagtttataataacaactcaattttaccttgaattttccagcttttcctggggttgagaagggatgagcaatagagatataaattttcctgaaagcaatcaattcatttaacaaatacttactgaatggctgctaggtagtaggcactgttccagggcaatggacacgttgctgaacaagacaaagcccttatccacatgaaccttacatacctgtaaaggagaaaaagagtaaacaaatatacaattgcagtgatgtcattggtgggaggagaggaattttttgctttttgctttttggagtgggggcatagagttagatcagaaaagaaaaaattggggggaaaatatattcattgccaatttttaaaatgtcactttttaaagtgtaagaacctaagaatatgtatacatagtttgacttatacaatgatcacatctaaaatttttagagctatagttgagaaaagtaacattttaaggggagaaaaacgtgtccttagcgtagtctacatatttagccagggctgaaagtgagatagagtaaatattagattccactctgctattaaagcctcacatcactaatttttgaggggtggtgttttccatgggtctcacttaatttccacacaaatatctcatttggggcctgggctattgctgaagtctgacttgtatagctgcgttactgccatatgaaacacacagacccattttagtttacataatatccattgctgttgtttgcagctctagattcccattctaggtgctttagagaaaccttccttaggcattggctgtcagtaaatgtaatactgtgtctttgactagtgagaaagccagagttctgacagatcaataacccctatagggtggaaaaaaattagtataaacaggaaaaaagttcatttaaaaaaatctttttgcatttgacctatgttcgattggcatgatcagtaagcaaatatttctagattttctttgtcaaaccccaaacctacttagcccagagacagagcaatcaatgtagggcagcagagacacagagctgggagtccagtccttccaactctaggaccagtattcattgggtgaggttttcctaaactggtaggccaggcagagaaaaaatctaaaacgttttgttccgttcctttacatcttatgtccaatagaggagatttttcttttcctccagcattggatgctgaccctccagtcacccccaagttactggtggctcagactgaattcactttggctccaaaattctgagacttggaccaaaaccactgcaggtgaagcccagaggatctggctggagcctggcaggctgggccggctggctttccttcttgctgggctccatcagagaaaagtacacacacagggtgggcagggacttcacttccctgtgtgcagaaggcatgaaatgtgagcccagcaggggcagaagcctgcagaggaccctgggtgaaagctacacactttgatggattctgaacaaatattggaagcagagagattgttgagttgtgagccatggattcaggggagtcagtgcaggaggtagctgtcagatccattctcaggggaaactattcattctttagtctttttctctctcccactattttaaaacaaaataatgctgaatcagtgtcaagttccaggcaataacatcatacctggtgtgatttagcaatatttagaatcatttaatgcaagagccagaagtaatcttagggatcaggtagtccactttattcctgttccagagactgaaactgactcagagaggttaaatgccttgtctagaactgcacagcaagtcagtgcagagcctggatgaggaccccatgacctgctgcttggtccaacacactttcctttactcccactcatttgggagtttcacaagtagctccctcagcttttgaaagggaggatctgccctgaatttcattctgctcttggagagcctgtggaattattaaataaattcataaataaggagaaaataaaaaaggggaaagttaattcccttttccccactctcttccagttaagagtctgtgtgctggtggggcgcggtggctgatgcctgtaattccagcactttgggaggccaaggcaggtggatcacaaggtcaggagttagagaccatcctgtccaacatggtaaaaccctgtctctactaaaaatacaaaaattagctgggcatgttggtgtgcgcctgtagtcccagctactcgggaggctgaggcaggagactcgcttgaacccgggaggcagaggttgcagtgagccaaaatcatgccactgtactccagcctggcaacagagcaagactctgtctccgaaaaaaaaaaaaaaaaggaggaggtagtggcaagtgtctatgacataggatcgtgccgccatgcttccttctcctggactttgctcccatggtctattacaacacagaatattcaggacttcatagaatcccaggcattgtgtaggattgttgggaacagagaagccagggctctgaactggaccagatgttataggatcttagaacatcagggctgaaaatcaaaaactttctacttcaacccattccatttcataaatatggaagctgagggatggtgattatttcagacatcataactgctatcaatatcatcactgtcatttgttaatcatgtactatatatcaggccctttacatatgttatcacatttaatcatcacagcaaaattttgaggaaggccagggatggtacacatggtaatcccagcatagattgtagggaggtccagccaggtggatcgtttaagcccaggagttcaagaccagtgtaggcaatatgggagttcaagacctgcctaggcaatataggagttcaagaccagcctaggcaatatagagacactgcctctacaaaaaatagaaaaaattagatgggcgtggtggttcctgcctgtggttccagctactcaagaggctgaggtgggaggatcgcctcagctggggaagtcgaggctgtagtgagccctgatcacaccattgcactccagcctgaggaacagagcgagaccctgtctcaaaaaaaaattttttttgaggaaggtatccccattttacagagtagaaagctgaggttcataaaagcaaaatgatcctacattatttcccatattaggggccagaacaaaattgagattaaagtagctggactctctgatttttttttttttttttttagttatttaatactgcttcttgggaaaacacaaagaaaaaaagacccaattaaataagcgtctcatttcctctcacccaggtagctccacagtaagcacctagttgcttattagctgtttcttctccaaccaggttaggatattacagcaaacctaagcactcttctgactattctttcattgaaaaaatattcaacagttatttattgaggtgtaattatgtgccagtcactgtactgttgacagaaacataggaccaatgaatacatacctggagagctccagtgagagtaaagcaaaatgctttttaaagatttcataggccagacgcggtggctcacgcctgtaatcccaccacttcaggaggccaaggcaggtggatcacttgaggtcaggagtttgagaccagcttggccaacatggtgaaaccctgtctctactaaaaatacaaaagttagccaggcatggtagcacacacctgtagttccagctactcgggaggctgaggcacggaatcgcttgaacccaggaggtggaggtttcagtgagccaagatcgtgccactgcaccccagcctgggcgacagagcaagacaccatctcaaaaaaaaaaaagatcccaccagctagtaacatcagacatacttaatagctaggaggggtaaaacttgaaatcacagggtcagcataagtcctggctgtaccactattggttgtgtaacttgagaaaatctcttagcttctctgagcctcagttttttcacctgtaaaataaagattaaaatccctacccatgaggatcagttcagaaaaggaatgcaaaatgatgcacagccatgttaatgtgaaggaaatgatgtgcctatttacgtgtttctgtgtatctcttaaatctctgtgttgttggctgtcccttgattagtatcttgctgtgtcagtcttcctgcttgcagcagaaaagtctttactccggtgattcaagaaaaactctggttccaccagaatttctgaaagctgggtgaaaactttattcctacttatatcgttctgctcttcggactctctagatccatgctgtccaatagacctcccctcagtgatggaaatgttctatcccacatttggccattgaacacttgaaatatggctaacatgactgaggaactgaatttttaatttcatttagtttttattaacttaaatagccacaagtcctgagtctgatggcacacagctgcctgggttctgccaaagagacctctctttccaccacttcctggtttgttttatctcacagaaattcatcaacagccagcaaaaatcattctttctcttgttgattatttctgcgattctcaaacttcattgtgtatgagaatcacctggagatcttgataagacagtttggtgggccaggcacggtgtcttatgcctgtaatcccagtacttcgggaggctgagacagaagaattgcttgagtctaggaaatcaagaccaacctgagcaacatagcgatacccacccccaacccacgcccccatttctacaaaaaaaatttttttttgatgtttgctgtgtctacccccagagtttctaattcagtaggtctgtggtagggcctgagattgtcatttttttttttttggagacagagtgccactctggcacccatgctggagtgcagtggcacgatcttggctcactgcaacctccaccttgcaggttcaagcgattctcgtgcctcagcctcccgagtagctgggattacaggcacatgccaccacacccagctaatttttatatttttagtggagatggggtttcaccatgttggccaggctggtctcgaactcctgacctcaggtgattcaccaccacccccccaccccccagcctcccaaagtggtggaattacaggcatgagccaccgcccaggccgaaattatcacttctaacacattcctgggtgttgctgatgctgccagtctggagaccacactttgagaaccactgggttaatttagcatctcatggggagacagctgtgctatagtgaaatgagtagacccttgagatctacttggacacaaactcctggggcagtagttctcaattgggctactccactttggagtcacctggggagcttttaaaattcttgacccctgggctccaccccagaccaattaaatgagaatctctaggcgcaggacccagacaagagttgtttcttcaagctccccaggtgattgcactgcacagtcaagggtgaaaaccactttgccaattcggcttaagcaaatttccttgtctattaagtgataacgataaaatttgctgtatttgtatcacagggccattgtgagaatcacatgagactgtgaatgtgaaggggttttataaactgtaacacctaaaagtaagaatttaggcattgatggtcttggaagggcctgtttgcaagtgatgccatcatccccactgaagcaggataatgctgctctctctggtttgcattctagtactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtaattactactattttatcttcagtctacgtcctttgaagaagcctgaaaccttctgtgtttgtaactgaatcattggtgaaacgttttctcaagaagcaaatgtgaaatatgatcaggcactaaaaagactgagcagcgagtcacggagggagcactaggcttgccaccaggacccgtgggttctagtcccagttctaatgtggacttgctgtcacaccctgagcaggtcacttgcctgacgggaagttcaattccatcctccttaaaaggaagaggttggatttgatgatctcttgaggtcccttgcagctccaacattctatgattctcgaaagattctcatagtgcataagctatttcctgggagcaagtgtttgctttggaacattgtatttacctcgtgggtttctgtttaacaagttactattctagcacacctgatggggccctaaagagttcccacaccttctcaacccccagttttattccaagagaacactcttagatagaaagatttagtccatcctatcatactcagtgacgccaaacacaaaaaggaaaagtgatttttcaaaaacatagaaccttggatctaagctcctctagtaagttccacatgtagattttttaaagtttattttattattgtttttattcacaaatagcctgtttaactccatcttccttgcttcctttcagttatatatttttaggagatgataccaactttttaccaaatattatcagaaaaatccatctttcccctctttctctttcctgccatcacctccccaatttcatatcactaccagaaactcctgtttaatttttaaagtgcagattgccaggcctcattgccatctattttggtttggtagactgtggaagtccagaaatctgcatttttaacatatgctttaatgattctgatgtcatcagggtccatgttttatactctgagactaaatcattctgtcctgtgtatgccttctgtggagggatcagtaggagagatggggtggagttacaactagagtgccagtaatagcttaatttgtagccaatctagtgtacaccagagctgagccagcaatgtgactgtcatctattaggcatgcaacaaaggattaagtagactgtaagctccatgcaggcaggtgccatatatgtcctattcaccatgttttctcccagtgcctggctccaggaataacacatacttcatgctcagtagacacttggctgagtgaaggaatgaatgaagctgttcatccaagaagcacaaagagatatttgacttgtgaatacaacaggccaagatagatacatacgtggcaagagatttgaaagttaaaggaaatctaagattaaaggaagaaccacatataattcagccccttacttgttatacccaatatttgtcgaaccatcctgtgtactgggcaccatgcatgggctttcaaatcctttcttttatttaattccctcaacaatcttaggaggtagcaattagaatttttgttttataaataaggaaaaagaagtccagagagatttaaggagcacccaaagccacaccccaagtcatcatgtccacctggaagttccagggcacctatcatgaaagaagaatgagatgatgatggacataatataaactatcaggacagatttagaaatagccctctgcagccccaatgttaaaagcagagaaggtaatacaaaataaggacttgttttatgttaggccaccctttaatttgtgatagacttctggcacttacagggacttgatttttgttttgttttgttttgagacagagtcccactctgtcacccaggctggagtgcagtggcacgatcttggctcactgcaacctccgcctcccaggttcaagtgatcctcctgcctcaagctcctgagtagctgggactacaggtgcacaccaccaagcctggctaatttttgtatttttagtagagattgggtttcactatgttgcccaagctggtctcaaactcctgacctcagatgatccacccgccttggcctcccaaagtgctgggcttgcaggcgtgaggcatcgcacctggccagggacttggtatttttaaagtgtgcacaatggaattgtagtgtctagcctcaggccttggcagtttttaacatttaagaaaatcaaggacaagccctgtctcaggatccctggagggaacagtctcatgttcattgctgagagaggggtgcactgggcttcatctctggaacccatgagtgcctgctcccccatttcctgtcccaaggaaagccagtaattgattctagtaataagatagcaggtgccacagcccatatcttcccctgggctgatgttcaccaaagacattagcatagacaagtggtgctagttgtttatcccagagaacatagtcttattcattgtgggtatctggcatgcttcatagcaccacactggggtcccaatgctgccccatggctgtctgtgtgcctgtgtgtcataatgttatcatgttggacagattgaacagacctgtttaatgtttgtcttcctctcacctcccaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacaggtaagcaccaccttgccaaaaccgcatcctcatttctctccttccctttgttatggtggaatctggccttgaccactacacacaccagaaaagtgggaaaatgactaccatttttctgaaatctgttaagtttaacctagtttaagcaaagaaacatgcatctataatttgttgtcataaacttctagtaaagaggatccatagtctattgaattatcattgtcagtaagcccaatatacgaaaatctaacttcctactagagatctgtggacagtgggactagctgcttcagggtttgtttgttttgagacagggtcttgctctgtcacacaggctagagagcagtggtgtgatcatggcctagtgtagcctcgaccacctggactcaagtgatcctcccacttcagcctcctgagtagctaggactataggcacatgccaccacacatttgtcctgttttgtagccctgtttcaccctgttgcccagactggttcagtgttcttgttacaaagcctttcctagggagattacctaacccagcccattcctgtggagcagaggtgatgaggtttcccctgtccccagttcttggctagcgacctaaagtaaaaccaaaacactatagacatatcaaatacaacttgatttaataacttcgattggcaaaggactgagaaaaagcaaaaatggttcaactcagcagttttttatttttatttttaaaattttattatcattatttttgagatggagtctcactctgtcgcccaggctggagtgcaatgatgtgatcttggtttactgcaacctctgcctcctgggtccaagcaattctcctgtctcaccctcctgagtagctgggattacaggtacctgccaccatgcccggctaatttttgtatctttagtagagatgggatttcatcatgctggccaggctggtctcgaactcctgacctcaattgatctacccgccttggcaccccaagtgctgggattcctggcgtgagccaccacacccagccaactcagcagttttttaaccacaaacataaaagatatttgatttatgcctgtctccctctatagatctctctctttctatcttttgggagataaaggatcccaaggtggggtgggatggagaaaggcgcgtgttgggcaaaggaaagaatatcatctccctgtggccatggaggcccttgccccagctccctttgccccgggggagagtttcctgttagacctcattctttctggtcagactggggcctggggaggtggtgacagagggtgggggctccagaagtggccaaatgaggggctcatccttgaccttttggtcagacacaagcacaggcttggctgttgaacagagttcaagatcagaataatatgctcttggctatagaaaacatgtttctcaagcaggtggtgagtttccagagcatcaaatgcaacctctggtacagatggccccttctttctgtttcactggaaatgtgcattggtttgcccaagcattgtttacttgcatttcttgggatatctcctattagctaaggttagatgtgtctgtgccttaagaggctaggctggttcatcatttgatggttgacatgcaggcaaagacaagcaactggtatggctgcaatgaggattcagacagtagctgttccttcagtattccaaatggaaactgacttcctcctggtctttggtccaggatgagaaactcactttttttttttaatggggctgctagacttccaagagagccattaacgaaacaaaaaccaaggcagtctcaaagagtatggattccatttggaaggctttcaaatggcatactggagcatctgaagaaaataaacagatttaaggcacaagcatattacttcatcaggactggaaggaaactggttcaaggctgcctttgaactaaagctctttagttcaatttcaaaaccattcagcaattcctacgtcagttaaacattcaaaactagaaagtatggagtttagttcattttaaaaagacaaaaacaaaaaactagatccagctttggattcctacaagtaaaagcagtacattgcttcatctccatggcaacgagtgttgagtctagttaatcaacaaatattcactgacctaggcaccatgctgcatgtcattgggttttcagagatgataacacacatccctagaggacatagacatgcaaagtaccacatgtgatgcaaggtgttgagtgccaccatggagacaagggagtgagttcaaagtgctcagagacagcaggtgggggtggtcttctcagaagagatcacaggagctggtcctttgtaagtgcagaggatgtctccaggctaaaatggaaaaagtgagaatccaggcataaacatttgccaaaagccattgaaaatatggctaagtttcagaaaggaaacagctgaaaattggagtgacaggagatgtgactggtctgataggtcagggtggggcgggacataaagaaccttccacgcctaggtgaggggagcagagtttatcttgagaacaacgaggatccacaggttttgtccaaaggagcttgatggtcaggtttgcgttttagaaagatttaccctgtcagtgagttttgggcatagattagagtgagaaagaatctaagaggaaaaaggccagtccaggtgtgagagccatgattcaagaggagggtccatccctgaaggccacatctttgtttcactctttaaatggaaattgacagatatctaagaggccaggacgtgtgggtgccaggaagacccaacctggagagactgggcagttcagtgcagagaatacaaagtagaaattagtagaagggtggtgctggtcctctttctgcatcccatttgttctattccctgcagttacagctgctcagcccgctgcccatttatgtggagattggctgggggaggaggcagtttggcatggcagaaatagcatggactttggaatcgagcacgcccagattttaatcttcagtcctatgtttaataagtaggcgctattggggaacacatttcagttctctgaaattcagtttccccatttgtaaaatggggataacaatgtctatgtcatagggcagcagtgaggattacagaaaatttagttggtgatgtaaccaaactggattcaggataggcaactctgaattcacctatggtcccccttggagtgatagtgacagattccctcaagttaggcatatgccttcccctaccccttggaagcatcaaactcagtggcatgaggaaacaggtggtggctttagaaggcagtatgtttggtgacagtctccttggatgcttaagagagaggctcaaaggaggatagtgatattaaagtaattaagctgcacttaacaagcacttacaatagaccaagtgctctacagtggtgtctttgggcctccccgaccaggtagctcctgttcctgccctcattcctgctgtggttttagcctacaacaaaaataagccctcttctctcatttctggaccttacaacaaacactctctttgtgacttactggttgaaagtgggtttgataagtgtgaaaatatcaggaaatggcagaaaaggcaatgcctgggaaacagtgtgcattgctgtgaatattaattttcatttgaatatgagctgccatggatcttgacttctgaataagcttcgttgatcataaatggtgattgtggagtatcagctgggctatttacattacaaaattcatcccaaaactgtcttttcttaaaccacagagagctcatgaaaaggaaatggcatcttagaagtttaactaggcttgcttccaggaaaagtattaagaatctggattagtattggtggtttgcacaaacatggcttttttttctctcattctttttttctttgtcctcctcctctctgtaccccctcatgaaaaactaggcggtgaagtggggcaggaaatggtttcattcagatcactctcctttcctgcagtaaacagggggttccccacagtggttggctttcaaacgtttttcaggttccctgtttatctaccctaaccattgccctttgccagtgctgcatctctgaagtaatgcaagtgctttgaatctggtgggataccaatgagttgatatctggttgcagttaataatgtttcataaataagaagccccctcaccaaacagaaagttagtgtggcattaccattttataaatatccactcattaaataagcatcgagggcccactatgtaccaagcattgtaccagtctcttgggatgcaaagatgagccaggcacgcattctgttgccaagaagtgggcagtctactaggaagtcatagattatgatatataaacttgatgtatagtgattagtgctcaggccctgaaaagggacagatgcagtgtagagtaagtccagattactgctaacttttttgaggtgaaggaaggtagaagtgttggtcatgaatgacttcccaaagaggtagcatctagacatgagaagacataaagaacattccagatgaaggaaagagaacagcaagggcatggcagttgaatgcctcagtacagtttagggttaaaacaattacagtggagttgcattgtgcatatattaaaatcacacatatgatacaagtagaaagaggagaaaaattaagagtgcaggctattgcatttgatgactgtatgtcctggagtgagcatgaatccactgtaggtcatggtttctctgcctctggtgatgagtggtgagatgatgtcttgtgcttttgggaaagttaaatgattttcagggataaaactaattctatgtgatatttaccttctggcttgatgtgatgacctaacctcagagcaaaacgcttttcctgtacagaaataggggaaataagattggaaagatagttttgaaccagatggcagagggaatctcaagtgctcaaatgccattttgttgttccccatggctttcttttccctactcaggtcatctctcaggtgagaaaatgactcctttctcgtctgactctagtctttttcctggtcttattgaaacacgacctctaagactgagaaggaggaaggagggcagaaccatggcagaaagtagtgaaacagtgacacagcaggactagacaggtggctgaccacggcacaccctccaccatctgtctttccagagctccactgctcactgtaaatggttacctggttacccctgcttttgcatcagataaagccatcagctacattgcaaggaaaactaaatatcaaacttagcggggcaaaatagttaaaaacaaaaatggtgggagaggggagaggccacaggatttagagaccggagatctgagttcaggtcttcaccctgaaatgtgctgtctttgcaatcttggacaagttccttaccctctctgaatctcaatttccttccttctcacagggttaaagatgtctactttcaggtttcttataaaaattgaatgaactaatatgtactatgcagaaaaaaaattagacaaaccttcactgttattatttgttttacacacttccatgaagagccagctgtcttgctaagaatccataaaagtgttcatgcatccctgcaactgaatatacacattgtgttagggaatttcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagagatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttgtcttaggattgacttggcaatgcgggctcttttttggttccacatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttagttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgtgttagggaatttctttgtgtctttctttaccagctagactgtggggttcttaaggacagggagagtcttatttatctttaaaattactttagcatttacaagtatctggcatatgacaaatattcattgaatgaatgggccaattgtgagtatcagaaagtctcccaaattagaaaaatctgaattaataatttttagcctaccactgttatgataaaagtatgaattcttgaaaattgccttattttgattcagattaattcagtaaatatttattgagcatcaactgtgcaccagacacacattcccttaccctcaaagagtctgtggtctcactggagagagagacagacacatactctaccaaatcaaagacggtcagactgaaaagtaccatttaaatcagcctcaacacagactgctgacttgacttgtcgcttcctgaccagcgtgggctcaatgtctctgggactgcccatcagtaaaggatgttgtgtatgacatgagtgatagcaataaggtgaattcccagagaaaggggtagagctccgagtggggagtcctgtttgtttgtgtttgagctacacatacctctctctccaggggcccacctttccttcccctttggctggaacagcattgttgtcaccaagttagcctttgccctaacacctgctcagaaaggggagttacttttccccttggtggggctcctgatggttactatcatccctttctttatcccctactccctgccatgaggaagagaatttgacatttctcatataagcccaagaggcagaactgggaactacatatagcagcggtccccagcatttttggcaccagagactggtttcatggaagacaatttttgcttggactggggtcggaggaatggtttcgggatgattcaagcttattacatttattgcgcactttatttctattattattacattgtaatataaaattaaataattgtataactcaccataatgtaaaatcggtgggaaccctgagctcattttcctgcaactagatagtcccatctgggggtgatgggagacagtgacagatcaccacgcattagattctcataaggaacgtgcaacctagatccctcacatgcacagttcacaatagggttcacactcctatgagaatctaatgccgccactcatctgacaggaggcggagctcaggtggtaatgcaaataacggggagtggctgtaaatacagatgaagcttcacttgcttgcctgccgctcacctcctgttgtgtggcccagttcctaacaggccatggaccaataccaattggggacccctgatatataggatggcaaattttagctcaatgtaagaaaaactttcacatagaaagaaccatttgaaattggaataagctgccttgaggagtgagttcctgctttggggaatgaggcttacagagactagatgaacactaggtgtggactcagtcaagcatcttatggggactaggattgactagagcagagcttctccagcattcacatcactgggcatcttgttgcattgcagattctggttaggtaggtctggggcagggcctgcctaaacggattctgcatttccagcaagttccccagtgatgctgatgctgctggtctggggaccacaccttaagtatctaggaataagggaacctattggtaattaggaatccatgaaattaatagctaccatttaaaaatactcagtgccaggcactgtgccaagggctttacatgtgttattttgtttaatgttgcttaataaataaacttggaagtacctgaaatagattatagcagatacaggaagcatggagatcagtcaagagctattaaaataatctagatagcaaagatattgaagatcctcatccagaggccatgggtattgagagggagatataaatgcaaggaacatcacagagataataacggaagttcttgcaatggattaaatatgatggctcggggggaagaaattgttagagatgattataagagtgatgtgaaaggctgtaatatcattaatagacaagcttagagacgtggctgatttgaaggggaaggtaatggcttgagttttagatagagaggatacttgcaaatattcactaagtgctcactatatgctaggcatggttccaaatacttgacatgtattaactcgtttacttctcataacaacccataaggcagctaccattattagcaccattttacaaatgtggaaacagacccaaagtcacccagttaataagtggtcgaggccaggggtggtggctcacacctgtaatcctagcactttgggaggccaaggcaggcggatcacaaggtcaagagatggacaccatcctggccaacatggtgaaaccccttctctactaaaaatacaaaaattagctgggccttgggaggccaaacaggagaatcacttgaacccaggaggcgaaggttgcagtgagccgagattgcatcactgaactccagcctggcgacagagcaagactctgtctcacaaataaataaataaataaataaataaataaataaataaataagtggtagagttcaggtctacagccaggaaatctaattccaaagctttgatgtggtaggttttagagtttgtaaagttctttactgttgttagcttcttaataactcccaacctgtatatttatttttagcagcttacacttttagtgcttatataatcatttctcacagattcttgatcctctatgtatcaatttaacagatatttattgggtgtctcctatgtactaggcttggtgctggagatacaatgttgagcaaatacagttcatgcccccatggtgcttacagttaatgggaggagaaaaaaatcacataactatctgacttcaaactgttgtgtcctgcaaagggatagattagaatgccagaggagaacatgatctagaataggggtaaaaagggaagcttccttcaagaaatatttgatctgagatccaaagaatgagtatatcttaaccagatgaggatgggaaaacatgagcacagacctaaatatagctctattatttcactccatcactctctccccctgactccttcttccctggttccacctacctcgcaacccctccctcttgctctaagcagagatgtctatgcctggatagccaaaatgcacagaaatccaacggtgtctttaggtgttcataccacacaaagattaggagtgtgatctatctgtcgcatctctaaccccagtggttataacatcgcttgccacagaataggtgttcaataaatatttgttgaaagaagtagttagttaatttggtgcacagaaaataggagagagttatagaaaagctagttcatctcaggacgaggagaaactttctaacaattagagatgtccagagatggaagacatcttgttataagagaaatatctctggacttagagtaaaagaaaatagccccgtgctaattttgactatgggcaagtcacttaattgaggcttaccttccatacctattacttaaagataatctttgtcctgcctaattcacaggattgttgtgagagtgagataagataatctaagtaaaagagtgttgtataaagtgctattaaatatatatgtgctattatggcataatatagttaactcccagtccagccactacctgacactctctttatggtagcttgtagtagagattcttgtcttagatagaaatttgaactaaataactcaaaccctttccaatctatatatacaatgattatgacacataagtctattacttaaccatttctgtatgttacatatcaaagttttgaatatgtaatgccagagttaaaatactaaagcattctatgaaaattatatagatcaaaatgcaagaaatattaagaagcttgttttgtttaatggtggacaaagaccttaaactaaaatctgctgtgtataattctctaggaagggggatagtccaaatgcctgatttccccccgaatttatgaactctgtatattagctccgtagccatgtttaccaagctacaagaagaaaggagatccctttaactaaaatgtcagtgattaggttttaagggatttcaaattactagggaaggacccagacacttagtgactccctagtgatttgaaaatcttcctggctgctggcagtagtttgcatggagactgaatattatctcagcccttttgaaaaagtaaagaagctacaaatccagtggctgttcaaaacaacaaagagggttgaggtgcctttggcttctaacaggactgtctctgaattcctcaaggaattccaggcctagagttgatccagctggcaggaggtatcgatctccacttgaattcactgaataaataatggttgccatagttattgagcagtcgcaactggttggagagcagggaaaattctgcagtaccttctgtgagtttggccatgagaaagtctggttacaaggttccacaatcagctccctccccaaatccagccaacatattactcagttcctgtatcctgatgatgaatatgagatcttgaatgttatgtaagacatgagacactgaaaggaagggaaagcttaaatcaatggactggtatttattctgagaaaggcgtctctccctaggttatgaatataattgaatatttttcattattaattcaatttagtatcagcaaggtgatgtttgatcatgttatagcattcaagggcttcacaaaggacgaaatccatctcgttctattttaacattattatacaaagagcacaacctggacattttaaaaggaaggaaaatttatcccaaaaccccataggtattttcacgtttatattttctttcacccttctctatatgaagaaataatttttgcatagatggaatcacagctttagtatttaatattctactctttatttaatgttgtaaacgtttttttttttaattttgcttcatggccttcacatttgttctgtttgatgtcttcagaatcttcccttccatataccattatttacttaacagttcccctattcttcagccctttgcctttttccagttttttgtttgtttgcttttgttttgttttgtcttggtaatagataatgctgaaccaaatgtctccatgtatacagttttattcttctgttaaatgtttcctttggataaattcccaagagtgggattacttggtcagaggctatgaacgatttatagctcttgaaatttactgccaaatttacagcctgttcttttgttttggggagaaaataaaactttaggcagaacaccactgcatgcaggattctcttaaaattcattctcttaaaattcacaacagtctcttctgagactgaaacatggagcctgtgtatttagtaatgataagccgtaggagacaggtccgcacctgggctgattagctaatagtttctcagggaaagcaaaatgatgcactgcaaagcttggaaattaggccacgaattgctttttgttagaccttgtagttaccagccacttgcccactggcaagcattgtctttggttctgattattccatgtgtatagcactctacagctgacagaccacttttccataacattatcttaattgagccacaataatccatggagttgggttttattatcattgtactttttcttttaatttattacataacattgaagacacacaggaataataacagcaaaggctgtgtatctgccactcaataattccgattttcctgtgaagacattgagccttagagaaattaggtcacccagctagtaaatgacagaaccagaactagaacctaggtctgtctaactccagggccagtgcccatctctttatagcatattgcattgagacaagatgcctgcaacttacagtccatggagatcccgctggcaatcttcatggttgtattttaatatcattataacatatcaggccaggtgcagtggtgcatgcctgtaagcccagcactttgggaggccaaggtgggtggctcacttgaggccaggagtttgaggccagcctggctgatatagtgaaaccctgtctctactaaaaatacaaaaattagccaggtgtggtggcacacacttgtaatcccagctacttgggatgctgaggcaggaggatcttttgaaaccgggaatgttgcagtgagctgagatttcaccactgcatagcctgagtgacagagtgagactctgtcaaggaaggaaggaaggaagggagggagggaaggaaggaaggaggacacatcagagctttgggaccttacagataatgaagttcaaccgtctccttttacagggccccaaagtgggaggaacttccccaaatcatacacaactagccaaactgaggataatgcaaattttctggttcccaggcctcttatttgggacaagaaaaaagtgtctggatagttcttcatttttcttattggcttttgcttcaaggaaataacttttctaacaaaaatgcccccaacttaaaaaattaatttagagccaggcacggtagctcatgcctgtaatttcagtgctttgggaaactgaggcaggaggatcacttgagcccaagagttcaagaccagcctgggcaacatagtgaggccctgcctctacaaaaaataatttaaaaatcaaccaggtatggtggtgcatgcctatagacctacctacttgggaggctgaggcaggaggatcacttaagcccaggagttccaggctacagtgaaccatgactgcaccactgcactgcagcccaggcaagagagcaagaccatgactcaaaaaaaaaaaaaattaatttcgtaaaaattagaaactattgcttgatttcccattagaaggatgtcttccatctctcaagaattatgattttacatgtaaatgtactgagagaagaaaacttcgagataacagaggccaagctcttcctttagaaatgaggctctgaggccaggcacagtggctcatgcctgtaatcccaacactttgggaggccaagatgggaggattacttgaggtcaggagttcgagaccatcctggccaatatggtgaaaccccatctctactgaaaatacaaaaaattagctgggcatggtggtacacacctgtagtctcagctactcgggagggtgaggcaggagaatcgcttgaatcggggtggaggaagtgggggagcagtgagccaagatcgcaccactgcaccccagcctaggcaacagagtaagactctgtctcaaaaaaaaaaaaaaaaaaagagagagaaatgaggctctgaagtctaaatgttgaggaaaagcatagtgatttgttgtggatgtcaggctcccttctcattgctttggaacaagagaccagtatttgcctcagaaaactgggttctaatcctagcttttagcagctgagtgactttgggaaattcatttaaccttatacataagatagatcatagtatttaacatggagatcattttatatattgttttgtaaaatataagatactggtatttgtgtcttaatacattataacatgcctgcaccacatccttctgggcttcctccccttctctttggcttttccatctccacagcaggaggacatgtgtattttgtacagagtgccaggtgtaggtcaacaggggtttcaagtgggggggaacaaaacaaggaaaagaaaagctgaattcttctcagtgctggttagcatgaaaacacaggaatgcactttgctgtgttgggtcttttcgagcagcccttgcattagcaaatggaagttacagcctccccacctcccttaaatgagtctgtcaagatagaaacattaattcatttgcctggatgtgtttctatgtcactctgaaaaatagttgcctactgacaaggctttgtgagagcttagtaggataatgtatgcaaaataataaccaccctgccattcattccatgtggctgtgtgccaggaactgtgcttcccttgtgttacttacctaagctggccatcccagaaaccctgaattgggtatgatcattttcttcatctcataaggaaatgggtgctcagaagtaaagagacttactctagggcacacagcaagtaagtgttgggactgggattcaaaccttggtgttgcttcataccaaaggccatgagctatctctaacagggagggcactttgattgcaaagaagctatccaaactggcagaatgagacacagacctcaattagggattcaaagtgtcttaagatgtatttgcctcctaaacttcttgcccttctctatccctctgcagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggctactggtgtattgaataagcctgcttcatttaacagttttctcttaattattatgtaatagtatttgctgtgaactcttaagcacatccccaaaattgattttttaaaggcttagtaatgctgaaaaattaataggatttctgtattggatatatattaa

SEQ ID NO: 12648 - DNA, 94748 bp, Human
  misc_feature (1)...(94748): n = A,T,C or G
agagcttacagatgtttcagctccacgtggtaagcttctttgggccctcacctgcatatggagccgaagaggtctgttttctgacagagaaacaaacccccagggtgctgagaatggtgacaggatgaacaggttgcaggatccttgccaccaagtgacatccaatgctgacagtgagtgacggcttccccgggaggtgctttccagagcacacctcgtcacaccaccccgacagccaccttccccgcaagattgacataatcattagctattttcatataaatgcaaaagtaaaccttctcagtgtttctgggaaatttcatgctgttacatcccagaaaacgatgttgatcctctggcattctgtttgacactgatactgaataagagcagtggaaagtcagtccccgtgaagctctggaactactgtgacctcgagtgtcagtatcaaaagagcccatccaaacatccttggccacgtcgctagaaaacagtgtattggaggcaattttaaaatgctttgaacaattttgtttttattttcttttgcttttggccacagtttagatacattttaggctcactgccctgtgggtgaagacaagctgggaaatgtggaagagtcttccacttacccatcagaggttccatttgaattcagttgtgagtctgggctgggagcgcaggaagcggttgtgttgaatgtacagcatgaggggatggtggggttcccaggtgtgccccaaacctcctgtacctatacagagatgaactctttctgcagcagcctccagtgaggaggctcaggatctcaagtcttgagggtttctgagcctgccataggccagggacagggatttggctgctgatgggtgacatgctgccagctacagaatggggctggctgggcactgggagcttggtgatggggtgtcacggacattcctacaggcccagcccgtgtttagaatcacagagctgagccgatgcatgtcacggagaactgcctttgccctgtacacgcatgctgcattaggggcctgccttgggcggctcagctggccgcgcctctgcttgtttagggtgagcctttgcacagggcttggctttgtggagctcatttggtggccaaagatggtgttgcagccccagcccgctcgcaggcccagtaccttttgctccctagcttgccccaggccctcagactgtgcggtgcaaaggtccttggaggctagccccgggctggctgtgaggggagagccaggtgccgcagctctccctggtacagacttcagctgcctccaggacccggggcctgaaggaggcagaagccggcggtggaaaagggcgcacgtctctcccagcgtcgctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgtaagtgctccgcccgggccgccccgagtctcccggggaggaggagaggatgcccgggctttgttagtgtcgcctttcctaatgcctgtgcaacctggagcccaggctggcctggggttcttcgcagccttggaaagctttacctggggctgctctgggaggagcatctggtagccccaagttactgctgtgggcagaaacgattccctggaattcagttttggtcgctcagcagtgggtgcatggctggggggcttctcctgccgtcagcatctttcctctgcacccccggcacagtggtatttcctgcaagggaacagccaggcatcagcgactgcctcctcctaggaagaacccatgagcgtggcagctccgtgcccggggcgacagcccagtttccgggcagctgcgcttgtggctgggcagatggcgtggtgcgctctggtggacgttccgtctagttagcctaagcatcatccacatactctggtgaacactcgaggacaaggccgcttgctattattagtaaagggccgaaccgtcctgtcattggtggaggcagtgcttgactgtgcatcgatccaggaatccgatcttttctctcaaccacagagctaacgtgctcagaagtggcctttatcctggccgagtgtttattagaattcacgtttctgttatggtcgtctccattacctacccaggcatgtttggacgatggggcgtattgaatgggtctgccggccgggtcgcatttcagcaactcaggcttgtatccaaagtggacctcccagcctcacctgcccccacttttccagagagaagactatgtttcagagaagagtattttctggggacttgggggtaggggtagtaaagtgggttcttaagagtcatggatgtgtagattaaaagatggtggggattgatctgtgtgttgtaggagggatggggccccggggggtacttcctcactggtccctcgacccctgggcttcagtgaggagctggctcggcgtagtgatgtaatgctaggctgagcctcgtggttttctgggctccagctctttagcagggagtcattcttccgagcaggtgtgcacccatcatttgtcttcacccctgtagcttgagaaagcatcgtcttacaatggaggcacatcgcgtttgaggattttctttttaaatgttatgatccttgtgctgtgcctgccttgtttctcatgcacgtgtagtgttgctaggtgcatggaaatacaactcgagtctaggcagaaaagaaccactttaacctattttttgcaagtccctatagtggaattgagttaatcagtgacaggcactggccaactctcacggctcagacctatctagtgaagagcttaggaaacagaaaggacaatgtgactgtacgtttgggaaaatgtgctcctcagtcattggaaattcagctcgccggtccctaacgtccccgccctctttttcagctgagttaataaatgatcagtgttccgtcagctgagggccgagtttagatagcttctgttaggtagctgtgcctttttggataaggtcccttaaggttctgcccactgggatagtggtgtttaaataaaatttcaggctgaatggccacattgtgatggaagctgtttatcaaatattttcacagttgagttggtccatatgcccccgcctgaggcttctctccctagaactgctgcctctgaaatgtctctaaatatagatctttacgatagtatattcactcattcacaaaatcccaccctccatcccgtaacatttttgttctaaaaaaatggagagagaggaaatatttggggccagtgccattgctagcatctgtcctcttcaaaacccgtctctgctctctgaataactggggcttatttttctagtgcagatgtgctctttcccagtctagaggttttaaaaatatatattcggagagtgcctcttttctgcccaggcacaggtctttcttggtagtatttccatgcagctaaaaatgcatgcacgtgaataatacacaagacagcaacagagtgtggggcccatggcaggaaagaggttgcattgtaagatgatgccgtcagggctgcagggatggtgacaaacacagggtgcgcacctgccgcgggggacagctcctgacaaccggaatctagagtgaatgtttccctttttctctgctggttccctgtgaaagactggcttaaggagggccatggtgtaagagtgaaatcaaaagatagaggatttggaagtgactgaaggatttttttttaatttaaattttttagttttaagatttctttccttccaattgcaggtttggggtgcctttgggcagcttttgtagctccagctgacagcttcattctatgcaggagtgcattgggctagggagggagcgacttttgtatctccccttttgagaactcaggcatcaagattggagtagcagaagtcccatgggactggggattgaagcctgaggatgaaggtgcaaatggtgaccagtctcttgctactcccagggtcggccacacatgacagcatcagcttcccaaaggggcttgctagaaacgcagagcctcagacctcaccccagaccagctgaatcagaatctccatttcatccagggacttgtaaagatgcccaggtgatttgtaggcatctcaaaatttgagaagccatgagctggttcagtcttccctccatcctgtccatgagaaacagctggccacttctctgactgctcctttcctatctggcaaagaagttcttgtagcaatagtgaccatttgtttctaaatagaatatgagtagcaaggggagggagaattctcccacagaaaacacttatttctcagtatggatggtaggagacacaggaatggacaggaagtacttgagtaaatgtgggctgcagctattgatcagacctgctgttcatcccttgattctgtggcagccccatgtggtgcggcttctgctaagtggggcagcattaagtactttgtcctttatgtagttggagacccccgtttcaggggttccctcagcttccaccaaatccccacaccctggccactgaaaaccacccagggggccattatcagagagcaaaagcggtggttctgttggcaaagtcggcctgccccgactgttgccctactctcaaagtgagcacgtgcccttggctctaaaaaacaaatcacaaatatggaaacccatactctgtagacctgtggatcgaagtagaggggccagggtggatgggagagaagcgatggaggaggaagcaacaggctctgtgattgatgagatgggggagggaagagaagagacagtggcaagtacaaaatggaagtttcataccctggtaactaagagaaagaagtggcattggccaagacagacaagaaaactggattgggagctagttcggggaagttgatgagttggctgagatttcagaagtgggtgggatcagatgtagctggagagaggccaggcaaaagaaggatctcgggtaccaccgcagtaggtagagagattggagctctccacacatctgtggttagaagtggggttctggtcccttcccttatgtggttcctgaccttttctttgggagctgtagagaaaatccgatgactctgatcctgcccctcctgcctcgcagggtttttcagaggtgagatgccacatctgcaaagactcttgagaagacgtaagtgccagaaaactgcaaaagtggaaatgccctatgcctgaaattgccagcctctcagtcactcagaaggccagaaacggtcgctggggctctaagcaggactctttctttagctctcattagatctttttctttttctttctttttttttgagacagtgtttcactctgttgcgcaggctcatatgtaacagtgtgatcacagctcactgcagcctccaccttccggactcaagggattttcctacctcatcctctcaagtagctgggactataggtacacatcaccatgcccagcttttttttttttttttttttttaaataattttttgtagagacagggccttgctatgtggcccaggctggtctctaactcctgggctcaagtgagccatctgcttcagcctcccgaagtgttgggatcacaggcatgagccagcgcacccagccatagatctttttcaaggctttgtttcttggggcagcccttggctaaatgctttagcttaaacgacagcattcctaatgtgagttgcagccagtttctgagttcctggacggagattttactttggatattactgttggacacaatagagttttttctcccctaaaatagaataagctgcaacattatctgtagagtgggagggggagattgattcccaaaggaagcttgggtgcatttttccctgccattattcctagatatcaccagcgtggccctgtgcctgtgttcataagggtcctgggccttcactatcttctctgggggacttgcctggaggctttctcttaggtgggctgaaggcaaatatattccgaggtcctccaggtagctaccaatcatccaaggggccatgccatgctagggccctgggacagggtaccctgtcgaggatggggtgaacagctaggacttggatactgattgagtgtggcactgcaggtgaacatcagatcaaggtcagtggattctgggttgctcttccatcgaccctcccattcccatccctgtgtttctttccactgtctacagcctgtttctgtggctagatttttggttgcctaggaaacaactttattctgaaacatgattggctgttcttgcagatggattacccaagctagggcagtgttctggggtaagcaagtgatgctgaacaattctgtttcttccctttaagattaatggtgaggacttaggcattgtaagcaattgttctgtgaaaaccaattgttcatggactgatgctttgtttcaggttggacaggggtttaggggagactggttggccacaaagaactgactgagtcagaactgctcacacacatctatcctgtgttggaagcagtagctcagatgacatttctgtttatatttacaaattcactttagcagttgtttctggagtgcaggtgtgtgctgtttaaacgccattgccaaatatggaaacagctggatgctgcagtgttgaagccaggagtgaaaagcccactgagcaggctcagattcagcagaaactcttgtgtaccatgtctgtgtgctaggtttttttcattatagaaataattatatcccttaatcctgcaaggtgggtgacttctatagataaggaaactgagtcctctggatggtttaaattaagggagcagtaaactttctgtaaaagacctcatagtacatattttaggctttctgggccattccgtctttgtgcagcatctctgctgttacagttcaaaagcagccagagacaacatgtaaatccatgttccagtagagttttagttgtaaaaacagactgcaggttgtagtttgctgattcctggttatacggatgattggtacagggctcagacttatgtcccctttggcctgggcaatctttgttttctgttctctctctctaagacatctcatttatgctcatggacttaaataatatgtgccgataatgccccaatttatagccttccctctcatctgagcactgtaattttccttttttttgagacagggtctcgctctgtcacccagactggagcacagtggcacaatcatggctcactgcagccttcatctcccaggctcaagtgatcctcctgcctcagcctcccgagtagctgggaatacgggtgcacgccaccatgcctggctaatttttaaattttttgtaaagacagggcctccctatattgcccaagctggtcttgagctcctgggctcaagtgattctcccgccttggcctcccaaaatgctaggattacaggcatgagcctctgtgcccagccttaattcaatagtttacttcatatctcctcttggatttctcctggatagctcaggctcaacatgtccaacgtagaactctgatgaccatcttcctcttaaaacaaaaacaaatgtgcattcaaacgaacccagccccacccccatcttcctcatctcaacacctgggaccttattcacccaggtgctcaaaccagaaacctgatgatcaagtcttttttttttttttttttttttttgaggtggagtctcactctgccccccaggctggagtgaagtggcatgatctgggccacattgcagcctccgtctcctgggttcaagcgattctcctgcctcagcctcccaagtagctggaaatacaggtgcacgccactgtgcccagctaatttttgtatttttagtagagacggggttttaattttgtattttcagtagagacggggtttcatcatgttggccaggctggtctcgaactcctgacctcaaatggtatgcctgcctcagcctcccgaagtgctgggatcacaggcgtgagccactgtgcctgaccatgataatcaagtcttatcttcacttttccctcacctctcttctttctagaacggtccatgtcattggacttccatggttaaaacctgtatctgcttcccattgcttttagtctaaaatccaaatcccttgctagcgcctccaggccctgccacctggctcccgccgctcctcccctcgcctgatgttcaccaggatctggtcgcctgtcagttctttgaacacacaacaccgtccagcctcagagacttagcacactccatccactcccctcagcgggcatcttctgctccgtcccttggctggtctcttttttcctgtctttatctccttccacccaaggaagttgctggctgggtagaccaggagtctgctgcaagcactgcagggcttgtgaggaggctggtgtgtggctgtgagcagtagattaggggccgtgagcaatagatttcctttgttcctgcattcttagcccttacaaaggaaagcagtgggccttttaaaaaggaaggtgggtcttttgtacagtgcaccccatggctgtgcaataaatccggtgggggtggtgggcctccccgcaggttttgtacctgtctgcctccttattcagaaggacttgtttcctctgagtttctgcttttgccttttcgtctgctttctccttaaatggaagtggatggatgcagctcttcatgcctaaaacagaagccttgggctctgggcagagcagtgggggccgaggtaggggggtggaggtagggtggggtggcccctctgctcagggtttcccggagccctactgacaggcagtcacagtggctctgtgtccttatggggccgagaactcaggccagctgctgggccaagtttaccatcaacattccagcttcacttactccaaggtgtttgtggagttccagagtctgcggatgttagaactggaaacatcaggattttagaaataacagagggtttaaatcccccagcacttcatttgtgaaatatgacttaggcctttccggctagtcattattcaaaataagtcaggtagtcattttaatcttttccctttaactttcaatgtgctaaaagaaaatgtttgtaggtggacgtatcatttggtaaactcaaatcagaggcctcttcccacgtggtgaaacagcttagattgcaaattctttgtcccatgaggaaatgcaatggatggttaatttgggaataaaaatgagcctccttgggcccttggccaggcccttccatgagtcttattagccttgtgtctttgctctgaagtatttttttcttttctgtctccatacatctccttggggatgttctagaggtcagttccaaggaaggtgggtgtttactgtgttcagcccaagtggaaaatagctgtagccatcttcagagaaagctgacccctcctgaggaccagcaagcccagaggtggttggacaaacatgtgggctctcggtacctgacacctgttgagactggcctgagttaaaaccatccaagcctaaatgtggagccctagagatgagctagattgtactcaaggctgcagggatatgacccatgactcctggggccttaattttatgttttgactcgtggttacagcaggctattggtctaggttgaagcttgacatttagaaaatacctgggctgctttccgtctactgctgggtgacagaatcaggcaggggagggcacagcctgttgttgctgcccacccaggaggagctgagtttgctgcagcagtcctgtgccagcaccacccttcctggggctcagatctgggtctctgtacttgagaagcagcccacattccaaggggctccagcctctcacggtgactcctctgtgccacttatccaggcccctggtggaagctgcacattgttcattgttctgcgttaaagggaggcgcctacagtggtctggaagtattttccctccaggaagaaggcgggagaggttggctttattaactttactttagggaaaacatctgcgcacatttagatcctgcatggaacttcccagctgagcctctttcagaagaggatcctgtgactgcccattgcctttcatgaatggccctaagacgccgtcctggggcgcagggctgctgggggagtgaggagcatccctcacagcaccaggctcttgtgggaggaggaagagccaggagtgcacagagggtgagcaagagcagacggggagggcagggggtgaggggcaggctgtccctttggcattctggcctgtgtgtgagagcgctgagtttggacccccaaacctgtgactagcggagtttgtgtgagcaggcgaaggcttgtgaccaggagcctggggcctaaagaggtgtttctgggcagagctgtacccagaacatcctcagacaggttttgcctgtggcctcagcttgggtacctttggttgcaagtagaaaaaaaccaattcaaactgacttagagaaaagagggcatatatcgcctgtgcctgacaggtgagattcctacaggggtaattgctaggatggctttagagaaatgtgccctcctcaccccagacaaccccaaaaagtccaaagcatcagagtttttgggttttagaatcacctttgatctagaacagctgacttactcctgtggcttcctggggctgcctcatcctctctgcaacctccttggcagacatactggcttccagctgctggggaagtttgtgccccagcctcagtgacccagagccaggctggggtctgaaaagagagcggggctccacgccctgggctttggcttggcccacgaatgccccttaacagctcagatcagtctcctgccctaactggggaggctgtgggaggcaacctgctcctgggcaacttccagatctggcacttgtcacgagcatctttacgtgccagggcacagcctaagagaagtgacacgagacacagaagaggcaagaggctggaggagtgtggtcatatgtggcactgtgttcccaggagccctgctgctgatggccctggggtcagtggggaagagcaccaggcaagaaaggaaaacatgtctgtggaaggtggtcctttgcctgccctgcgagatgaggggaagcaggacttcaggagccagaggtcttccttcttcatgtccttcctgcccagcctttctggtaacagataagggaagagcatggctgagcctgctatggagcacacaccatgaaagccagcccctctctgggggcacagctcttaccctccagccccatgcacgttccaggctccatgacctggggccagcagccacctgctcccatagacagggaagtgggctaggctgggctgggctgagccaagccaagcctaggctgcggccagcggagctcttctgcccgcctcctctctccctttgtgggatgggactgtcccttttgtcctggtcatgccacagggctcggtggactgtccaagggttctttgtcctgattgtagtttctccatttcctctttgtttttccactgggtgcaactatcagtccatatctgtgacctgcatattttacctggaccaacaagacaggtggcctaggggctgagggtgtgcctggtaaactcagccagcactcccaagatagagcctgcccagatcagccttagccagcgatctctgctgttaagaacagtgcaacgctttggcaatacctcccagaaaaatagctagtgggcaatggcactggctcagcgcagacctgccctaggtttctgggcacatgacagtgcccactcactccatgggcttgagaagactggcattcagggcctcatttatgatgtcggtgaaatggaattaacctcccacccgtgtctccctctctgttgctaaagaattctgtaggtaagaaagagaatgcataaagcgtttagggaaccaggagaagaattggtgcataaaacgttcgtgaaacactatgctcctgtttttttttaaattgagaaataaaaattccattgtagaatggctaaatcaagctaattaatgtattacctcccctcctttttgtgtgtgtagaatacacttaaaatctactctgttaccaattttcaagtatatagcacattgttattgactagatagagtcactaagttgtacaatagatctaactgttgaactaaccagtagttgaactaatttctcttagctgactgaagttttgtgcctttgaccaacatctctcccccatgtcccagcctctggtaaacagcattctactctctgcttctatgaatttggctttatttcagattccccatgaaaaggcgatcactgtgggtttcatttatttttaaattttatttacttattttgagatagggtcttattctgttgcccaggctggagtgcagtggcacagtcatggctcactgctgcttcaacctccccaggctcagatgatcctcccatctcagcctccctagtagctgggacacccctggctaatttttgtattttttatagagatgaggtttctgccatgttgcccaggctggtctctaactccagaggtcaagcaattctcctgccttggcctcccaaagtgctgggattacaggcatgagtcactgcacctggcctggctttgtattttaaatacagcataattcttggtgaagaaaaacactgaaacactgatgcattgtggaaaaggatacattagttaatgtgggaaaggatacattggttaatatgggaaaggatacattagttatcactcctgaactgtttgtaacaacaaggaaaccccttcattcccgtgctaatcctcagaaacaaacctgcccagaccccgttctgtccagaatgcagtttctgttctttgtgctcactccttgggttcacatattgcatttctcgatgtaggctcaaaattatgtgaatttttatttttctggatactgtttttcttccacttcttcaaatgtgactatgctttcaaaaattcagagcttaaatgcctgtgagaggaaaggaaccgaaggtgtaggggtgaccaggtacggactttcctggagactgtctgaattgtctacaactcagggaccagggaaatatcttctcactatccagagataatattttattggtcaaaaatattagaaaatgggccgggtacaatagctcaacgcttgtaatcccagcacttcaggaggctgaggcaggtggattgcttgagctcaggagttagagaccagcctgtgcaacatggccagcatggcaacatggcaaaaccctgtttcaaaaagtacaaaaattagctgggtgcggtggtgcacgcctatagtcccagttgcttgggaggctgaggtgggaggatcgcttgaacccaggagttgaggctgcagtgagtcgtgtttgcaccactgcactctaacctgaacaacagagcaaaaccttctctctctctctctctctctctctctctctctctctctctctctatatatatatatatatatatatatatatgaagatgaaattggagtagtcaagttgtaagatagaaaaggccaaagtagaatggtggctgcagatgaagattgggtaccactcaagatggctttcattctgagttttcacatttgtaaactcagaggtctggctcttttaatatatgggtccttattcttagaagtaggaggctggctttgtcatttaggattgtttggaaattggcattcctgaaattctcccttcaggtcctccctggtcaataaagaactttgactcttgcgccctcggttggacagtggttttgtgcatcagaggctcccacaggggagttgttgggaataggctggctcttgttctgtgagggactaggggactcatgctggtgctcatagctcatcaagagtcgtagcattttacttagtatcccattgtatgtgtagacaaatatagatttttttttctctgtaaaatgtgtggccttgtagataaccatgcagattcaagctgctgaaaggcctgatgtggccctagaaagccagaatttgaatgagattagtcacagcaagtcagcaaatgtgggagatggaaaactggcttcctccacccacctaggttctttggctgggctacaaattaaatggacataaaatagattaacaggagaaaaaacacagtaattatgtgtatatgcctgggagtcccacaaaatatgagactcaaaagaagggtccgaagagggaagcttatatagccccctgagccacagaaaggaatagggacctggggcttctggtgggtggtggagacaagttatggaagagtgaggggaggaagtgtagggtgagtaaatgtggtcttgttatgcccataaaatctcttggtacatcacagttgcctggagcagccccagtcctgatagagatactttactaatgtagattttcttgatggatatcattgtgttttacaaaagggcagcttttcagagccactcctgtgtctgcagtttctcagaataaccagccccaaatatgacaagtatagtttggggtggtatattctggcctcctacagttgcattttggggtggtattgtcccgagccccaacacagaaaaggagggcagtaggaatttaagaatttcagataaagcattctcattttggaaggagcagtggagggaggctggaacagagagaaagtcaactgcatttggaagatgcagtttgaaaaacaatgagatgtttgtgcacagggccttttaaaaattataatgatgggaggatggagttgcagggatgatggcatgaacctataatcccagctgcttgggaggctgaggcaggagggtcacttgagcccaggagttcaaggctacagggcacaatgattgcacctgtgaatagccactgcattccagcctgggtaacatagtgagacctgtctctaaaataataaaatgatggcccagggagtggatggctcataggtgaaaggttttctgagcagcaagagaatgaagctggggaggagataaggcccaagcctctggggccatgatctgtgatcgcaaacaaacaggattattctgtcgcagaaagaattgggagtgtggattttagaggtgtacaggggccaaaccttggaatgggcccttccagaactgccatggtcccttgctaaaaactccaaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggataaagggtcaggcgcagtggctcacgcctgtaatcccagcattttgagaggccaaggcaggtggatcacttaaggccaggaatttgggaccagtctggccaacatggtgaaacctcgtctctactaaaattacaaaaaatcagccatggggttgtgcgcctgtagtcccagctactcggaggctgaggtgggaggatcacctgagccttaaagtttgaggctgcagtgagtggtgatcaggccactgcactccaggctgggcagagtgagaccctgtctcaacaaaacaaaacacaggataaacccctactgtttttaaagcaatttacattacaattccaagtgaaaccagaagcatgacttttaagtagcaggaacattgagataatggaaaacttggagcctttgagaaaacaaagcacaaagctgctcttgaacaccttgccatgaaagtaacaaaacgctgaagcatgtttataagtcagggctgaaaatcatgatgaagaggaaaagccaggtgactgctgtcagtttcaataccttatcctgtttcttttatcatgaaattgagtagttcgtcagcaagaaggtcaggtctgagcatctatttaaactcttaaccttgagactgtgatgcttatgtgatgtgggaaattgtatctgctcattagagctctgatatgtaattgaaatctgagattacttatctgccttgtcgtatttaaaccactgattatggctctgacatttttgttactcttcaatcaaccagtatataaaggattcagaatctcttggaattaagaaaaagctattatcttcctggtatcaattatagcgcaagtaaaaagcaatgccttttttagccaaaactttgcaaaagtacatgctgggatctcagatctttccttgatgcccttcactttaacccctacttttatgtgtgacacaaacccggccacttctcaccttggaggcgagcaagctccatacccttcttccactcctgctcctgctgctgttgttacagctgtcagaatggccttctaaaaacaactcaggggccaggcctgggggctcatgcctgtaaccccaacactttaggaagccgaggcaggaggatcacttgagcccagaagtttgagaccagcctgggaaacattgggagcccttgtttctacaaaaaatgtttttaaaaaattagcagacgtggtggcttacacctgtagtcccagttatttgggaggctgaggcgacaggatcacttgagctcagtagtttgagaccagcctgggtagcatagggagccaccatctctacaaaaaataaaaaaaaaatatagccgggagtggtggcgtgtatccatggtcccagttactcaggaggctgaggttcagaggatcgcttgagcccaagaggtcgaggctgcagtgagccatgattgcgccactgcactccagcctgggcaacagagtgagacggtgtctccaaaaaaacaggcgagtcctttccccgtgtaaccctcagtggctttcagactcctcatgggtctcagcgaggccaggtcattgtcattgttacctgcttcttgggtctcctggcaaactttctcctcgttgcctgctttgttttcttaaatggcctgaagcccattccttgaacctgccaccctccttccccctcccacctcagggctcttcatctttttgttctccctgcctgaaactttcttccccccagttctttttttttttttttgggttaatagtctggctttgtcgcccaggctggagtgcagtggcgcaatttcagctcactgcaagctccgcttcccaggttcacgccattctcctgcctcagcctcccgagtagctgggactacaggcgcctgcaccacacccggctaatttttttgtgtttttggtagaaacgaggtttcaccatgttagccaggatggtctcgatctcctgaccttgtgatccacctgcctcggcgtcccgaagtgctgggattacaggcatgagccaccgcacccggcctcttccctcgagttctaatgactgactcttttttcactcttcatgtctcagctttgagaagcctcccttcccagggagtgcaagaggaataacttattttattttttattttttttgagacggagtctcgctctgttgccgaggctggatggagtgcaatggcgcagtctcggctcactgcaaacctctgcctcccaggctcaagcgattctcctgcctcagcctctcctgcctcagctgggattacaggcacgcgcccccatgtccacctaatttttatatttttagtagagacagggtttcaccatgttgcccaggctggtcttgaactcctgacctcaggtgatccacccacctcagcctcccaaagtgctgggattacaggcatgagccaccgcgcccggccaagagggagaaattttaaggcatcctagagcctagaacaaacaatgccagccagcccttcttctgtttggctgattacagtttctctcttgagtggctgtgaattaattcagtaaatattcaagtgaaatttattgcttagttttacaattcctcgcccacagccactttagcagtatgtgtctgtgtgtgcatgttggagggggcattgttggatgtgtgggaagagcaagaaaatcacattctttttgcatcgctctgtaaactcatgaatcattggtacagctgtcccctggctactgggagcatggccgtgctttatgtttctttattgtgttaaggtgaaagatgcaataattttggtggtagaattttaacactttgaggactggagccagtaaataccttctaagtgcctgggattgtgcaaggtgctttacaaatataaactcagctctgaaagcaacccatctactacctactgttgcccattgcatagacaaagaaactgaggtccagggatgttaagtaacctgtccaaagttactcacctctcatgaatttggaaccagatcagttgatgctcatatttgatggctgtggtgctgttttctcctacaagatgtcagaatcgtgtaattcgtatattaagtgctttaatttagactttatcatttcagaatttttaataagtgggttaaagagtgagttgaggatgctgcattatgtatgagagaacagtgtgaaaacatcggaagcaggaaaagcacattttcaaggcattgaacaatacttattccctacaattagtgtgctgtttaccagctattctttttcttttttttatcatgtaaagaggttagaagaaaggaacaaaagatttaagtcttccttcctcgtgattgtactgctttattgcactgcttgcagactgcagtagaaaataagcttttaagactttctagattttcaggctttctactaagctgttgtagcttctccatcccacatctgggtttgctcactttatttctatgtgccaaatcatgattgagactcgttgagacacacagtagaccacaggttgccatatttagcagagcagggaaagaactctggagagtttgcctttttgattagggagaaacgctgtgggaggtatttgttgagcagctactctgggcaggaccctgagaactatcaatttttggatgcgtgaaatagaccaaacatgaaacctgctctggacgcaggttctctctgaatcaggcaaagcttcaggcctctgaaggcctcattcaggagcatgttatccatggcagggagggtgtgatgcctgattaaaattccagctgcttggctcccaccaggagctcaccacgatttctgagttgcttgggatttagccaactggtttgcaaactgcatgtaaggtgtgtctgtgtttgttaaaaacaatgacttctcagcaggactcagtaatgggtttccacggagagaaacattaccaagagatgaatgcaggggcgtgattgtcctgtgcactaagagccttcaaatcctttccccatatttgcaaggtgttgaagtaccgcttttaaggcaaaactaaatgacgagttataaagtcaaaacacgtgagctttaattattgctggaataagcgggattctcatcagcagggcagcttccagatgtgcttttcttcattttgactagatagggagaagagtgagggggcatggcgtggagaaagaaaggtagatatacaagaggcggagactcaggcgcaggtagagtcagaggcaggttcaaagacacacagagacacataggtgaagatacattcgatgtaaacagcttaggagccaggtcgggcctggtggcttctaagctcatatctgtaatcctggctctttcggaggccaaggtgggtggatcgcttgaggccaggagttcgagaccagcctggccaagatggcgaaaccccatctctaccaaaaatacaaaaagttagatgggcgtggtggcacgtgcctgtaatcccagctagtcgggtggctgagggatgagaatcacttgaacctgggaggcagaggttgcagtgagccaagattgcgccactgcactccagcctgggtaacagagtgagactctgtctcaaaaaaaacaaaaaaacaaacaaaaaaaacaacagggggtgggggcttaggagccaggattctaaggccatacctgctcctgctctgaatcctgtggcctcctgtttgcaagagtccaccctgagattagtcatcctctcagtctcccgttggctctatgatggtgttgccctttgcccaggatgtgagtaatgagagtaacagaattcagggttgacctgactttcctgcagaggtctgggaagacctccatgtgacagccttcccatgtcactccctgcgggttccaagaatctcaggcctttgcagctgggatggcatggcatagacatgtgagacaccccctccttgtttgtatgagcgaaagggccaaaagaatagggtggaggtcctggctggctgcccccgtgggctgctatggatctagatgcagaaactctgctgattcgttcccctggaggagaggttgctctgggaaactgcagctgccaaacctactggagactgatttgcaaataaggactccagcctgttcacatacaggagcctccgtgagtggggagggcagttgggtcaggctgaggctcagaagacacgtatgcctgtcttggctctgcccttgcccctgagtggttctgagctctcaggcaagatgctgaaccgcttggctccaagttctcatcctcagaacccaggaggacttgagcatcttgagagtgggagcttatctgtctggttcaccagcccaggtgcccgcaggtgatggggaataaataggtccttctgaaaccgtgaatagtcagggaatgatacccatgtgcctctcctgttgtaaggatcagtcatgaggaagctctgagggacggtaacatgtcagctgaggtgagcggccgtggggttattcccattcctgacacttcgcagcccctggctgaggcacccccatcctggtccttgggtacctgcctgagaaaccacacttggaatcggaaggacacttggtgagtgtggaacatcagcctccgatgcagaatggatgtgtcttgctggctgggggagcacttggagggggtccccgaggcacccctgataatacagcctgggggtgggggggtgccctggtgggtgtgtcttccctggccagtgcagagggggacagctacatttttgtcactcctctgtttcttccaaactccttgttggctccttcccttaatccatgttgccctggacaaaatccagctaaccggatcccagctgggttccgtgtattgtatccaggacctggatgagatttggaagaacttgctgagcacatctggggagacccctgcgtccccagcagtgtggctgagctctgccttgttggggcctgcatcctcccttgtacgaaggcaaccttgttgctggtacccgtgtttaaatatctttttctgacttacataaacagcacctatgtgttgcttttatgtgtgtgtgtctgtacatagacatctgtgtacgtgaatatacatatgtatttaggtatctttgtgtaagtttatatataattatctgaaataagctcatattatatacacatttcttaatttgctgggttttttttcctacttatcacctaactgggagttatcctgattgtacatgcaatcccactcaccttcgttaacagccattatgttactgaggggtgatagcgatggggggtctgtcccctgccaggtgcttggggaagctctagtggttggccagagctgactgctctttgagttcttgcatcttctttatggtttttccgtctcctctgtcacttattcttttttttttttttttttttttttagtagagctgggatctcatcatgtggctcaggctgatctggaactcctgggctcaagcaatcctcctgcctcggcctcccaaagtgccgggattacaggagtgagccactgtgcctggcctatcacatactcttttctttctttttttttttttttgagatggagttttgagttttgctcttgttgtccaggctagagtgcaatggcgcgatcttggctcactacaacctccgcctcctgggttcattcaggtgattcccctgcctcagcctcctgagtagctgggattacaggcacatgccaccatgcccagctactttttgtatttttagtagagatggggtttctccatgttggccaggctggtctcgaactcctgacctctagcggtccacccgcctcagcctcccaaagtcctgggattgcaggcatgagccaccgcacctggccatactctttatcagtgctatctatgtgcctgcctccaacattaccctgccccttctcatttaatttggattctgaaaccagataccaaacctattagactagactgtaagagaaggctaagtgtgttttttcagagaagaccaggtggagctttttattgagtaatgtgcaggatcctttagtgcaagctctgtgtcacatgacttggttgaacagaaatgtttgtgttttctggggtcctggttgtgtttcagatgggtaagggggtactggtttgcttgttaagtggcttgtgaataggtaggatgttactgtaattctcctctctagagaaaatacaaggactttaatgacaacttgttgaaagctccttctgtgtctttttgaattcagttttatattcttttcttattagtattcataagtaactcattttcctttcttccttttttgaggtggaatttcgctcttgttgcccaggccggagtgcagtggtgtgatctcggctcacctcaacctccacctcctgggcaagctattctcccgcctcagcctcccgagtagctgggattacaggtgcccaccagtacgcctggctaatttttgtatttttagtagagacagggttttgtcatgttggcctggctggtctcaaactcctgacttcaggtgatccacccgccttggcctcccaaagtgctgggattacaggtgtgagccaccacgcctggccaagtaactcagtttctattatattttttaagaatctcactttagtggtcaggcccagtagctcatgcctataatcccagcattttgggagaccgaggcaggagggtcgtttgagaccagcagggtgtagtggcacacagctgtggtcccagcttactcgggaggctgaggcaggaggatctcgtgagcccaagagtttgaggttacagtgagctgtgactgtgccaccgtactccagtctaggtgacgagcaagactcagtctctggggggataaaatgagtttatttatttatttattttttgaaacagagtcttgctctgtcacccaggctggagtgcagtggcatgatctctgctcactgcaacctctgcctctgggtttaagtaattctcctgcctcagcctcctgagtagctggaattacaggtgcccgccaccatacctggctaatttttatatttttagtagagatggggtttcaccatgttggccaggctggcctcgaactcctggcctcaagtgatctgcccaccgtggcctcccaaagtcctgggattgcaggcatgtgacaccgcccccggccaaacctgagttttaagattccaatttaagttaatcaaggagtttagctacaaagagattttggggagatctgtgtgcgaaggcaaggaaaccaaaagggtggtccgaggctcttttttctttatttctcctgacacttgattcagtctggcctttctccaggaaggcgtagcaggatctagttacaaatcggtgaaatcatgagcccagggtgtgggggccggcttagtgtcactctgcgcttcctgcagtgggccctcagccactagaaagtcacttctcttttgcgaggaacctggtattgtcacaaataagccaatttcaaaactaagtatgtttgtgttggggagtgaggagtgagtttcagcagacacatgtatgcacacccacatgggcacagtgccacactgagcccccttcattctggaagcagtcccttggccctggacctggttgtgtgccccttgaggggaggatgaagttgacctcagcactacccggagctcgccctttcttcggtacactctggtgtccacaggtggcctggcttagcaccagccacagtttgttcctggcctccagggtctctttcctgtccagctcagcagctttgaccaagtaaaatagaggacttggtctgcttgctagcagaattacatttccccaaatttcttttctttctttcttttttttttctgagacagagtctcgctctgtcgcccagactggagtgcagtggtgtgaccttggctcactgcaatctctgcctcccaggttcaagtgattctcatgcctcagccccgtgagtagctggaattacaggcgcctgccaccacgcccagctaatttttgtagttttagtagagacagggtttctccaccttggccaggctggtctggaactcctgatctcaggtaattcgtcccacctcgggcttccaaagtgctgggattataggtgtgagccgcggtgcccagcccttatttccccaaatttctaatgcttggaggccaagggcagatcagagctgcaataataatggggaggcattatccttatggtcattaatatccccatttatgtgacagtcccagggcctgggaggtcaggtgtcttgcctaaggtcatgtgcttgtcaaggggagctgggaggcatcctgtagtagactatggttgtttgtggactgcttgccctcccttccacatcctgcctgccttttggggaagtctgtctccccattctgttgagtctcagcaggttgctcctttgttaaggttccctaccctcttccagccaagagacccaagaggagccaagtagatactccctccctggaagttaaaccgtgagctgagatccagaaaatggttggaggactgaagtgccctcatttctgtctcttcagatgtggttccttagcctccttgggttttcagtaaatcccattcttgctttagtttatttatttatttatttatttttttgagatagagtctcgccctatcatccaggctggagtgcagtggtgtgatcttggctcactacaacctctgcctcccgggttcaaacaattctcttgcctcggcctcccaagtagctgggactacaggcatgcgccaccacgcctggctaatctttgtatttttctttttttttagtagagatgggtttcaccatattggccaggctggtcttgaactcctgacctcaggtcatctgcctgccttggcctcccaaagtgctgggattacaggcatgagccacggtgcctgaccatgctttagtttaaattcagaattgggttcctgtttcttgcaactgtattcaattaacacctggccataacccaggcatgggactcctcaatctgcagtgctctttccacttggtcatgctgctgctataacctagcgatggtcaggacggcgatggccagcgccccgggaaccccagtaacatcacaacatagccacgaagtgatagctacttgattctgaaaataggacctgctgggaatctcggggtaaatgtgttgtcatctgctttgatttttcgcgaggcagccgtaggtgtcagcctggaaaattctagcagcctggcttgccagagctagcttggtgtttgttcatggaaggcagtacctggctggctgcttctcagtcacctgaccgtccaagatgggtcttggcatttgcttgtgttgaaatcatgttcttatttagctaaatattgatacaacagagcaattccttttgtatatgcaggatggatgaattgaagtgaaagatcagtttgtcagcccttaaaaaaaatgaccggtctgatcatactgttttatgccagcgaggtgtgtgtgtgtgcagagattggggaggggaaagcttttattggcaagactatctgaaggtctcattcagcggaatattttgttgaatagaatctagcatgcgcagtttcaaaaatatccatttactcacagagtcctcaaacccttacacaagatgaagagatgaatgagactgtctgatctgtcgccgagggctcagttttgtttctggaaggtctccctctctcttcagggatggcagctgctctttcagcctggacaatgctggctggctttccccgaccagggcttttgtccagagctgttgcttttacctgggcttggtcttcaagggaaaaagaggtgggaggaggaggggagctcagaagaaggaagcccctgtctttggcctgcactgtgttctttcactctgaggagtggtcccaagaccctccctccagttcccagatcactttcatgttgggagctgcaaagtggaattctaaggaattgacctggattcgaatatggaagtatcctcttccccttaagcaatgctcaagaaggaattgtttcttgataatcaggtaacattcaaatgttatataaactttagatttccaggatgagtgttgtatttagagcaaaggctcttgtttggaggcagtgctccatgaaggtaggcctggttctatggaatttccagctctagctgtcatgaatgggctggttaccttgggcgagccactttagctctctgggctttagctgggataagtgtgttggaataggatatgatctctaaattttcttccaacttccaagattttatggcctttgcaatttattatttcaagcccttaaattatctccagtaaaacttgagcaaatgtaaccatttaatgatatactgggaaccatatctatagtacctctttattacaagatgcttatgttttagttagagatatactcacatgttcacatatgggtgtatatatgtgtgtatgtgtatattatgtatgtgtgtggatgctgatcttaaactattttgttgtcgtagttcatagaagtaaaaacctgaaaatatttaaaccagatcacaaatacagggaaataggctcttagggtctgcattttccagctacctgactcttgctttggggccaatttccacgcccttctttcacacggtgtgtcagctgtggaggtgtttaattcagcattgtgtggagcagagcttttccgactgtgctctgtgggactctagagaccaagaaagtacttgaaaaaacgtttttaagccgaactagtacacagtcgaggagctcggcagggtcctgttttcgtggccagcacagtctgtccccacctggggttacgttgttccctctttcctgcttggttgtacacaccgcactgtgtgctattggataccattagcacattgattgcctggtacggatagattaattcggttggtacagctggttgaccctcctgccctgtctgccttattaaaaattattgcatgaacacaggacaggccgttaaaaatcaggggctgtttgtaatgactcatgggtgcatctcaggactcttcccagtgatgtgcagcggggggagaaaccaacgggcatccggctacctcatgtctccagcccccagtgtcaggtttttgagttcctccaaacaacttaattgctctcgatgatggaccttatacaagcatattgtaaattgctattacattacatatcgtaaaatgctattacaagcatattgtaaattgagcttgctgaaaatgtttggaagccacagatgtagcgaaaagggcacagattttagagacaggcagttctggatttgagacttagcttccatcatttagtaaccatacggcctctggcaaaggaatttgcacctctaatgcctaattgtctcatctgtaaaatgggcctgctgtctggcagccaggacccttttttttttttaagagtcgaggtctcgctctgtcattcagtctggagtatagttgtgcgatcatagcttgctgcagtctcaaactcctggacgaagcgatcctcctgagtctgcctccacgtagctgggattacaagtgtgcaccacgatacctggctaggcaggacgtttctgaagaccttagatgtgtgtacagtgggcctactcctgtgcccgacacataacagtatattcaacaaatgctggtaattatcatgcttttcatgctgagaattaaagtgttacaagccaggggtgtccaatcttttggcttccctgggccacattggaacaagaagaattgtcttgggccacacataaaatacactaacactaatgatagctgatgagctggaaaaaaaaaatcacaacaaaatctcatagtgttttaagaaaatttacgaatttatgttgggccgcattcaaagctgtcctgggccgcatgcagcccataggccgtgggttggacaaggttggtttacactatagaaatatagatattttattgcatttgcatatttacttctgtggtggacatagcatatgcatagtctgataaatatatttgcctataatttagagatatttcagcagattgtaatgacaacatttctctttctgctacatttttgtagcaaattaaattaattttcttttctttcatttttaaaatgtgtggagccttaacagaataatttcttgtactttgggttttttctagtaggaaaagaaatatcaaacagccggtgggaattgtgcttatacactgggcctccaaagtgctgctttatttttatgtacagactcgttgggggtggactgccgaaatccttgctcttagaaatgtatttgagcccctgggaaactggatagggaaaaaagagctaattaaaaaagctgccatccacctcctctaattaacttgctgtctgctcccaagagagggttcagaaatatgaaaacaagacaggcagcaccggaagtgaatgccattctcgtggtctgtggtggtccctggtgttttgatgcagagatcgttcatagtaaacaggcaagggaccacaaagaggcttggtgtgccctggcccaccccatgctctgccttccacacagggcgatcgtgaacggcggtccctctgagcaggtgcacaggctgggcagttgctgcagcggagaactcattggaattcaggggctagaaccgaggggcatccggccctccctgttgcttgcttgtgctgttgagaaagagcagagccctttgtgcttcagagcctgctgtcgccagtgcccaggaatgcagaagccaggggatggacgagtactcaggctttcctcgaatctctgcttgagtggggcagcctcggggcctccggacgctggagaagctcacagcatctgtggccggtggtgcagctaacttttttggtgacattgaaagagatttaggtccaagagatacgagcaggggaattaggggtgggaatttgggggacagaggctgttcttcagcggaaatggcctatgcctcctggcagaggtggtccccagtggaatgggcccggtggatgtggacagcggtgaccagcagtggggactccagtctgctggtgcttcagggagactctggaaaaaggcaagttatctctgtgtatcttgtcagtgttgctcatgatggtgcagtgctgggggcctggtgaggaagctgggttcccggggcagcacccggggcagcacccagggctcgccaggctgatctgaactctcattcttctttgctcctcagttgtgtgacctccttttgttttccacaccgataaacagatgcttcaggtacctcgatctgttgttgtgcaagtgcggatctttccttctccccatagacaaaagctaagccctttgatattaatgagtgtttgtaagaagtcagtatcttctgttgggtttgcatgaattatttcctcatgaaatttaatagtagactaggtttggctcattggatcccatcaaaagcagctatgatgtttcttttaaaccctttggttccctggaggctttgtggctggttggaggagccaaggtccttggggggtggaggggcaagggtgctgatgaagtaagtcactgacaaactagttgtaaaagcattgatacagattttctgaagggaactcaccaaatagctctttcttcaggtcccagtggatagtggagggattggtttggttcctggtgctctctgccagctggctggtggtctttagaagatggtggcctctactggggtccctggttctttgatctttttggaagctcagcaacgtgagcatctctcagcattgggttgcacggctcggtgacaccggtgcagcttggtgcacacactgtccgtactcacctgccaggtcaccccgatttcatgtcttcaccagatttgcttgctgggatcattcgtgccattcagccactctaagtttccattctcttaataattagccccctcgttgcaaatgaataaatcagtatttcagtctgtttaacccttccaaaatgggactcagcccaactgcgactgctgctgccaggctagctgttctccaaggcaaggctgggctcaggaccgtgggcccttgggcatcttgagcataggtggagctggcttagtactgggggaagccttattctttctggcttaaaattgagtcaccggtggaagcagggtgatggggagggctgtctgttggttcttcgttttcttctttttatttttttaagagacagggtcttgctctatcacctaggctgggatgcactggcacagtcatagctcactgcagcctcaaacttctgggcttaagtgatcctcctgcctcaccctccctagtagctgagaccataggcacatgccaccaagcctgggtaattttttatttttatctttttatagaaatagggcctcactgtgttgcccaggctggtctcaaatgcctgacatcaagcgatcctcccacctgagtctcccaaagcgctgggattagaggcatgagccaccgcacctggcctgttggttcctcttcaacccaggccaaggcttggccagtggcctctccttgttagtgggcagagtttctccacatggatttttggtccagttctctgggtgaagagtcttccttgagaacagactttcctgcagaccagcgagggccattttcactgtgtcggggttggtggccgtgctttgtgtcttggtctgatgcaccctctgcctggccggcttgctggcttccttcgttcactccattcacccactcaacacatgttcattcccggccctccactgtaggcttggagatactgtgataaacaaggccggctgccctcctgtgttttgagctccgtagaagagaaagacagtaaacactactagaataagtctatactcacaagttatgagaggcgctgagaaggcaggacagtagagaggatgatggggtgggatcatgtgggtgagttggcacaatggcatcgaacatgcagaatgcctctctctctctatttgaatcaatacctaataatgaacgcgtgcggaagttcatccagagtccgctgtgtgtgtatttgccactaaggcgagaagcgtgtatttccagtagagccgagttcaaagaatacatcatttgtgtgcaatcagagccagtgataagattcaaccttaggaatcacgactgagaaaatgactttcctctcatctgtccctgcacagtttaactgagcagcgagccagaacccactggctctgggtgcgaaggccacaccggctcagcagaactggctctgggcccctgtctaacctgtgcttctccctctctcatcaggagttccgattctgaagaggcatttgagaccccggagtcaacgacccctgtcaaagctccgccagctccacccccaccaccccccgaagtcatcccagaacccgaggtcagcacacagccacccccggaagaaccaggtaaccaagggcagggaggcccccagacagccctgtagagttgtgagccctgggggagatttgcagcagttcctcctgggtcaggctggaggcgagcactgactcgacctcttggctttgagttgtgcttgacgtggcttttgtagttttcttgaaaatgaagggtgaacagatacactggattattttgcatttgctttgcagaattttagggggggcctctggggagattgggtttggaggagggcagtgggtctcggaagttcacagcacagtcttggattccagcacttggccccttgctcttttaagaacattagctgtggacaggcctgtgaatctacatgtgtatttccagcactaggcttggggaaggaaggtagtcagtgggcggggatagagaggtagacattcacagcagatcatggtggtttgtttattcctcatgaatctcgtgtcacctgatttcatatcactttcccacaactttctcccttagtgtgagtgaaaacacctttatgttccttttagacgggtggttagtggacaggtggaatagatctcgtccccaccccacccctgtggggcatgcattctgcgcctcccagttacaccagcacagagaaccacctctcacatggaagattcacaggagactggaagagatagggcctgccagaaatggtcccacaggctggccagggggcccaggtggtattgtccttgggcctggacagctctgggccccacaacttacaggaccccactttggccttccttggcccacagccttcccgtgtgatgagaagtctgcagggccaaaccccttctagaccacacgctggatacctgggagcggccactgccaggggccccctcgtccccttctctggctcttcctcccgagggcaaactgtacctgagaaggaaccaaggatggggctgggtgcctccactgtgtacttgccctggccaggagccaggtaaactgaacaatacaataacattttgaccttgatgttggttttagaaagaaatgggtggaattctttttatccgccgtgggttcgagcagcccgttgttttggaaaggatgtacactcccggagctttgttcctaaaccagcaaacccccgtgctgggacaagggggcaggacagttttaatgagagctgatgcctttggtggagtctgccgaatactgctcccatgtcccccgtctttgacggctcatcagtctgcagcagtgtctggattttgctgagtcagtgtagatgccagactctgggaggatagtgacggatatttctttgatttgaaagtagagaagagccaggagggctgtctgtagttctcagagcatcgtttgcatctcttcctttattttgtatgaccaagcatataaaactgtatttctcgtaatatttttaaaaacttacccataatttttaatggaaagtggctggatgacaaacacattgtaatctctaggtcaaatgtgtgattaagaataaactattctggccgaggcgggcagatcatgaggtcaggagatggagaccatcctggccaatacggtgaaaccccatctccgttaaaaatacaaaaaattagctgggcgtggtggcgggcacctgtagtcccagctactcgggaggctgaggcaggagaatggtgtgaacccaggaggcggagtttgcagtgagcggagatcacaccactgcactccagcctgggtgacagagcgagtccgtctcaaaaaaaaaaaaaaaaaacaaaaaaacaaagaataaactatgcttggccgggcatggtggctcacgcctgtaatcccagcactctgggaggccaaggagggtggatcacctgaggtcgggagttcgagaccagcctgcccaacatagtgaaaccccgtctctactaaaaatacagaaattagccaggcatggtgccgcacgcctgtagtcccagctactcaggaggctgaggcaggagaatcgcttgaacccgggaggtggaggttgcagtgagccgagaccatgccactgcactccagcctgggtgacagaaccggactctgtctcaaaataaacaaacaaacaaatgtttagaagaaaatgatagcatgttatagggcatgtaccatccccagcaccaaggagtgtgcggagaggccacttgtggccacaggtgcgtcttctgggattcccagtccgacatcctgccagctctgggatgaatgggatgccactctgttctcttctttgatcctgtccttcttccttctgcctaacttcctttcaacaaagcagagaacaatctccattcttaaaacgaacacgcacaacatccatctttttcttagatggcagttactaaaagaatgagcattattgaggattaaaagataacccccaccagggaaggggatggaaacgttaattgctgtggagtcacagcccctcagaaccttggattacaccaattggagtgtttgaacggggactttatgtttctcctcctttgaaaacggcagcaaggctagctgtgtgaggattgtacactcaggagacttacggttggaactgtgtctgctgaaagcccccctagcttgggctgtacaaagatccatttgatttgctgccctggttagaaaaccgcctcccaggcggagggtcccctcgtccattctgtagaccagcatggggcattacgaaggcgtgggaaggcagctgtgcttgctagtgtaggtggctgtaggagaagaaagatttgttctctcaaccataggaaagaagggtaccaggggaaaatctattgtttactttcctctgcacagtgcccgggatgttgcgaaaggtgctgtgggaaccacgtgaattaatacacaacacctttggctgtgaataaagatggtttttccccctggcaacctacattttataaagcactcacttgccctacattgggtcctaccagcgtgtctgggctccctgggatggaagatgtgtgggccagagcagtcccatgagcctgtcctgagggctgtagcctggaccacactcctgaggcagaagatggggcaaaggattgcacctgctgccagctggggcgggccaggactcagctcatctgaacgcagttcccttatctgtgaaatgaagagggtgatctgtgggtcccttcagatccttccagctccggcctcccgaggtcctgtgaagggaatggttggctgatgtacagtgaccgtgttattagaactcaaaaccggccaccaagggtcataattacatgtcatgtaattaaataatagctcccattcaagcatttgccttgtcagggctatgctaggtcctctgagtgtttcatctcccactcaggtgagggaggatcagccgtatgcacacagcatccctgtatagtggatgtcttcccctgattccccagtgacacgcggaggttacgaacctcatacgccatctcacagcgataaggggactctggtgtcagaacccaggcctccccacttccaagcccggctcccttccatttggaaccagactgctctctgcgcaggtacagtgagctggtgcctttgtgcgcctagcctggggcaggcccttagtaggtgttgagtgaaagttgttgctggacctgctgttgcttagatgtgtgctggggcagtcctgccagcctgtcctgagagctgcagcctaggccacgcccccgaggcaaaggatggggcaaaggattgcgagtcagtgggtgatcagtgggggcgacatggcaggagagctgaggcaggtccattctgacagttgcccacctgcccttcagggacattgttcagcattggggaatgcagcttctttactcattcttgctaggagattgccaagcccagggaaaggcccgtgttggggccttggaggtaatgggggcctccctgtgccctgcgtgcctatacctttcctctgtctcccaggacatggtccccaggcactgattgtggcactgcacctgggggcccgagccattgagccaagggtatacagattcacagccaccagatccaagcaccagtgtcctcgccaggcactcgttgtgctccaagtggctgtttgtggacagctgtcctcacattgacttggaatggagctcagtgcccagcctggctgcagagcacacagtggcttcccttttctttgggcccgcctctggttttcgtatacactgtcacctgcttttgtctccaaagaggccatacgtgggtgctccctgtagccacgggagacttcctggcatggggtggggcatcccagaacccagctgaggcccttcccagcctggggcaggggcacaggggtgggtgtcaccatggcgtgtgaagagcagggggctgtggttgccttttcctgacacctgctatgacctgggccaggtgcttacagactctccctcttcacccacacaagaattccctatgacagctgatgacagcacactgtcttaggtctgatcacacggctatcaacgtaaccatagaccaggtacctgttagcaacagaaatgtattgcttacagttctggaggctgggaagtccaagctcagggcactggcagatttggtgtctagtgaggacctgctttctgttcatagacagcacctcctccctgtgtcctgacatggtgaaaggacacacagtcttcctcagtcctctttcgtaagggcactaatccactcatgaggacactgcccccatgagctcatcacctcccaaaggccccacctcctgataccatcaccttatatgaggatttcaacataggaatttcggggacacacacattcggaccagagcacacagcaagctgagggccgagccttttcaggcctggatctggctgccacaggcactcgggccctcttgggccggctgctccctcttcacaatgtgagtgtttcatgggcccaggaccagggaacaggtgagaccactggagattctgatgcagtccaggcagaggctggcactgcacctgggggccctggccattgagccaggggtatatgggttcacagccaccagatccaagccccgttcatcccaggctggaaggacgatggagagtttggggcctgcatagagccaggtgaggagacatgagaggatggcgacctcacctgcccacagtggccacatctacagtgagaggacgggcacctcacctgcccacagtggctgtgttcacatggggaggacagttacctcacctgcccacagtggccacatctacagtgagaggacgggcacctcacctgcccacagtggctgtgttcacatggggaggacagttacctcacctgcccacagtggctgcgttcacatggggaggacggccacctcacctgcccacagtggccacatctatagtgagaggacggccacctcacctgcccacagtggccacatttacagtgagaggatggccacctcacctgcccacagtggccatgttcacatggggaggacggcgacctcacctgcccacagtggccgtgttcacatggggaggacggccacctcacctgcccacagtggccatgttcacatggggaggacggcgacctcacctgcccacagtggccacatctacactgagaggatggcgacctcacctgcccacagtggccacatctacactgagaggacgaccacctcacctgcgcacagtggctgtgttcacacggggaggacagcgacctcacccgcccacagtggccacatctacagtgagaggacggccacctcacccgcccagagtggccacatctacagtgagaggacggccacctcacccgcccacagtggccacatctacagtgagaggacggccacctcacctgcccacagtggccacatctacagtgagaggacggccacctcacctgcccacagtggccacatctacagtcagaggacggccacctcacctgcccacagtggccacatctacagtgagaggatggccacctcacccgcccacagtggccacatctacagtgagaggacggccacctcacctgcccacagtggctgcgttcacatggggaaaacggccacctcacctgcccacagtggctgcgttcacatggggaagacagccacctcacctgcccacagtggctgcattcacatggggaggacggccacctcacctgcccacagtggccacatctacactgagaagacagtgacctcatctccccagggtggccacatctacactgaaaggatggcgacgtcacctgcccacagtggctgtgttcatatggggaggacggtgacctcatgtgtcctgtgcaccttggatggagacaccaccaacctggcagggccccaaccctctggacgcacattcacttcccgtaatgacctcgctggaggggcttgactgctctccacatccacacaggcacagtgggccatggatggatcctgggatgctcggggctctcacagaccccaggctggtggctcagcccattatcctcccgggaagacaggggtataaccaagcaccgcaggtgttgtcctgttacagatgacatttgataataataatagaaaaatagtaacattgtggggggtggtactagagacagtgacagcgaggcacagcaaggttaaggagctttggccaaggtcaccaagccgattagtggcaaagccaaggtttccgctgctttttatgactctgcgctctttgaaactgacctcttttgaatctgacattatgttagtggtctgtcttcatgctgtcttctttagcttttttttttttttttttttaattcataatcagtgtttttattattttcgatgatggctcatttctaagttaagtgatgtatactgtctacatttcccatctataagcttttgtttttcctggacttttgttacctaattttgatttgcttaggttattatttttttaatctatggcatgtcttcctatcgctatgtacaatggctttcagtagaactttttacaacttcaaactcatcagataactgtgttttaatatctttttctgaggacattcctcccaaatccctctgttctgctccacttggggctgataggtccttttctgttttgagacagggtctcactctgttgcccaggcttcagtgtagtggcacgaccttggctcaccgcagccttgacctctgggctcaagaggtcctctgattgttctttattcttgttgcacagctgttgtttggggacttccctttgccatcatcctgggatttccctttacctccttcctgtgtgatctccggtttcctaaaatccctgtcttcctctctgttaggttattccctgttttggtcagtacatcatccaagagtttcctgacaaaagagatgggaaggtaatttgtttctccagaagtagatttttctttctttctttttttttttttaattgatcattcttgggtgtttctcgcagagggggatttggcagggtcacaggacaatagtggagggaaggtcagcagataaacaagtgaacaaaggtctccggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccctctttctattctacaaaaccgccattgtcatcatggcccgttctcaacgagctgctgggtacacctccccagacggggtggtggccgggcagaggggctcctcatttcccagtaggggcggccgggcagaggcacccctcacctcccggacggggcggctggccgggcagaggggctcctcacttcccagtaggggcggccgggcagaggcgcccctcacttcccggatggggcggctggccgggcagggggctgacccccccacctccctcccggacggggcggctggctgggcgggcggctgacccccccacctccctcccggacgaggtggctgccgggtggagacgctcctcacttcccagacggggcggctgccgggcggaggggctcctcacttctcagacggggcggccgggcagagacgctcctcacatcccggatggggcggcagggcagaggtgctccccacatctcagaagatgggcggccgggcagagacgctcctcacttcccagatgggatggcggccgggaagagacgctcctcactttccagactgggcagccaggcagaggggctcctcacatcccagtcgatgggcggccaggcagagacgctcctcacttcccagacggggtggcggccgggcagaggctgcaatctctgcactttgggaggccaaggcaggctgctgggaggtggaggttgtagcgagccgagatcacgccactgcactccagccttggcaccattgagcactgagtgaacgagactccgtctgcaatcccggcacctcgggaggccgaggctggcggatcactcgcggttaggggctggagaccagcccggccaacacagcgaaaccctgtctccaccaaaaaaatacgaaaaccagtcaggtgtggcggcgcgcgcctgcaatcccaggcactcggcaggctgaggcaggagaatcaggcagggaggttgcagtgagccgaggtggcagcagtaccgtccagcttcggctcggcatcagagggagaccttggaaagagagggagagggagaccgtggggagagggagagggggagggggagggggaggggtagatttttctaactgccttctttagcttttaaagaaagcacttttccagagcgtctcatttcatgcctgcttataaaggatgaggagtggccccaggtcacagccggtgttatttcccccattgccctctccctctgccttcaaatgagcagttaagtcagtaaccggctgagcccttgtgctgatgctggggctctgcctgggggactgtggccccttggtcggcagcccaccagggaagcaccccagcaggacaacaggtggggatgtggcaaggaaagctgctcatctctggctgacaccagagaagtgacagtcagcaaagcaggacagagagggacatgtgggccgggtacggtggcccatgcctgtcatctcagcactttgggaggctgaggtgggaggatcgctggagcccaggagtttgagaccagcctgggcagcatagcaagactgcatctctacaaaaaatttaaaaactagccaggtgtggtgtcacgagtttggctagccacttaggagggtgaagccagaggatcacttggagttcaaggttgcaatgagctatgataacgccactgcactgcagcctgggtgacagagtgagaccctggctcttcaaaaaaaaaaaaaatgacgtgtggcatgctctaggtggagccaggatcagcccagggctgctgaagtcccagctgtctgaaccgcccgcacagcacagtggggctgtcactccaacagtgctcctgggtgccttcttacttcttaccctacctagcaaagcctccccttaggtgctccccatcctcactatggctctgtcacttagatgctcacgaggcggactctgctgggaacaatttggtttatgtaaagacactttaatttcttcatcactaagtgagttagcacggtcagtaactgtccccacagtgcctcgacggcacttttccctcttggtttctgggaattgaacagaagtttgagagcagacatacgagagcaagatagacctcaggaagcagaggagcacagccccacccggtgggggttcctggggtctctgtgagatcctgaacacccactggtctgaggacagaaggcagccatggcacgggcctcctgctctcttgctggtcggttttgggtttggtttcttgagctgtctgttttggaccacatcagaggagggtgggcaccaaaggacagcctctgcctggtacttctgcagcactgatgcctcacgcctctggggtaaaaaccccacaggaacttggagctcaaaggcccatccaagcttatcctcaaagctgactcatttttgtggccaaatactaaagtgttacccactggaggtttaagaatgaggataggcccagatagaagcagatgaggtgagatagcccagttccagacttcccgatgaggaggcgcacctgtggcacctgttacgatgggggccctgagcccccaccccagccctgcagaaggaagtgctgctctgcagaggaaggggcggatggaggcggagtctggggttttaatgagtgtctcaggtgtgtcttaggctagacaaatttgggaaatgttgaattcatcacggacttgctctgagctacccacagcaaccagcaaactgccacagaaagaccaagtactgctttgtatctcgttagcctacttaaaatggacaccttttcccagaataaatattactaactgaagattactatttgtgtacttagaagatacaaagccatgctctctgtgtaggagaccatctacccgtgatgcggcagcttaagagaagagtctgtgaatgcctgggcacacctctggccctctgggcgccaaggattcctgtgcacagtgaactcactggggggcggggggaaagaggggaggatggagaggcgccagtgcgggggctggcagcaagtgcttctgtgagaaacagtccagcaaggctaagggtgtggcctttggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgtatgctgaagccccaacccccaatgtgattatttgtagggaggacctttaaggagacagttaaggttgaatgggttcatacgggtggggccctaagcccatggggaccagtgttcctatacgaagaggaagagaccaggagtgtgcagagaaaaggccatctgcaaaccaaggagagcggcctcaggagagacaaacccactgatgccttgaccttggacttgcagcctccagcactgtgagaaataaatttctgtggtttaaaccgcccagtctgtggtccttggtgatggcagcccagcaagctcatgtaactgggataccctagtgacccttttcatctgatgaactgcgggtgctgactttgtcatcagactgagccagaaacctggagcctgtgtgcaaggcactgttctctggggcattgcccagatctgtgtcagtggagacatgaggtggaggaagtgttgtgtatgtattcatctgggttcctatccttccttacctctatgtcctcggcacaccccccagtggctgatgtatgggaggcaccccaggttatttgtggaatgaacaaatgaatcacacagttgattgtgtctgcattggtcttcatgcagatatgccgtgtggatgtttagaaatccagtaggggagcagggaggctgggtgtggtggctcacacctgtaatctcaacactttgggaggctgaggcagacggatcacttgaggtcaggagttcaagaccaacctggccaacataatgaaaccccatctctactaaaaatagaaaaattagccaggcgtggtggcacacacctgtaatcccagctactcgggaggctcagacaagagaatcacttcaacctgagaggtggaggttgtagtgagctgagatcgcaccactgcactccagcctgggtgatggaatgggactatttcaaaaaaaaaaaaatgcagtaggcgagcagggaggacttcgaacccagttggaccacaggagcccttctagccctgtgaggggccccgtggagcagcctgctctggtaaccaacacaataagacagccgttcccaaccagggaggattttgcccccacaagggtacatggcaatgtctagacacagtgttggttgtcacagctggggtaagggtggggcctactggcatccattgtgtggaggccagggatgctggtaagcatcctacagggcacaggacagcccccagcataaaaatctgactgcccccaaatgaccataatgccaaggataagaaaccctgcagcaagattaggtttcctggttcatgatgagctaatgagagcatgtcagttctaaagaggaaagccatgctaagcaggcagggagctctttcttctggaggaagcaatgagcagatggttaagctcattgttgcgtgataactgctgacatttgaagggcctccgaaggcttccttctgcaggctgcagaggcacgtgtaacggcctgagagggagagggttggtgtttgtgggccttgacgacgggataggctgaggctcgtgcttcctcctgccaaggcccatttgaaagcacctggtccccctcagcatcccctggtcctctgttccctccgtgtatccaggggcaattacagagcaggaagaggaggtcacggctggtgggaggatggggtacttgagagtactagggcctagaggaaacagggagttgattttagaaagaagcgaggcaacaccttttgaaatgagaaggaaggagtgtttggagaaaccgtttggtagaaagagctccgtatttagggcgtctgctccaggtaggccctgggtggagaagaggagagtgagaggcttgaaaccaggactagctcatagatgtgcttccaaatgatgctttcaatccaagcgtttattgatcctgtaagaaagtgtgaccagtcaagggggaaacaaagccaaggccagttcctgaactcaagaaccttgaagttttcttgtgttgtgagctgagttctctgccaggtactccaggagaaaggttgctatgagcaaagcttggtaagcactctgcagaatactcactgcccagagatttgcagtcgggagcatgaattgctctgagaaaatcgacaggaagagaccagttcaggggttaattgtgcatttcccaaaccttgtttgtttgttgggatgagagatagggctccctgatttagcaaatgaaaatacagggtgcccattaaatctgaatcttagataaacaaagaatcatcgagacatgggacatacttatattaaaaaacatgttcatttatctgaaattcaaatcagctgaacatcctgtcctttgtctggcaaccatgccggtggcagaaggggactgggggtacataacacctgtcacgaggcacacattggaaacgctgtcccaggtcttacctgtgccagctccgtttactcctcattctgcatctcccagtacttaggcctgcagaccgctttatcgtgtttgccctcttgtccaatgacacacttttagttttctggcatccttgactgcctggagcagctgtgacctcagaaatgcatgaaagatgccgctgggtgccagcagaacctagagtagccaagccaaagctggggctggccggatccccatgggcagtagggtggtggcacctttgagcatcatttggccaacatttgcagcatctgcagcatgtttgggaaataggagcaacctccttgactggcaggggctgatgaggtagaaaagctgagaggaggcagctgggagagcagtgagactaggcaagaggcagggccaaggataggcaggcaggactgaaggagaggttacaggtgatggctggagcggcaggtggcagacagcaagtgctactacaggtgccgggggcctccgtgtacaggctcccctgatcttcacagtggctctgaggagtcaagaacaggcttgctggtggccgtggctagtatgaatatttatggaagcctccgtatgccttcctgcaggatttctctgtcttcctgtcccactcttgacccttgctttagccacactggcctcctcgctgtttctgtaacgcaccaggtgctcctgccgcagagcctttactcgcactattccttctacccaggatgcttcctccccaggagtcctcctgtttcatgcacttaccttgattctggcctttgcttagatgtctcctcagaagatcttgcctgactaccttattttaaaagtgaaactctcctatcccggctttatttttctccttagcatgtatcaccctctgaaattctgtacattgtttgtttgtttttgagacagagtctcactcactctgtcacccaggctagagtacagtggcgcaatctcggctctctgcaacctctggctcccaggctcaagcgattctcctgcctcaggctccggaatagctgggattacaggcgctcaccaccatgcctggctaatttttgtgtttttttagtagagactgggtttcaccatgatgaccaggctggtctcaaactcctgacctcaagtgatctgcctgcctcggcctcccaaagtgctgggattacaggtgtgagacaccatgcccggccctggtggtttattcgctatcttcccctgaagaatgtgacttccaggaagggaaaggttttgtctatttctgttccttgttgaatctctagtacctagaaccatgtctggtcctgattaggcacttggtgaatgtttttgaatgaatactctgagctgttctttaatcggtcctcatgatcctcattgtacagatgagggaactctgggcgaacctggcctgggtcttgagctaattacgggtaggtcaggttctgtacccaagtagtacacacagtgatgggcggggtggcctggggccgtggtttgtcaacccctacgctggagggtgatgttttggtacaagaggagaggtgccccaatgcgtcctgtgtctgtaattgatggcgttgtctgtgtttccccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacgtaagttcaggggtggaggtggtaaggatcagaggcgggggtgcgcattggctgtgacccttggtcatgtgcctggataaccttcgactgccctaaccttgcccctgggtgctgtgatgatgccacgcttacggccgttgcaccaagcagacaatgtacgtgttttccttcctctctgcggtcacagtggtggcattttcccatccacatacccctttgtgtccttgatcttttgctttaataaatcaatgggctggagctttacttgtagccaaagacctaatgttcaactccagagcaatctgggagatcccatggaaggggaaaggtccttagagatctggttcatctccctgttggtgactgattgctttttggagaagctgggagatacaccctttaaaatattaaaatgtatagtacttgtttctgcctattaatgagacattagcccaacctacaaacatagtagattccaggaggctcaggaatgagagatgtggcctgggcccctccctgctgcactccaaccagcccgtaagaaacacccttctttgtctccttccttctctccagtcatcttttgtagacaaagtccctgcaagttctgaagagataaatggaacctgaaagtggggagcaaatccccacaatccccaggaagccattggtccttggctctatggtccccagacacttgacaaggccaagtacatcgtgcttaaatatcaaacacccatgcctccagaatccaccccaggacccggctctaatgtggatggctgctggtcctttattctttggcccctgtggttaatatcttggcgatttccttactcttacgggaagtattgtcagtaatttaacaaggctgaggagatcagtctcccaggggcagcagaacagaccacagcgctggcccctctgggtctgcctggcacgaaagagacagaacgacatgtttacctcccattctgggctccccctaacattgaatttctgagaagaacccagggcctcctgagaggaggtctctacagcaggttaccttagatcaacctgccactgtctagtggtggctggaggccatcctggccaaaatggggactttgttttagatcagttactcaactaggtccctactagagactctctagaattcacgttggaaacttgatttcaagcctggaataggagaagtctgcaatggctagactgcaaggccgtgctctctcatctggaatgagagccaaccttagccgccacctcttccttctccaagatatgttctgtgtctcataggcgtccccagtcactttcttgtttgaatattagagctaacaggggtcagggaagtttacccaactgtgtcctcacctctagtgcagacagggactttggcgtggaagaccctgcgtgggtctgacaaagctcttggggcaccacggctttgtgggatcattaggatcaagagaggaagctgttccccagcagctccttccaaaaagctggggcattgccctacagcggtggccgccatatcctaacccattaataaccagttgtctgcagatttatcttttttgtcagttccttctgtctgtctctctttttctttgtcttcttgtcttaggatggttgaagatgtgatgtctgtgtgttctctgttgtaagtaaatttaatgcaatctgcctcttatgccaaatgtgcttatttttctgccttttgtttctgcttccaagccatttttatttcccctctggctgctactgatgtgtttctgtggtgggcctgcgaatgatggggcatggggctccccagtagcaaagattacttttctgtttcatagtgatttgcataagagactgcttggctgtgaaaatgtgattatccagcatctgcctgcttatcaggaatggaacttttttccttcccttgcatattggatgtcttcatctgaaatcaaacattttttttaaactcttcattacattttttcattttaaactgggctagtgggcgattgctttcaacactactgtggcttcacgttaaaataactgtctggtctaaccacaggcagcgacggccacagcttattcttgctaacatgtaaagcagaaatatttgggccgttccaaattgaggcccacagagtgccctgaaatgcagggtcagtgcagagtggagcacacagctgtgagagccatcgccaggctgccccagtcctgcatcctcagtcacccaggacctggctgggtgtcggcatgccttgtctgccatctgtgggtcaccctgccacttgtcagtagaaacagagctgaccatttctgtgcctctgctgctttgcctcccatggccaggagggatctgtgggcagctcgggggggtccaaagacatgcaacttttccctgtccttagaagggaagccggccagtccaggtggccagcagtcccaggatagggtcgagtccatcagactctcttctgcccaagggatttcttgagtatttttgagccacttagcaactataaaatatatggttatatatttatatgcatgaataaatatatgcttcaagctgcgattgcactgttttaatggcaaatattataaatgctgtaaatagccatttatttttttttcatgattaaatgccattgttggagtgatttgagagaacacaaggaaggaacttgaatgccaaattgctctgcccacccagttaacatgcaaagcaggggagggtggtgggatctaaggagagggatcaccccccaaagcctttgctttgctgggagtgggaccaacccatggaggggctggagacggggcaggggccagtctacagggtggaaagagcccccattctgactgtggaagtgacccccagactgctcggtggacttaatggaactgctcaggctaaaaggcatccctttctcctgggatctgcttccttgacccttcaggagtctgatttggtggtttcctttgcctctcagccccgctattcatatggaggagaaaaagggagagaagagctgtgaatcttgtctgtttaccatggttaggagaagacaaaaaaaatcatctctcccctggccctacctttagtcaggattccacctagaagccttcagagcatgggaatccattgagctcaaagatcctgtgatagggaggattcaggaggttctccttgaggaccccgaactttctatttctgcgtggcccccttcagttgttcattaagtgaggtgtcgccttgcccgtctgtaaattggtgtcctgagcctagagcccctcccctagccttagttgggttcagatacccctggaagaatccagataaattaatctgctcaccagaaatttgctttataaaatacgaacatttagttaaatttagcttcattttctgggtcattctccaaaatggcatctctttaaagatctccagcttgatggatctttcccttgggggcaaaaataatagctgttaaaaagtgagagtgggtagccggcgtggcctctcgctggtgctggagtgacagaggtgggagggtggcctgggccagatggctccgcagaggcagtagcttcggtccgctctgtactgctctggagtgttccgtccctctgcttgttgtgtttacgttttccattttgtttccagtgacacatttagggtgaaaaagtcgccaaaacggtctcctctctctgatccaccttcccaggtacagtgttcctttgatcttgatggttttatgccccccccgggggaggttttcttcgcttgttgacaaagctttgctttctgctcatcccgggcctgtttccaagaccctcttcttgcattctgtgtggagggtccctcgatgtttgcttcacattgttttggtcccttcactttgcggaagatcagagtgtgtcccgagagtgggaagacgttcaggaaaaacattagttgggctctggaggacccactctgctccattcaggccagttcatctgctgtgaacttctaggactgtcgagatgagaaagtctcttgagatgaacaaatatgcagtgagaaggtgaagaaactcagcaagtgtcaggagcactgaattgtgcagccaaaattggagtgggaagaaaagggaagcccctcccctaaagaagtggggcttaggttctgtcttgattagagtccctcttaccagttcctccatcagatagattccatttcttctaccctgtttacagaccaaggaaagttatcgtcaagcctgtcagtatgttagggctaatttctgggtcataaaacaaaacagacctgccacccctccaaatctgagccagcaaagccccagcctgcagaccctggccagagtgggggcagtggagggaagcactcagccctggggataggggctcaggtcccagctgcagctctgtcctgacctctctaggttcccaccctgccctactccacttcccactctccagtggaaatggagataagatccccctttttctgcctccagggactgatgagatgcttgtcaggtgattctggtgatattgatgtgcaggcctgaagcactgtgtgagcctcgcacagcagtcacagtcgtaaaactagcaggaatgctcaagtaactaagacacaaaatcctgattttttttttttttaaattcatggtcattccctgaaacaaaccatcataaaaggagattcatagagggaagaatctgtgtgtccatctgtttccttaatggaccatttggagcagagtctgagaagagcatgcagaggattgtgaccgggacctgtcctggctaatgggtccccagacctgagggtgggcacagtttctgaccaagagtctgatgagacaagaaacagtttctcttctctttgcaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgagggtaagcaactctgtagccagctggacccccactctgcctcggagaatcctgcccctagggagccaaaggccaggagagaaacttctcagccaggtaaccacgtgatcatcattgtgagatcgtctgcacgtctcccgctgcacttgcagctcaggctgtgtttgaaaacagcctgagacttgaaagcagctgtcccttgacccaagactcctgctaagagccagcacggtgccctctaactccacctcaggactccatcgagtgggtcctgagcgcccactcgagctttgcccatggcttatgtcccctctgtgattttgataaacacagctccaagggagtgtcattcaagtcaaactctcagtgtaggtcactgacctggactcgcttggtgccaccgttattcctaggccccatactgtgttcagacactatggccacaccttttaatgaagcctcaaaccagagattcaccccaggcttgctgagagggcatgattccctcctcagaaatgggcagaaatgggctccggacaactttgcttatctcaatatccttcctcctatgtatattcaatttcagtgttttttctttttctttcttttttcttttttttttttttttttttgagatggggtttcactcttgtccaggctggactgcagtagtacgatcttggctcactgcaacctctgcctcctgggttcaagcgattctcctgcctcagccttgcgagtagctgagattacaggcgcgtgccaccacccccggctaattttttgtatttttagtagaaacggggtttcaccatgttagctgggctggtctctaactcctgacctcaggtgatctgcctgccttggcctcccaaagtgctgggattacaggtgtgagctaccccatgcttcctttttgataggaaaacctttttgaaggagagctagcacctttcttgggagggatgaccccattgccctgacctgttggtgcaccacgttcccagtcctccaacccattttctcctccagccacctctgtgaggctgcccagttggcattttgacactccagcttttgtgatggttttgagttttcctttctcgatttctaacaatttattttattatttttttgagatggagtctcactctgtcgcccaggctggagtgcaatgatgtgatctcggctcactgcaacctccgcctcctgggttcaagcgattctcctgcctcagcctcctgagtagctaggattacaggtgcgcaccaccacgcccagctaatttttgtatttttagtagaggcagagtttcacagtgttggtcaggctggtctcaaactcctgaccttgtgatctgcccacctcggcctcccaaagtgctgggattacacgtgtgagccaccgcgcctgaccgatttctaacagtttttttgaactgagtagaaatcactgtgaagaagatcacatgtgaaggtctggtctccactttttgctgctaataagagactaagatctcctttaaacggcttcctccctgtctgagtggagtggtggtgtcatgagggtgcaggtagattttaatcgtaactcaaaaactcccaaccttcttctggacgctcttccacagtcaggcccggaggcatggtttgctttgtgcccacgaggtcttggaatggtaccagcatgcaattatggtagatctatttcatgtttttcagagtattggatgcatatcttctccctacccaaaactgcctttctaaatttgacaatgaaaagatgatccaaattatgtatacttgtaccttttggcattttgttttctgtaaaatagagccttttggttggctgtcaggttggccctctggtttggggtttgagaggtccgaaagtgaccatcttggccaggcacagtggcacacacctgtaatcccagcattttgggagactgaggcaggcagatcacatgagctcaagacccaggtgttcaagacgagcctgggcaacatggcaaaacactgactctaccaaaagtacaaaaaattatctgggcatgctggtgtgtccctgtggtcccagctgctcaggaagctgaggcgggaggattgcttgagcccaggtgacagaggttgcagtgagctgagattgtgccactgcactccagcctgggtgacagtgagactcgtctcaaaaaaaaaaaaaaaaagaaaagtgaccatcttgctctcccctgaccccagaggccctacgatctggcctcagcctcctttggatccttatttctctctgcacctgcatccgaggcaggagcctgttcccggaacacccctcactcagctgcctctgcagtgctgctgtagaccccgcctgctggaacacccttccccccaccctcactgcactccccccacctcatccctgtttcacaccctttccttagtgctagcccctcccagcctttccctggaattccgctcctggctctgcccgccttcagtgcttgatctgggctgagctggggatatgaaacaccgtaataatgatgtgtgtgcatttcttgcttcccaactagcttgtatgtttcctgaaggcaagaactttgtcaggttcatctctgttcctcacagcaccctcaacgtcgtaggggctaaagacaggtttgtgaaataatggtaacacaaggtcaggcaggtcaacagcttagtaatgtcagctcagcaatttgatcctgcagtgggcatcacctgcgtcagatgtggagcactgcggggaaggtgctttatgttccagaggcagcaagggacatctgagcacaggcctcagacttggccattttgatagcacctatggtgggttacatctcttgagcttggtaagagatttctaaatatcggagaaaagcatttagaaaccatcctgaggttggggccgggcgtggtggctcacacctctaatcccagcactttgggaggctgaggcaggcagatcacttgaggtcaggagtttgaaaccagcctggccaatatggagaaaccccatctgtagtaaaaatacaaaaattagctgggcatggtggtgggcacctgtaatcccagctactagggaggctgaggcaggagaatcgcttgaacccaggagacggaggttgcaatgagccaagatcatgcccctgcactccagcctgggtgacagagtgagactctgtctccaaaaaaaaaaaaagaaaaaagaaagaagccaacttgagctggacatatgattttgatatgtgtgtgtctttagttttaccatcaggaaccaaatacatgcatttttttttccttaggaaatataaaaatactaacagtacttttagggctaatatatacctcattcaatggtggcatttatttgtccatcttctacattgtactaaaacagacaacttactagctgagtgacatatttgacagttgtttttttctgtaaaaattgaacaaatatgtaaatatatgggtttggaacaaaacttggttaaacccattaccttagaaaatgggaagatttgggaagtcatgactataatttaagctggtagacaataaaaaatccattaatgtgaagacacaacagttgcagtttcaggaggtgtgggccccactgcatccacctcgctaacacacccagggtccccccagcatctggacgtggaaataccattaatgtaatgaggtccagtctagcagcaccagacacacacccaggggtgctgatgtgattgatcgtcagaaagaatccgtgtggggcggggccccagctgtgatgtgagacttacactaaagtcaccaaccacaggaaaaggaaatgttgggtgagaaataataattatgatttaaatacatattcactatcattaattctataggtaacaataataagctagggcctgtcattgggtgaggacttactttgagctgtgcagagtcttttacattcatgatttcatttcatcctctcagtctgcagagtgcttttctacagttccccattttaggaacaaggatacagaggcttggagctgttagtgactcccccagtgtcctggcacaaatccgtggagagccaggtgtgcctgacttaacagctgtgctctttatgtgagcatggaacaggcttgctgcctgcgtctgtagaatgaggctgttgacctactcacactttcctacctaggtccataggagcagaatgttgcagagcttcaagttgtctttaatatttcaaaacacctgaatgtaactaggttagaaagatgcccaggggattaaaataccatatttgggctgtaattgtatcaactcactaggatgacactggtcatcttccacggatgaagaactcattgacaattataaatggttttctttgcgtggttgcttagtaaatgcccttttttggtgcagtcttttaaagcgtgatgcagtgggagaaaacttaacccatgtagtccttgtggaggaaaagattaggaactattggtctacacagctgagtcctctcctggctgtccaagagaccctgacagagtgcagttgttttagattcagaagtctcagtgactctttggtggtcacccagttgccctgtgtcctttaacacagctctgttagtccctccttcccactctgacagaggggaaagtgccctccttggaagcctcagctgttctttaacggcaggcgccgtctctgtcacactgcagacacttagaagggtgacggtggggaagctgggagcagcctccctgtctctttccctggactcttttcttctcccctaatataatgtcacttaggttaaaagttccagaaatactagccatgagcaggaatatatctgatcatgctcctttacatttgtgttacccatcgaagggtttttatcttaaagtatttcattttagcctacaaaatataagcactttgagctccacttggaagataagtcaataggcaaggagatatcaggcgagttggcttccctgatcctagcaatggagacctggactcagtggcatccttctggcttctgcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagaatatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggcgtgttctgaagcagcatctccaggcgtctgccactcatctgggattgatggggaggagtgcgggccttctgaaaccaggcatctcacaaatgcaaacactaatgtgggtgtcagagtaccccacttttgcaccgtcagttgctccttctgaagggaggaatggggacacaggacagtgggaagggacttccttttggcaggtagcagagaaggcagatgagtgagctccgtgacctaaaactcacccagattcagccaccagaagagctgaggttccaagtgggacactttagtgaggcgagctggttaccagagccgggcactcgcccggggccacaggcccctggaaaaactctgcggtggtctgttgctcgtttggtgtgtcctgggtgccctgtgctgtactggagtgtgcttagagatttctgttacatcatttagggcatgtaatgccttggaaatcgtaatgataccttagaagaggcagctgattcactattattttctcaacttaaacagcttataatagaacagtaaaatgatagtcccagagttttatacttggaaagtgatagatagatctggaagagaccctaaatatcaccctgtccatccctgtctccttcctcctcctctctctctctctctcttttttttttttttttttttgaggcagtctcactctgttacccaggttggagtgcagtggtgcgatcttggctcactgcaacctgtgcctcctgggttccagtgattcttctgccttagcctcccaagtagctggaactacaggtatgtgcccggctaattttagtatttttagtagagatggggttggccaggttgttcttgaattcctgacctcaaatgatccgccagcctcagcttcccaaagtgctgggattataggtgtgagccactgtgccctgtcctgcttctcatttttaaggtgaggaggcgattaagactttacaaattaatgcttctgtgttaagttggggcagaccctggggttcaggcttggtgtgagagttggaaacacactttctctactcatctttattcaggatgcaacagggctttctggcctttaatcacaaaactgtcttcgatttcatgagctggccatgctgagtagaaggatatgtttgcctcaccaagggagatttagagattcctgaaagattgtccacgtgtttaagtagttgaggttattcagccatttgcaggttttatgaaagtcctccaggaaatagctcattttaaagctgatatttttttgacgatgcctttagcaataggcagaaataaaggggctttaaaccagaactgctatttatctttattttcatcttaaaaaaagttgaaagattaaacttgatggattgccactgatgctttttcacagtgggtttctgagcaggtcactcttcacctcttggttttctttttaagtagaaaagaggtatctggtagctctagattgtggcttctgtgaagacagaagtccattctggtcttatccaccactgtatctgctatgcctggcactgtgcaaaccatataggaggtgcttcatccgtttgctggatggggagttcagttgagtgtcagcttagtttccaggtactcgaggcaggcagtggtgtttgccgtctccattgagtgtatgggattttcaccaatcaatttgaaacaggtcatttctccacccattggactttactagtctttgagtttgaaaatagatttggaccagccctgaagacactggtagaaccctgggaaaggctccaggtgacttacaaagcttctcttaaccagcagcgctgaaggaacaatatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtctggccacacttgggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggattacagaaactcctatgaaattgaatatatggagaaaattggctcctccttacctgtaagttcgtctgcctcgggccacttaggggactcgctttcctgccttcaggggcctcctcccctgtgcagagtgtctctgggagctcagaccccaaatcgagtgttttctgtgtacacagcttcccgggtgcacagcagtgatggactggggctggggggttgaggtttgtactcaatccacttcgtttgacattttcagggagaaaatgatagaatacaattagacgtcctgcagaattactttcctagactgagaaagagctagagatttctttaaaaaaaaaaaaaaaagaggtggtgatggtttttcaggtatacgattagctgtttttgagaaattgttttaattaactgaatattttctctgggcaataagcctttctccctggtttttcattttaagaggttatgatgggcactgtctttcctggcataatacctgctgccctagggcatgttattccaagggtgacctcttgctgttgtcagcgatgccctcggagacgtgtggcacacaggagggcttgcttgcttacagcactacgtggccctggatatgttgctctttatctttctttgcattagtcatagatgccggggttactgcttccaaactgcaggttgctgtaagttagacctgaaggttgggtgggagaatgtccccatgcacaggcttaactcatgcgccacgtcagtgagatcacagcttcctgagtaaagcacatgggctttgtcatcatccccttgtgcgttgcttaaagagcttagctctgtggccacacctgtgtccccagtagctgaggccatatacataatactgagggcgagacattttaccgctgaaggggaactgtcgtgtgttttgagatctttgatttaaatggattgaaaccacaaggggccccttcctcttgtgccaccacccactgcctggtgcgttggcaggcctcgcggatgaattcgtgaggagcatgccctgctcaggaacagcagagccacccagagatttcatggcagtgcagagcagcatacctgccggccgttgcagggacttatttggggaccccagcagggcatgtggagggggtctttcaaggtcttcccatcactgagagatgccagtcccacagcccctgtttctagtccagctgagttgctctccaggccctgcccctgccctgggctcattcagctatggtcagcccaggtctaggctcttgccctacctctctgtttatctgcagtggccagcacagctcctggcccagagagcgtgctcagtaaatgttggtgaattgaacaaagtccagctcaccaacgccgtggcgtcttctcccctggccacgttcctacttgaactcagttgtactttctctgcatcctccttccctcctggcctccccacctcactcctaaccaggccccacttcctcctctcttcctggtggctccagaacaatgaaggcttttccctgatgggttatttgttctctgttgaagagtgctccagttttcatctccgttgcacgttcaggccaactgtacccaagctgatatgtgattttgatccctgcagcaggacgacgatgccccgaagaagcaggccttgtaccttatgtttgacacttctcaggagagccctgtcaagtcatctcccgtccgcatgtcagagtccccgacgccgtgttcagggtatgacttccatgatgagagagttacacatcatgctggatgttctaaagcctctgagcaccttcatgctgttattttgacttcatttcagtgcatagattcaggcggctgacatgccacatattttttttttttttaatagagacagagtctcaccatgatgcccaggctggtttcaaactcctgggctcaagggctcctctcacctcagcctcccaaagtgctgggattataggcatgagccacaatacctggccagcccacacttcagtctctctgaatgtccacagggacataaacgcattggttttgttactggctaccctttggactaaagtgaaatccttcagcagttgactgtgtgtcccactccctataatctcgcccagtgcacacacactttattccatcatttgtctaaagggggacactgtggcccagcattcaaagctcgaatcccacctgtaccccctcctggttgtgtgacctgaagtgaggtacttgcctctcctgggcctcagcttccttgaatgtaaagtaaaagtaataatgaaatggaccttgcagggatttgatgaagattaaaggaggctatccgtcttccagagcgtccccgagctgtgtgacggggagagggcactctgtctaccagagagatgctgtgtgtaaagctcttgttgaagtacctggcacacctcaagtgcctggtaaatgtacattattgatatgggtgttcatgtttgcatttatgagggctgatgtttggagcagtgcattgtttgatcaagtaagtgtgggcattgctgtgagatttggaccagcctatttttgtctgcctgcccctttaagcaggagtaaaagtgcttgcattgacttctcagacttacaaaagagactctgcaggctgcccagggtggtgagaacaatgatgatggtggttatgttgttaaaacagtagtggcaccaggtgacaggtaccacattaagtgctttacaggcatgcagcatctcatttaatcttcacagagaggtccattgtctccatcttatagagaaggaaatggaggcacggtatccagtcactttcccagagtccacaaccaagcagcgggtggtctgctgaactgcagagctcgggtctgtagccagtggcatctgtgcttctgcccctcccttgtcacttggtcctggggtgactgcccagcctagaggctgcatggccactggagacctggctcatatccctctggaagtccaggattccttgtgatattgacttggtcagggcatcctggttgatttcagtgggtttcccaatgagaagactaaagaaagatgccctttgcttcccccaggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattgtaagtggagttggagggccccagatcacaggggatgaggtgtgggccagctgcgtattgtcaccaagaaggccaggccttcagagcaacactcacctggcacctgccatgggtcccaccctgactccctgaccacagaagccaacctgggaaatcccataccatgaggatgaggggaaggttctctattcccaccagtatggttttgcatttcccacttaagtactttatatgccttcagggttatttagtttccattttttgccacttaggactagactgttgctttagggcagtcgttaagcagtcctctgccgcttcgtccttgatggcagagggcaagggacccttttttgggaaacagttagttttcctgggacttagtgatgggaatttctcctgttcaaaaccaggacttttcctctccccaagccctgtggggtcttgcagagcaaacagagctgagctgaaggcctcacctaccccccagtccctgcacagcacacgtgtcacatggccttgtgcattccccaaagtaagcgatgcccatgccacggtcttccacacatctgaaatgcaccatccttctaggtgaattttagttttatttcctctacctcccgcccagcaatccccaagcaggtgtgaagcccttgatttagtgtgttatttttgttgttctgtgttagtaggccatttctcttgtgcatcaaatgtttattgagcacctactatgtgtttggcagttggatgctggggtggatactagaaaaacaatagcaaaaagagggtctagatgtgaatcaatctctcacatgaatactctgaagcacacgtccatggttcgccttctacaaagctggcttctgattgtgaagtctttctgatctatcagaagacactttttcatttgaaatcatctttccgtgatttagaaaatgacctttaccaaaaccttacttcatatatatatatatttggaagtatttcttgaagagttatgttacgtttggaaaacccaccagctaactggcctttcaccttccgctggctagctcccactcactgaccagggagtgagggtggcgtgggggtgggaggacactgaaggctatgcttttggggagggggtcgggtctgccaatctcaagatgtgcattgtcagcatgtgggaattagtctagatgaaaccacaagtaatggcagctaattgatactctctttagcctcaaggcaaaaatgtccagcaaatggctgcatggcccttgcttggaatcaatatcactctctgttctcctctatttttcttgtgtgtcctcctctctgccggctttcagacagctcccgagggctcctttgcctctgctgacgccctcctcagcaggctagctcaccccgtctctctctgtggtgcacttgactatctggagcccgacttagcagaaaagaaccccccactattcgctcagaaactccaggtttgtagcccacgtgtgaccttttgggagtttgtcaaaacctcagtagagaatgaacccccgaggcccaaatgaaataaggcaggatttgatgaggaactgccgagaacgttcccagtgacatatcttcccctcaaaggatggtatatgtgacgttctttccccacgataccaaagtgatgtaaattgtgtgattacatattgaacaaaccatttctatttcaatttacaaactgggcccaaatagtcattatttagaagcattgatagcccccaaagcagtttctgtgatttattcactgaaccaagaatattagatcaccactgagccaagccgtttatatatacgtggctatctcagactcccagtgagataacatctgggctcagtcttgcatctggaaccaaaaacaatgatctactctgtgctttaaatttgacaacttaatttgatatcctctagactagggtgttcagagcaaacctagagagattgttaacagccatctgagagatgcagctccattcatggaaactattggccaactttaccttaagaaagaaaaagggaaagaaatgaaagaaaagagaacagtaaaaattttgatcccattttgaaaatcatttcgtattcaactgcacaatacttcctgacaatcagaagggtgatttttagaaaaggaaattaaatgcttatttcatgatctgctgaggtgctaattgtgagagaaaggcggagcgcgtgtttttcccgagtgcctgtcatgacacattttcgtggcacgttcatttctcggatgtggaaaccattgacgtctgtcttgatgcatttccctgcggtttgcccacactccctgtgggcaggaggagttagagtttgccatcatgcggatagaagccctgaagctggccaggcagattgctttggcttcccgcagccaccaggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcgtcactcttgcataaatacacactgagcacatagctaagatccatttaagtcgataatgctaaaccgcgggatagtaatgctggttaaatgagagagaatacagagaccaatgtatgggtcagtagggtaaagaaggctagcctaagatggcaaagttggatagaaaactggttagcaccaattcaacagagcaaaacaaaatcatgacctttgagggttttttttttctacagataccatttgcttctctattgagcaaacataatttgcaacttttctattttctgcaagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgtttgtttgtttgtttttttacaaaaaacggcagtgggccatttggcctgtggagtttcccaattcctagttttagcatggagtatgacattgacagggcatgcagaaatcttttcgcctggcttccaagtttggggtaacttttattaacaatttgaatgagttgctgatgacgtgcagaacgtgtgtttgcccctggactgcccatgcaaaccttggtctctgagggcggcctcgttcccacccctcaccccaccccaagttggacagcccgatgaacctggtgtgtcagactgtgctctgtggctttgaacaagtaggtgaacctcttcgagccttagtattgccgttcgtgagatgaggccaataatagccagtgtacaggttgctgtgaggatgacagatgtctggtgtgcggagagtggcaccatgcttgacacatagtaggtgtgtgataaaggaaagctgctgttgttagctgacacttccctcttgcttctgttacctgatcaggtgctcccagcatctctcctcggtgggtggatccgggtcccattttacagatgggagatggagccacttgacagtgattcaccagcctgttggggactagaactcaggtctccaagtgagaggcccctcgctgggtgtggtggtacacacctgtagttccagctactcgggagactgaggtgggaggattgcttgagcccaggagttccaggttacagagagctgtgatcacttgattgcactccagccaaggtgacagagcgagaccctatcttttaattgaaaaaatacaaatgggagcccctggcctgcctgcctggagtaacagctcatctgcaggggggcagtgaggtctgtgtctctcatccttggtacaagagtaggagttccggctgctgctccagccctgagggccccgcagtgaggtctccttggccatacccaaaagagagacccctcccagagacagtgggtgcttacactgtgggtgtgcaggctgggaacagcgagacccaaggcagggacaagaatgtcaatacagattggggatgtcctcgttcttgttgccaaaccataagcttaggttgaatttccatgaaagcgagatttttagaaagcatgaagcagtgaggattttccccccactagatttatttctagacatccttggggcctaaagacagaatgaattgcatgcagtttggccactgtaagtaccatgtattcctgtccagagtttgaggtggaattgagcatgtttggtgagtagctcagggtggatatggagtgtgctgagtgctttggtccccctgccacctcctttggagagcggccagagatgactgttggcaaataatggccaggagttgactttttgtcaattacaggctgttctcagaatatgtgccccaattctgagttagaaaatagagtcatgtgtgttcatagtatataggtcggagaggcagcccaagccacctcttttatttcagaggcgtatgctcaaaggagtattctgtgactgtcttggagtatatagggaatatttttctctagcagagtaacttgtattgcttttgttaaaaagtgcattacctggtgatgttggcctgtggaaaatagatggtgttcctgtagctacccagcccgagggtggtccacgggcctgacctcaagttggtccctgtgggtttctttttcatatagaaagattgttccttgctgcattggaaactcctgatgcataggaagagaaaacagcagctgtgtatccaatttgcctttttttctggccatatatttcagcggtaggtgacacagctctgtcattttgccaacatggtcttaagctgttgctagcacaaagatgaaatcacttggaatgaaaaatatcatattgcatggatgaaaatcaccataagctagagtggggagtgattttccggttgttccctagagcagctttgacttccatatctctctagactgatggagagctgagtcagccttgcaggagctgcagtgggggtttctccatctcagttagaaaatgtgagaaatgaggagaagtccttaggggccggggtgtcaggctgcagtctcaccattactttccttccacatccttctggtcaaacggaatttggttgtgtcctcctgggagtgaacctgaccaaggtcactggaaatgtggtacaggagccctgaatttaacactcagccacgtcagatagaacctgaatgttgtgtctgggtggctctccaagaggcacaggctgtgggcctttctggattgggggacccaatataaagacggaaggatgtgtctgggttccttaggaacaaggccatacaaataacaagcttcaggaagggggcaagtcctagcaagaggcccccagcacggttgagtggtgtggcccctcagtcctggcttagaagaggccgatgcctggagcttacatgagcaagagaaggagttggggccacctgtgttgtcgttgagcagcctggcagcatgctctgtgtttccctctccattgctgtgtcacagactacccccacccatacacacacattgagccgaggttcaaaaggagggagacgtgatgcccaaaagccacaagtacagcctgagaggagtgacaaggaccagctcgcgagcgcctgtgtatttggccgtttggagcctctgtggtcattggctggaggctgtgtcttgactcggtgggcaggagcggctggctgttgccagtggtgccacctgtgggagtggcataaggcctgatgctgagtgcctccccatgatcaccgctcctgctgggcttggggactgcctgtggtcagaattggatggggcagcacccagcggaggccactctcctgcgcgggtggcggcacatgacctggacaccctctgagcaccaggcctgtgtccatgcaccgtggccttggtccaggtggctgtcatctccctagctcatcctgactcctggcctcacccctccgtggcccctctggcatggctctcccagcctcggatggcaggtgctctccccagaattggcctctctctgctccaggggacagggatcctgccacagtgctagcccctcccctccatgtctggcagcagggaactgtcgacaagggggctacgatgccacccccagctgccagcaggaaggaccccaggcacagcctgcaggtctgaagtgggtgacagtggccagaggttctcacaggtcgcaggacttcagtggagtgaaggttggaaattggttacaaaggccatgccttctgcgtcacagccatttcacatttcaatttgtgattctagtggctttttttggcccctctaaagtagcaagtgggggttatgtgagagaaacaaagcttaatctaaaaatgtctgatcttaaaatatcagcgacagacaaagctatcaatttctgttaaaaacaattcttggttgtaaggggaaaccagagtgtacacaatgcatttcatcaacatgcagatactcaggcagtaattcaagagggctctgaagtcatctgttcctttattgaaaacaccaggtggccgggatgaaggggtcagtgaacagtctacatggtagtgtccatttgaattttcttagaaaccccattattttacttattttttttcattccctttcttgttttacaaaggattttaggcagcataaagataattaattccttcattagtcatatttagtttctgcccactatgataaagttagttttaattaaatcaattttctcctgcgctgcagggagcctgcttattttgatcagaattgaatctcattctgggaaaccttgtgccccagtctctgagattctccattttattcatcttcagaaggtccacgctgagtttgatggtgacaaatgttgttttcattttgaaattttattgctcattaaaaaaaacacacacatttgttgactttaaaagtgaatagtttttgtttttccttttaaaatcctttgcctttttaaaatttttttaagacagagtctcactctgtcacccaggctggagtgcagtggcgcgatctcagctcactgcaacctttgcctcctgggtttcaagcgattctcgtgcctcagcctccccagtagctgggattacaggcatgcaccaccacacctggctagtttttgtatttttagtagagacagggttttgccatgttggccaggctggtcttgaactcctggcctcaagtgatccacctgcctcagcctcccaaagtgtttggattacaggtgtgagccactgcaaccggcccccaatttttttttattaaaaatttttctagagatgagatctcacaatgttacccaggctgttctcaagctcctggcctcaagggatcctcccacctcagcctcccaaagtgttgggattacaggtgtgagtgagccaccgcacacggcccagaatttttttcagaattgtgtgtttatgaactttctccataaggacaaatattgagtcttgatctctgtgtcatttttcagctacttcctgagaagttcccccatgacaagcagaactgtgaaacccattttccaatagcagagatgaacccctgcatgtgaggctccggccctgcggcttggtggtgcccttgcttctgggaggtcagcctgcctctgctgagggctattagtatatattctggtcaagcgtccttaaaacggggacttcttgagggcctgagcctgccctgttctcacatgagcgagtctctggggtctgcttgaaggggactgtgtacttccatctctggccagtggatcatttgggtcctgcttcagggtcaccccaagtatgcaaggccaggcaggggccaagaaacccaggcaacagacgttcaatcttccaggacaaccgaaactatatagtttcaccctgcatgtatacagctaactaaccggtcctaactcagtcatctccggtcctatccattaaacttcttgagttttccaagctgtctcccttctcgggttcattttccctgatgctgtcgtagggtaggcacgcctgttctggtggtggaagagacaaattctgcacaggtacctttaggtcctcccccttcccagttaatgttggctctttaatcttacctgctgtccttgataagccctcattattctttccccaaatctctctctctctactacactgtggtagccttccaccattcaatttcttctcataatttcccaagggaagaagcagcctactctgcctgttagagcactctagtattgataactagggtagaggttcgctgggcagccatgacagcgccacgaggttaatgcataggactgagagtgtggttggtttgatgtttcttttgcagtagaagtagactgacaacccggctgtgctggtcagtgatgctgctaacaccgcatttcaactgtgttgcaaattgccgagcattttgtgcaaagggaaaaagaataaccacagactcctcctcacctgtgggaggccagtatctgtcctccacaaaaggctgtaaagcctcaaccaacatcagttgggtgggttggggtggtggatcatgccacttgttcagggtctaatcagcagatgtggatattgtcattgacccagtttttaattttcccattaacgtaacagacttcatggcaacagaactcttacataactctaacataactccaacataactcttacatccagagactctacctagccaaaggtgatattggttgacaactacagtaggctttaagctttgcgtgactcacatcctttcaaacagagctaaacaaatgcccccaaaatggaaatgtaaacagtcttacaaaagtgatcaaatctgtggttattcaaaactaggcaaacatagactagaattcaacattattcaccattgagatctcattttggaagtggaggctgctgaatagtgccctgggttctcaggcgctgtgcctaagtggctcagtgagtgataaatggcagagataagcaggtaccagacatgctggactccaaggcctcggagcttaaggggcctctgccattagcccctttgtctgcctgcccaggtgcagaatgatagatctccatccatagactggactcggcatttccctgttcatcagtctttgcactttctcatacttttgatgttctttgtttcaaaaccatacaattggcccattcatgagagggtgagtgtaatcctctttgtcgtatgattaatgctaactgttttttttttaattaaaaacgattccacagagagaggctgctcacccaacagacgtctccatctccaaaacagccttgtactcccgcatcgggaccgctgaggtggagaaacctgcaggccttctgttccagcagcccgacctggactctgccctccagatcgccagagcagaggtatcgtggcatgtggtgtaattaccctcttcctgccacttataaatacgtatgctcgtggtccacaaagccagagtctttggagacagactttgtcctctgaacgctgcaggcaaagatgtgtggcacaccatgcgttttgatcttcctagacgctatcgtgtaatgggccttttggccttgttgaatttacaacaaaaagcatgcccctttcagttgctccccagtgggcactgtgaaagtctgatatctggctgctttcttttttatgctcggggaagttctctgaatgtaattatggtttgttgtaggaagttttcattccacatttattcaccgtctccttttcttgatctatgaattgctcagagctgaattcactcatttggggctaacctttctcttcttctctctgaaactagatcataaccaaggagagagaggtctcagaatggaaagataaatatgaagaaagcaggcgggaagtgatggaaatgaggtcagttggggagctgggccttcctcgtgcctgagggatacttacctgtggtttaataatgaccggagctggtgtggtccacagaagagtgtcttctgtggaagttctctcttctttattacacacagttcatatttttctaaaagtatttttactctattactattactaaaatagcatgcacatgaattaaagaatgcattcaaataaatgtatgtacaatgcaaaacagatctccccactcagcctccagttccacaactcgcaggtgactatcttctgtttctggtggatccttccaagaattttccatttctcatcacaaatgtaacaatgagtgtaaacagcctcttttttctccaaaataaatgagagcttgcagtatacatcattctacactctttttaattaattaatttatttttttgaaacagagtttcgctcttgttgcccaggctggagtgcagtggcgccacctcggctcactgcaacctccaactctgccaggttcaagtgattctcctgcctcagccacccaagtaactgggattacaggcgcctgccaccatggctggctaattttttgtatttttagtagagtcagggtttcaccatgttggccaggctggtctcaaactcctgacctcagatgatccacccgcctcggcctcccaaagtgctgggattacaggcatgagtcgctgcgcctgacccaccactctttttaaatttaatagcatatttttgacgtattttttattcctctctgcctcactctgtttaacaggtgcttaatggtccattgtatggatataacgtaattaatttaaacagtctctgtggacaaacatttaggatgtttcctgactgtagcttaaatgatttattttcatttgtggtatgttgtaatagaaatatagtcaccatgtatagtgtacataagtgcaatggccgatactagttttttttgtgtgtgtgtttttgagacggagtttccctcttgttgcccaggctggagtgcgatggtgcgatctcagctcactataacctccgcctcccgggttcaagtggttctcctgcctcggcctcccaagtagctgggattacaggcacctgccaccatgcccggctaatttttgttttgtatttttagtagagatggggttttaccatgttggccaggctggtcttgaactcctgaccttaggtgatctgcctgccttggcctcccaaagttctgggattacaggcatgagccactgcacccagccccgatactagtttattatcaaaatcaattgcattcctggctaccattttaagcagaaaagcgaactgtaggtaatcatatcccgttttctaggtcatcgtaggatcttcctgaaaattctcctgttcgttccttctttctgctgatggttccctgtgaccacctctggacattgagcctagcgtgctatttcacattcaaacgaaagccctgcatttgcattatttttaaacctctttgttttttctcttatttgggggtatgggtggttctagtttttttacatgcactgaaaatgaggcatggcacccaggaaggctgtaagttctgtctctaatttcttttgcctcctgggagctttgccttcttggtgcctggggagtgcttattcgtggtttgagaagtcgtaccactgaggggcccccaggaggtgccatttactagctgatgtggtaggatttcaagatgtcaccagctggtgcagatgtaccggcatttggtagcccgaatgtcagcccgtcagcctctggagctagactaggtgaaaaccaggctctgcttcccagccactccggggcatcttacttaactctgcctcactttgcttattaacttgaaaatgggggtaaataacagtgcctcaacagagtagagcagaaggattatgaacaaaggctgcggagtgtgatgcttggattcacatctgggctctgccacttggcagccttgggatcctggaagagtttctgaatcactctgactccaccccagtgtcttcatcagtaatgctgggaacagtgagagcactgcctcttagggtcattgtgagggtagagtgaaaaaacagcacagctaaggtattttcaggtccccggtctctccacgcttccaaaaggacacgtcccttacctccttgtgtcctcagcagtgatgagtggttagacagggcagcctcaaagatctatcacagcttggtgattctgagatgcaaggaggtgttgtttaatggcagaaaacacagaattgctcctgtgtaggatttggaaagaaccctcggaggctcatctcatggttacctttcttgggagtccattctggggtgagacactgaccttgggaccaaggttgagcagccaagggcaggcacccagcattagactttgcagaatgcattctaccttcattatcccttttacccttattgaatttcccatacagccctgaaaggtggggtctaggaaaatccttactctaccaaggagtaagcagagcgcccgcagcttccatgaatgtcgtgctcagggtcacacagctgggaggggcaagctcagcgggatcccaggcctcctgaccggggtgggggtctctatggttttctgtcattagggtcctggatcttcaacagttatccgctcttggttctcttgtggggaataattattggataatgtaggtgaacccctgattctttttgagaagtttcttccagcagattggctttggagaaaagacgtcttcacacatcagtccttccatttggggacagctgggaggcagtatgacaaacaggggatcttagtgcttttgtgcagttactgtctattgaggcttcccaagaagtttactctgggccagtaggagatgagatttgtgttcagtgatgccagatgcatgagatgctttggaagaagatgcggataaaaggtaatagggttccaaggagaaatcaaggaaggcttcttgaaagagacaccatttgaattggaccttgagaaacagactgtgaggggtagaaatagagagaaagtgaataacatgggcagaggcatggggatgagaaggccgagagcaaacaagaaatcgttggttctcgctgagccactgtgttcatgacgtggtgtggaaggaggtaagatggatgagggaggttgggcccaggttgcaaagacctcagttgtcgggctggaggtttggctttatttttaatttttaaatttttttagagatggaatctcgctctgttgcccacgctggagtacagtggcacaatcatagctcactgtagcctcagactcctgggctcaagtgatcctcccacattagtccctcgagtagctaggatcacagacgcagaccaccacacctggttaattttgtattttttgtagggatggtgtttcaccatgttgcccaggctggtctcgaactcttggactcaggcaaaccttctgccttagcctcttgagtaggtaggactacaggtgcacaccactatgccttattaatttttttttcatttttgtataggcaggatctggctgtgttgcccaaggtggtctcaaaatcctagccttaagtaatccaccagcctcagccttctcagtacctgggactgcaggcatgcaccactctacctggtttgattttttttcttagtgggcagtgagggatgttgaaggctttgcacaagggagtggcatatttagagtcacgcaccaggaaaatgagcgtgcagggcgagggctgacattgaaggtgaccctggaagttggggccctgctggacatgggtcaggctgtggcgtccagctgtgtgagatggaaaaccattctgttgtcatgactccaacgtgtctttacttctcttataggaaaatagtggccgagtatgagaagaccatcgctcagatgataggtaggtgtcctgacctgcggggcctcaggccggccccgatgtttctgaactatgaggaggccttggaagataggaggctcagagtgggtttctggtagagcgtgaagcctttcagggaaggaccagagcattccagaaaatatggctttgccccaggacagagtctggggcttcttggtaacacccccctgaactgtgccatagcattattcacacccatggaaagccatggcagtcacctgccagccaccatctgactcagccaaggactctctaccttgtggggaaagagattccttttgggtgggatatttgggggattttttcttttcgcttgtgggagataataggaatcaaatccctagaccctaacttagtttagactcaaatgacacctcagcctttccacaaggacccagggacaaggacagtggaccacggcgtgattgtccgcctccttcctcccgtgaccatggcaggccctgttcactgaccccagcactgtttctcactgagattggacgctgcctcggaatccttcttaacacggcgtccctggcagccagtactgagaaatttgctttggctcacaataaaagaaggcctcaagttataagctacacatccctgggcttttttttcttttcttttctttttttttaaataatgagaaaagatcttgcagaagttctaagcccaagtttttatgctaatggtcactattcagaaatcatattataactgggtctgtgggatttttttaaaattaattaattatttgcttaggtttatgataatccattttttgtttgttttgggatggggtcttgctacgttgcccaggctggtctcaaacttctggggtttagcgatcctcctgccttggttgcccaatgtcctgggattacaaggcgtgagctaccatgcccagcccatgataaccagttttgttgttgttgtttgagaccgtctcgttctgtcacccaggctggagtgcagtggcacgatcttggctcactgcaacctccaccccccaggttcgagcaattctcctgcctcagcctctcaagtagctgggattataggcatctgccatcatgcctggctaatttttgtatttttagtagagacggggtttcactatgttggccaggctgatgttgaactcctgactttaagtgatccacctgcctcggcctcccaaggtgctgggattgcaggcgtgagccgctgcacctggcccgataaccagttttttttcttctaaggatatatggagtaaaaactccaggtcactgcagaccacgctttatgtgtccaagtttgacactgtgctggcacctggtccccacccccaagcatatggatgtatgagtcacatcacacctctagcttgtcccaaggtaaatataatagtagcctcaggaatagtgaagaggccaacaattgagtgctttccattcaaaggagcttcaattttgatttattgtaacaaagttcatttcacccagaaaagaagccctttcatgtttagcctcatggtgcatgcttcctatcaaagtgaaacttctttattaaattggtataagaatttatgaacacatatggataagataaaaaaaaaaactcttggagttgaaaatgctggcaaaaatggtcaggctaagggattgatgtcttccttatgtggtgtttggcaagtagaacacaactttttggcctcctggagtcttgggatttgagaacatcactcaggccctccatagttcatctggaaacatcctgctccatctcagagccatacactttcatttttgcccttggtgatgacattttggtaaatgttgaaatgcgggggaaagggtgtgagcttttgctcctgagagaaagctacccaagccatcttttattgctcagctggcgaagttgatataaacagacattccctcttgaaaattaaaagtggagaatttctctagttggcataaatgtcctgtccttgtcatgacagaaagattactcccacggtttcctcaaagaatatctgcaggtgacagcagtgaggaccttttcaatcctaggcagtgtgagttccctccaagccctggagagaatgccacctgccttcctctcatcctggtgccaggggttagggccacacatcaccccccatccccacccctgctccctgatgtgtttggcctgaggggccctctcttcaagagctgtacacacaatcccttagaacattttcctgtccttggggtactctctgggtggcccctgagactgctccagtgtccctggctgggagcagcactgccacacagaggggcatctcactgtgtgtccgttccccgatccccatcctcattcacccattgaccgtcctctgtcattccaaggcttttttcatcaggtgacaggcctgtggttgtcattccttcagccactgttgcaggtcattgactaaggtcaccgtagatttcaaggtccttgtgtccttgtggaagacagcagggggctgaggcatggctgggactcactgtggctcttggcaggacgtgccttctttctggcacggttcaggtcagggtctctccatgcttggtaacatgcccaggaggcccacctgggttccatgcttttctttccattttcactcacgtaaccagcatcccttgtgaaagaggaaactcaggcccagagagattggcagttcaggaccaccgtgactgtagtcgtattttgaagtcaaaccagctccagcccacatgtctagctcttcctggctctgctccattcagctttcacagatgctccacaccagtgtgacatcagtcctgccgttgttattcatttgcatcaaatgttactggagagatatgttttgttaagctcacatagtgactatttagaattcagaagagagagagacttctgtgctttctgcattccaggttgttgcaattgatttttttctgcttttctaacaactgccctgattatctgttttgcttccattttctgttgcatcttgccctttgcttgcaaaacaaacaggcaagcctggtaagtaaacgcttttccccctaatttgacacctgcccattgcaaccctttgtttgtttgtttttctatttttgttatttttgctttgtgtattgctgcattccccccacatgatttcatgatgttttgcctgaaaaagccagaaaagtcttcaggagcattgttttgttgttgagtgtagggtgtctttctcctgatttgaagaacctaactgcgtttgtcatgtacaaaaggatttgtgaagcattcttgcctcccccgtctcctgggaacggggtaattctatttttaaaaagggttaggttgagaggaaaggaaacctgaggcaggtgaagtcttggatccaggaaatcagatggacttggtttggtaaacagctcctttaccaagtcaggtgaaacatacacatgggctcagatcagcccagaatatacaccatacagcgtgctgggaactaagaaagcagccagaattccaagaataaaaacaagcatttgattattagagacatgttgaaaggccctttcttttaggagtgtgggtgtggcaagcaggttgttggcgattctatgttaaaaagctccctcttcgcaagccactgtgacactgttgctctgattccaggggtcacagagtttattatggacaatgaggctcttaataatgggttaccaatacaggactcttcctccttcttgggggctttatatacattttctcatttaatctcctgcaaatgccaggagatacaaatactctttcttcctattttagacaaggaggctgagactcagagagtttaaaaccctgctcaaggtcactcgtatggaaagtgtcagagtgagagctcgaactcaggcagttcagaggctcctagccactggcctgggcagctctgggctccagaggctcctagccactggcttgggcagctctgggctgctggtggtgagcgctctaggagtcccacgatcgcagaggcaggtgggaaggatattcggcatcttcagggccagtggttctccaagcagggtccctgccccagcagcatctgcgtcactggggaacttgtgacctgtgcacgttctctgccccaccccagacctcctaatctcacgccgtggggtggggtgtagcagcctgcgtgtgaacaagcccttcagctgaataaatccacactcacgtgggagagtttttggaaatgaggtgctgggaccctaagaggtcagaactttagagcaagcttatgtcgggaccggagctgaaaccgaggaaatgaccccaccacaccacacggtaacagtgtgcctagtcctggggtatggcaaggtgcagatatgtccggaacctaagggaaagaaactcatacaacaaaatctccctgctactaagggagctgcatcctccaaggtctgtcattacatggggcccgtgtagagacgtggttatgatcacggcttcaggcttggctttgggctctgccattttctcagtgaacagtgacttagcttctcaaaccctctgttccgccttctgtaaaatgagggtgagaaaagctgcccgggtggttgtgatgctctaagttgttcactcgtcgcatggacatgtatcaagacatcctgtatgcccggcactatcctaggccctggggcagagcaagtggacaaaacagactctggtgcctgccctcacagagcgtgcattcatcagggagatgagccgctgatacaccagcataggcacgcacgcacacacgtgcacacatgtgtgcacacatctgatacaatgataaggggtggctgctgctgcaaagaggaaaatgaaggactctagaggaagaggagccatttccagtacctctggggaggtgacatgggatcagagccctgagagaatgttggagagccctggaagccctggggcgggaccccctggggcattggaggccttcgtggctggagcagagaggcctgggagggtagagggcagagcatgtgggcaaggatttgggtgttatttccatttcagagggaggtcactgcgggggagctctgagcaggagtgaggtggcctggtttgcacattaggaagctcagtctggctgctgagtgctggcttagggacagtcaacacctagagcaatcagcagggtgcccgccacatggaagggtccagtcagcgctggctcccgttgttctgttatttccagatgtgatctgtctatggcagccagccctcggagtcattccaggtggcaggcagccccctccccagtgacgagggcctggtagaaagacaggtctgctgagctccttccccaggagctctgagtgggcgcttctcccttccccactctgctgtcaccaagagagcaaatggttcctcacccacctgggccggggatggatccgcacagaggacagaggggtgttttgtgtagagtagtcagagaaggcctttcccataagtgtagaaatgattttctaagcagccataaaaaaagaacaaagtcatgtcctaggtaccagcatggatgcagctggaggccattgtcctcagggaattaatgcagaaacagagcgccaaacactgagcattctcatttataagagggagctacacattgggtacacacggacacaaagatgggaacagaagacgctggggagttcacagtgggggtagaagggagacgggttgaaaacctgcctttcaggtactatgctcagtacctgggtgacaggctcattagaaatctgtaccccagcattagtcacacagtatggccatgtaaccaacctgcacatgtgccccaaatctaaaaatatacattttctagatatttggggcagattattagcttgggatggccaagggccggagaggtggggcagaggacaatggttcctctcaccaggatcagccactcggaactgagccaacactgaattaatattgtacatcactgagaagctaaccttgacggaaatagctccgtgtttcttggagttacaacacttgctgtatcgaagacgctatctgtgcctgcgtgaatggaatttcagaggagatgcttttttgggctctgggtttccagatgtgttaaggatctccaaagacctcctctctgtcctgatacataggagggcccatccctcacagcccagacctcacaccctttaatcgtcccaacgcaaaattcactagcgatgtcttcttttttactttacggatctgtctgcttgctgtcaacaaccacatagaatcaccagggacaccaatatagacctgtgaaggggccgtactgatcaggttaaggaatagtaatggctcatttctacctcacgcgaggctgcacaggcccgggtctgggaagccagggctctggtttttgttctgttagagacagtctgggagggctctggggcgtgggttcgtcccaaggaaaagctggggtttgagatgcccccactggtgaggctgagttgcatctgaggcctcggctggccccagagacccagtttggactttctgggctccatcatttggctcctggtctctcctgccagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaaggtagggctgagtttgggggccacggaggaggaggatctgattgggagagattgtgggagcactgggagggggtaggattccagaagttggtcttgagccacctgcgaggagggggtccatgcaggctggggaggcagacttggccgcctggggttacacctgcatccgagagttcctggggttcccaccagtgctgggcatttgttctcgtgggcttgacgcctgtcctctgccctgctgtgtcagaatgaagaggtgttgaagagatgtgcgcaggagtacctgtcccgggtgaagaaggaggagcagaggtaccaggccctgaaggtgcacgcggaggagaaactggacaggtaacatttagccactgggggtggctcccaggggcctcccagcagcccttttacccaggcaggctgggacctctggcagcgcctgtgacattggcttggaaagggggcatcatccaagtgtgtgtttcaataagactcgagagaaggcacacagttagcatcatttaatcagtggaggatgcgtgttgcaatgtccagggtgccccggcaccttggtctcatggcaatggaattgggtttggtgttctcatgggcccctgtgctccagctccagttggtggcagctgtggccagaccaggccactctccctgcctggacctgggaagcaggaggtgtctctagtgatccacaaaagagtgataattctgagctccctgtctccgcagggccaatgctgagattgctcaggttcgaggcaaggcccagcaggagcaagccgcccaccaggccagcctgcggaaggagcagctgcgagtggacgccctggaaaggacgctggagcagaaggtaataggggaggggtgtggcctccaggtgggccgggctgctgctctctgtgctgctggccagtccagctagacaggctgggcttccctggccactgctgctcctgaagacgaattcatgcttcatgagcatacccttggttccttctagaagttccaatttcatgccagccctaagaccagcttcctttccaccgttcctggaactgcagcctgcatgtgtgtttactgccattttcattccttttcaacattcgtttatttgttggatatttattaagtgcctacaatgtgttaggcgtagcccttgaacctctgcatccggcatgcttactgggtgagtggatggggtgcccaccaggccctggcagtggtggccagctgatgcagaacatgagcagtgtcagggctggaagggcgcccaggtggcctctaattccagggacaggggtgatcttcccgaggacactgagcttgtgcgcaggtttcctccttttggatctggcacccctccatccactgtgagcactgtctccctgggtgtccagataagaagctccctcagcccaggagggccctctgagcgttgggctgttgagactgcgtgtgtgtgagtgagggccagcctccctccttggatgtgtttctcaaggagaggatttccagatgtgcagcctccttccagtcaatttcctgagccttggggttcccctgcgtagtcatccacgagcccagcagcctgggttggcagcacaatttttgcattttgggccttgataggcagtgatggggcatcctttgttggcatcagaaatccatgtgcctcccgagtggcctctactaccgcaggagcacccagccagccccaggggattggccgtcctcctttgcccactgtggttggtggtggtctctaggggcatttgggccaagcagtggtgatctctgccctgggcaggtgccagtcctcactccacctaagtaatgttggggaaggagccctggggagcaagaaatggggctcctgtccccactgcaccatctgtcatggccctgggcaagcctcgcaccccacctcagtgtctaggttccatctagccctgaaaattagaagcctgtatcgttgggcagatggatttccctgaggtccatatctgatactcacccagtctccactaggccctgtgccctattggatgttcctggttatccagaatttattcatattacagatcattattttcattctttttttttttttttttttttttttgaggcagggtcttattctgttgcccaggctggagtgcagtggtgcagtcatggctcactgcagcctcaaccacctgggctcaagtgatcctcctgcctcagcctcctgagtagctgagaccacaggcatgtgccccctaccaggctaatttttttaatttttgttttcgtagagatggggtctcactttgttgcccaggctggtcttaaacttctgggctcaagcagtcctcctgtctcagcctcccaaagtgctgggattataggtgtgacattaatttaattttttacctttcttcttaggatgaaaaagacagatggctactagacagttttaatatcaaaattgcattagaaaatagtttggaatatgcatatgttcaactacctgttttgtaggctctgatgattgttcttagcagtatcctcagaacgacatatgcggtcacaactgtcaagtgcaagtttttgctcactcacccagtatttattgagcatcattatggttttagtgttgagtgtgcattttctattccttgtctcttgataatctatgtatggcatatttggtgacttgaaaaatggaatgtttcattaaaataaagatcatactagaagccaggcatgttggcatgcgactgtggtcccagctattcgggaggctaaggtgggaggactgctggagcccagaagttcgaggctgtagtgcactgtgattgtgcctgtaagtagccagctgcattgcagcctgggcaacacagcaagaccccgtctctaaaataaagaaataaaaaccatacttcacagtcattttggctattgtagcagttgaacatacaatgtttcttggtgagaaatgtagcaatgtgtgtgtttgagatggttcccccatttccatcagggtttgatggtgtttaaattgcattatcttaaactgaacttccagaggaatgaacaaatcacacaggttcttccctgaaagacctgagtgatatctaggggatagtcccatcttaaagagattcagaaacatgattcacccagacaattcttgaatggaggcgctgggcatttcgcccaatcagcgctctgtaaaggcttttgctccatgagctgagctttatgatgaggcagtttgcttagtggtggctgatgacgccaagagagagcttggaaaacctccgggaatcactttctaacgggtctgctgatgcctcttagccatcagtcactgtacataacgttgtttaacagttataatggcaaagccatataggagctggggcaacctgaatttgtgttccaggcttgccacatctgactggctgtgtgaccttatacacaacccttaacttctctgagcctccatttcctcactgaaaaatgaggataatactggcttccttgaaggcactattgagggaaccaggggaggccagagtgcctgggatgtcttcagcatggtgagcagctcacggtgggcactccaataagatggaagatcaccgttagcagccccagcaggggccatagtggcaatgagagttttttttttctttcttttttttttttgagatgaagtctgtctctgttgcccaggctggagtgcagtggcgcaatctcggctcattgcaacctccgcctcccaggttcaagcgattctcctgcctcagcttccctagtagctgggattacaggtgtgtgccaccacgcccagctaatttttttgtatttttagtagtgacagggtttcaccgtgttggccaggctggtcttgaactcctgacctctggtgatccacccgcctcggcctcccaaagtgctgggattgcaggcgtgagccaccacgcccggccaataatagtaattttaagattagtggtcagtgctgtatcccattcagagccccatcgtccagctggcatttcagtgcctctctcgagttgttgacctcagatgcaaatttgagccaggaggtgggccagggttctgtttgaggcaggcttctcccacagtggggactgctgctgggaaggactggaacttcccctccactgaggagagccacttcctcccagcactgacacaatgatgaatgacaccaggagttctaacctagaaacagagggcacgtggctctgggctggaacatgtctcaggagttctgaggttttcagggaagggctctgcacagcctcagggacaggcttttggtgaagactgatcttccatgggaatctcaaggaaaagctggctgcaaaacatccccagtatgctggagggatccagcccccttggagaaggccattggagatcggtcgtgctgttgaacttgatcagcatcagagccagcatgtaacctatctgaaagcaaagccacacgtccatgatggagggatcgtcccgctggatcccctcactttctgagaagatggacagtgtaggatcatctgtgctagacaaacctgtggttggttccccttgattagacaggcaaggtgtggtgggagaatcaccttaaagccagctcgcatctgccccccaccccccatgaccctgtagccacagcatcacctatttggcatccctctgagcaatgccagtgatcccattcacgtagaactgcgtaaccctccttatgctacatctcaaaaaagccaccgaggggtttaccccagacgctcctcacctcagatcacatccttcccgggcaaataaagggaaaggaaccagactagttagtccttcactctgtgctggtcactgccaggaaactacatttatcacctcatttacttctcagaaagaaacatgttatcacctatgttctagagataaggacaccaaggctcagagaggttgtgtaacttgtggaagatcacacagctacagctgggatatatactcagattgtttggctccaagtcatttgtctcactgctttagtggggaccaaggggcctggtggtcccccatctccccaaaaagccccatgagcattctgactggccagatttcaaacatcagcaacttcttccttgtcttcacttgcagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataagtgtgcctcgaatttattttctgggaagggttgagtcttttctcacctttgtcaaataccagatttggcttcgtgctcttctctgtctgggctcatttctttgtccatagacttaaataatatttcctttgttatcgtggctgcatttgtaggatgaagctaatgagaaatactgactttctacttaaataattaagtggaaattaattaatctcagcactggattagctgagatttggtttttacaaagcctcatgactttaggaagcaaatctatttcattttattgagtcaaggaagtaacagactgccactctttctgttcaatcctttagtgtttgaaggtcaacctgaaacccccattcccctctaaagaaagcactgggaaagggtgcacaattgccagtggccggcaggtaattagggcactttggagattaaactagcagtgtgcctggcctgagatcgcttcattgctgccgacttgctcagggttcccaggttgaagggtgggtggatgaggggagtcgggggtggaaaggtgtgatcatttcctagggctgccattaacaaatcactgcaaacatctgcagcttcaaacagcaaaatttattctcagttctggaaggccgaatccaaaatcaaagtatcagtggggttagttcccccaagaggctctgtgggagtctgtcccatgcctcttccagcaactggtagctgctggctctccttggcgtcccttggcgtgtagcctcagcaccccagtctctgcctctgtcttcacgtgaccttctcactgcgtttgagatttccctcctttcttataagaacaccagcattggatttaggccctcccccatcaaggatgatcttagctcgagatcctcagttacatctgcaaagaccctgtttccaaataaggtcgcattcacaggtaggaaggattaggatgtagtcatatctttttgggtacatgtgtgtcaatgggatgtgtggtatgggctgtaaacttggaaggcagatgagagcccctgatggcccagagcttgactgtccctctttctgcctcggcacggtggctacgggcaactcctctcacagtaggacaacccccacccataacaggacaggccttaggcagcctcagcttttcggggacagggtggggtgttttctgtgatttataaggtggatgaatttcggctgtgccagacagctccaaggagagaggactgcacatgtgctgttggcctggcagcctgctccgggttggggggcgggggggcaggatgcgcggcgtcttttatgctctgagatcctttgttttctttctgctacactttcgaaatccatccagcagagcctgcctctggtgccactgagaccctcacctgccaggcaccctaagccagggtagggaactgcctccttcccactgccagcatcctttgcttggtccagcctcctggtcacagcatgttccagggcccagccatgaccccttacccaggtgctcgcttctcaaggccaaatccctgctctgccctcgctctggattctgacctcgactgcattctcagaaatgcccagcttgcatctcttggaaacttctttctcattaagtaaaacatttccattgtgaaaaaattagaaaacaggtaagaaaaaaagcttataacccccaaactaagaaactgttaatgtttgtctgtatgtttaatggcctttttctccatctgtaaaatatgttatttgttatttgtatttttaaaagtgccacccgtaccaccctgtgcagccacctgtggtggtcctgcatacagttttggagacttttttcacctgatactataatgtgaccatcatgttatggtaaactttttatatcaataaatatagcccttcatcattttgaacgctgcataacattccatgcaccaaaatgtgtttaaccaaccctcaccccggtactgatgagcgtttatattgtgtc

SEQ ID NO: 12649 - DNA, 23538 bp, Human
catatctagtcctgcttacattactaagtggtaggaaattttaggtaacacctcagactttaaagtggcctactgagctggtagaaaagtgtgtagttggtgctcagtaattgttgaaaagatagaagctttacttcaaagctcttgtagtttgatcagtttggaaaaaatattttaatgttgggctctgttaacagctggactggtggctgtctgaattgggaccatgcttggggtgaggtttttttcttacttttttttttttttttggtgagacggagtcttgctctgtcgcccaggctggagtacagtggtgcaatctcggcccactgcagcctctgcctcctgggttcaagcgattctcctgcctcagttttctgagtagctgggactacaagcatgtgccaccacgcctggctaatttttttctatttttagcagagacggggtttcaccattttagtcaggatggtcttgatctcctgaacttgtgatccatccacctcagcctcccaaagtgctgggattacaggcgtgagccaccgcatctggccacatatttttttaaattaaatgtgatacataaaattaggctgcaggcatggcctgatttgcaggtgcttcatgagcaagcgtgcacagcatttatttgctgctcctggagtctctcgtgtgtgcttgtagcctagccttaagccctctgtggacggcttggaatgcgtactccaaatgactcttttggcggggtgggaagtggcaatactttaggtgactgacagttgaaattaaccttacacaagagccaaactgtaggctgatgcagggccactcacctttggactcacccctggcaggtcctgtaagaggtgctacttgcttccactttgccagctgttcgttggccctgttttgtcttctgctgtttgccttatttatgaaacagaatggaaacaggcgagtttgatttcttataattcctaggagtcatagaatggaagcaggtgagtttgatttgttataattcctaggattggataatttgccttcccctctctccatctttaattaatcccttaaaggaaaagaggacgacagcacttttcctgcagtcatctgtgtaggcctcagccttaactcatgacataggctggtgccactggccacagggctgacctcagctcttggagcccatggggtgacaggagatcagcacctttgaggtggcggcgtgaggcgtcttccaggccttgctcatggtgcttgaaaacactgctttagagctttgttaagagagagaggccctacttactcctgtcccacaggcatttgggtgttgacctccttgttggcctcttaaggagagaatacttgagtattgaattcgatcagcttttctgcctccagggaccctgtttctctctgctgagactgtggcggatgaaaccaggatttagtggatggtcaccaggtagcttgggcagacctgggccgcggggcccctgaggactcatacgtctttttcctgttcacatgttccttccccacaccttggcccattctcagtccctcccatgctccttagcgtgaggcactcagggaggtgcccatggggccttggggcctgtgctggagctggttcccagcctcagaagtgtgcctaactgtgccacattcattggaaagctgctttcacacttcctggatggaattctctcattttttcaatataaagtcactgagatgatttttttggagaagtctttaaaggccagttatacatttattgatacttggtattgacaaagttcagttgtttagtgttgctaagtcatactgtgtaagtttgttgagcacagagttttcattttatactttcagaggagaaatgaaactgaatttcgtggccagaaatatgtttgagcgtcatcctgatgtaagaacagaacagaaagtgtgatgacatttcattgtaactctagtatgttttcttttttgtccattagactacatgaggaaataattgacttttataacttcatgtccccttgtcctgaagaagcagctatgagaagagaggtggtgaaacggatcgaaactgtggtgaaagacctttggccgacggctgatgtgagtatgttctttggagttctgtgtcgcacgtcacgtgcgagtaaatttaaataccctgtgatgatgatgtgtcggctagatccacacagaccttttctcgttggcccgaggcagcagttctccaagtgtgctttgagaaggcctccgttgcctggaatgcatggcccccggcgcacctgcacctgctgtcttagacacctgcggtggccgcacatcttcgtgatgctggcgcgcactcaagtgcgaagaccatcggctgagggatttgttgggtttttttttttttttttttggaagggggagaatggtgtgattgtttctcttaagttcaccttaaaatttagaaatttcaccctgtcacccacccctgcttccccaccaccacacatagtagcatataatgtgctcatttttgtaaaacttggaagtgttccctcatcacacaccactcttgcagtgaaggaacaagtgttttttgacatgtggagtggggccttctggaatgcttggtgcaggtggcgtgaagcctgcccctggccggctctattcagcagccttccctactgctgactgggctcagtggaccagcagggctggccgtgccccagctgtgaggggcatgtgtgctcttggtgggcaagggcaacccagttttctgcgcctcttttaaaatgatacagatttttggctttaaacttcagagtcctaggacaaagccctgccccagtgccttagctgtgggtttaagaagaggttgaagggtttgaagctagctctgaaaagtcctcagctttgaagggttatagggtgaggacaaaacttgtttcacctcttaattttgagtttttaaacattccttttttgggcatgtctttaacttaaagggaattttctggttgattgttatacggtcccctccatcagtttccaaggtagttttattttttacccaagggtatagtgagggctttcttttagtaagaaataatggtagtgtgactgcttggtttgtggtatacattttaaggcaaccactctttctttcaggtacagatatttggcagctttagtacaggtctttatcttccaactaggtgagtaccagactgcatggcatgggctagtggggggctgggatggtgtctatgcaatattaagggctacaaatagattctttgtaattgagtctaaggcgagaaatgccagctaaaggaaaagactgtggttacagagggaaattggcagaaagatttaatttagtgttatgatgaattcattgctttgcattttgcctctcacacttaatttgttggggtgcaaaaatgcttcatgctggaaatatgaagaagacaggtgggaggactgtgggaagtaaacgcaatagaagacattctgctgatattttaggacatgtgtttgaaaaattgatcttatgttttgatgaagattcaagcaaaattctctttaaatagtattttctaagtatttttacctgataggaaaatgtcaaacaagtttgcattctaaaatacaaactagtattttctcattaaggattcttgatagccaaataaatttcctgtgcactgtctcattaaaagcttaccttctattaacccactgctagttagcatttggaggccgaagaggctataatctcaggatttgggggttgacattagcagggccagtgggtaattgaacaggtttgggtatccaggaatctctgggtccgcaggagtgatccagcgtaggcagtgccggagtaggtgctgggagagcggggcctcagcctggtttgggggcaggcattttcatctgaatcccctcacatacctagtgctgttgggagaatgatttaaccttcttgctttccatcttatgctacaaatatggaagtcttcccttaagttcagcgaggacttgctgtagttcatgaactgcacttcacctccttaggggccataggctagtgggattgtgtcttggcctttgtgggagacacaggcacatgtgccttggtgcttatcctccccacacgaatgtgtaggctgtggcgaggggagcagtggctgacgtgcgttttcttctgtcagcgacatagacctggtggtcttcgggaaatgggagcgtcctcctttacagctgctggagcaagccctgcggaagcacaacgtggctgagccgtgttccatcaaagtccttgacaaggctacggtgagtgcctggctttggcccctctgaccgggcaggagccttgtcacatcccaggtggtcacaggatacgcctgcgtcacgagcttgtggtattttacacagttattggctacagttttgaagattaatctgcttctggtatagacatgtgttttatgtttttgtttcatagtcgtgatcaccaactgagaacatgtttagtgacagtctgaacttttgggacttgtgagcccattaaactgttcttggaatgaaaatatatgattgtgtctacttgtgttaggatgaataggaaaggagagtcatctgaaaccggacactgacattcaggtgctgcccattatggagagtgtggctcaatgattaaaccatggtttttatgattaccatttgctatgttatgttaaagaggaacaacttagctgttcctttcgtggttccaaaaaatatacatatatgaaaagcctcttatctttgggggaagtttgaagatgagactgtttctggtgtgtacttgctaaggtttatgtcagttcaagattataagccccccagggactatgaggtacttgcctgttgtatgacagttcttagctcacctgtgcgaccggctagcatttcatttttaaatttgtgtgtcaacttgtgtgtgattcacatccttatagtgtttagcagaatgtaagttaaggcaggagcttcctcctgcctgtgtggtgataggggagggggcattcacatgtttctcattgtcaggtgcttttgattgaggctgggggcaagttttaaaacatgatatatgcactgaaaagtgcacatgtaccaggtgcacctcttggtgagagttaacgaagtgcacatgctcatgtcactgtcatgtggaccagagcgagcaggcagcaccagaggttccctccaggcccaggttccagaaggggctgttggctcttctcattagcacgagacaagccctggccggccactttctcaaatgcttacgggccttattgcacttagctctcccagccactctcatcagcagatgctgttgctgttcacattttacaggtgaggaaactgagatgcggagaggtgaggtcattagcccaaggtgggtcagcggcatagtccaggccgctgttgtctgctgctcctctgtgtgtgccaaggggcagcggggaggtgggtgggaatcctgaccaggcgaccacctttggagtagaggaactaaggcgcggctgtcctgaggccacacagtaggttgagcagttacagtaactgcttagtcccagtgacctcgttactgtcgcatattggctactaagtatcttttcctctgttacctgagggccagtgtagactgtagggagagcctggagcctgccactgctcatttctggggagcactgtgcagccggccagtcatgggcacaagagacccagggcgagggctgagtttaaggtgaaatcttgtctatttggaacaacaacccaaaactgtgttacagtgttaactcctcacctccaggatttggggttcctgccgtgagtgagtgtgtgcaagagtagggcaggagagtgccaggagtgattgtgggaaggagtctatgagatggaaaggaagctgcttcctaaactgtgggtgtcagggaggcatagccattgagtgttggcttcttccaaagcagtttctgatgagttctttgggaaagtatttctttctctgccttcttaagaacatactggcctcagggcttaccctgcctggtggtcgcagtggtgtccaggtgactctggccccactggcatgtcctcacacgctgagtccttggttggttgccctcaagtgtagacattaaagcccagaataggtgtgtactgaatgcactgtccctacgttgcctatcactggcatttgaacttttcgttagacactgattgttttggttaaaggaattcctttttttaatccttcaaggctgaaggaaacaaaacattgccttttcttctggaagaattcagttttactggtggggtggagggtggggcatgagtgtggtctggacagttgctcaggcagattttgaatgccattcggtgacagttcttgttggtgagaatatttctaaaatagccttttatttgctgaattttttaggggaaaaatttttttagtaaagttgtcttaaagagtgaaaacccgaagtagagaaacaatatcagtataacatacaatttaaaaaatggcttcgaagttacattaaatgatttcaaaaattctgccaaataaaagtctggggccaagcacctctctccatcccagcacatagggtgggcgtggcagagactaactcctgttccctgttggctccctcccctcacgtctctttgatgcttggtcacctctggtgctgatccagggctacaggggctgggcagaatgtgggtcctgctgtgaggggctggggcctgggagtcgtcctgggttcagggactactgatgctgacagtgttctctgaccccctttcattactaagaaaaaacaccaaacctctgtacagctttggcagcattttgatgcctggctgtggagagtcctgcatgttaaagcagtttttaaaatgaaatctttacaggtaccaataataaagctcacagatcaggagactgaagtgaaagttgacatcagctttaacatggagacgggcgtccgggcagcggagttcatcaagaattacatgaaggtactgtgcttggtgacccagcgcggcgagagtgcaggactggagtgcttgtgcttggtggcatcctacgatgtttacagctgtcagctgcacacacaagtctttcgtaacacagactacacttacattatttctcctacaatattatttctagagatactttgaaattacatagctgtttttaaaatttgcttttcctgagtaaccattttataaagttgacaattattttagagagctttgttaaaatgttctttctagttattacagactttgcttctagctcagtgtgcctcattcgcaggttttacccaggtggaagttgataaatcatgaggtgccttaaatatactcactttgggaggtctcagtgcctgaggatgggcagagagacttggttgagctgacatgtttgggactctgaccatgtgcctggtcttaaacgggtggtcatgacctcctgttacagtagaggccgtgcagtccttagcaggggcagacgcacctccgggtggtcgtgacctcctgttgcagtagaggctgttgcaatccttagcaggggcaaatccacccctgcaatctggtcccatcttgttccattttcaagggccttgctcttcaggttcccccttcccccttgtcatctggtctgagggagcatgtccacccccagcgcaacacgaacagcagcagccaggctttccctccctcccgccatctcctgccgctctgccttccttgccagcctcactctgctctcctgctccggaggcccccactgtcctcatggcctgtgtagcaagcacataaacactccagtgaacgcgctggtctcttcctgagttcctttgtgcctgtggactcgtcatggtaggggtgcacccctgctgagtcgtaacccagggagagctccacagtctcgattttcacaagcccctcaggaaattaattcttagcgtcccccaaccaaagtttgagacttaatgactgagagccttcagatgggcaagaggatcgaggaaactttcctttctgtcttgtgtgatttgctatgtgaaatctctttgaaagtatggtaattactcagtaaatctttttcttttggaatttacagaaatattcattgctgccttacttgattttagtattgaaacagttccttctgcagagggacctgaatgaagtttttacaggtggaattagctcatacagcctaattttaatggccattagctttctacaggtatgtatgctttcttgagactgtttctgttgagacatgtgtaagagtagactcttccaaccagttgcctagtgggttccagcagcctttgctctccttttactgtattgtttcaatttggtagaggctgatttctgattcttacaatcaaaccctcttgattaatgcacctttctggatgctcattttgtactgggtgtaactgttggtgcaggggtgcccatctggttctgtgagtccagtgcacatcagtccaagctcagggaattctctgtattcagaaatgtccatttcatggtaaacaataaacatttcttggtgcttgtctgtgatttatattgaaaaaaatttgtctcagaataaagttgagtaccacatatgagaaaaggatttacaagagagctttctcagactgatgaaacatcattattttgtcttaaattatatgtggtccttattttgctgagtaacatggaaaatctatcaatagaaaacctacgtgttttaaaaagtattgttaaatgctgtgatgtattgataaactgtaattatactttttaaacatataaaatcatctctaattggaacagtaattattccgtttatattttcttgagtgaagaattctgtcctttacaaaatcttgcctatataatttagccgcacggctgtatttctccagtgtttaccattaatttggtctttgtgattgtgctgagattaccgaatctgtccatgatttggtaatgttctcactgtcatgaatgctatgatagtagaatcactgggtaactacctgtgatgatcgcagcttccttggtctgtctctgccaagatgctttaaaagtagtgaaaatggaattccatgtctgttttcttacagttctagtcacactgtcctgtcttcactttcccctctgagatgtggcccttatatatagcctttcttccatagtttttggacattattttgaattaaacatgggcctctgttctttactgatatactcctgacttgcactattttcatggccttgtagtaacaacagctacttaatactttgatcatgcatgtgccatgtgccaggcctgggtccagggcctcctccaccccctcagggggtcctttcagtgatcctgtgaccccacaggaggccaccacagcatgagtgggattcctgtgttcactgccacatccctgtgccttgtccagtgcccagagcttgtcctgcctcagcggtgtgactgtggcagcatctgagtttcttgactaagtgaggggaggaggcccaccctggcaccggccaggctcttggatatgtgattttggctaaaagacaaggaataaggaagggaataaaggtcaggccagaatcggaatcctcctcttgtgtggtggaaatatgcagagaactccggaattcttctgaaccctaaaaacatttgtatgctttctagctgcagctcctcctggcactctgtgttataaatagtttcaagcaccgtgcttctctgagggctttctctcatgtgccctcgtccatccctttcgagttggcactgtccgatagaattctgtgatggtgatggccacttctgcatggtccggcaaggggctgggcgccacatgtggctactgagtattgcagtgtggctggtgagagcaacaagctggatttttaattaatttgttttaattcatttaaatagacatgtgggcaatgcaggtctggacagctgagaattatgaccctcaggaggtgtggtggacagtggtttacttccgaacaagcccagtgcctgcttttgaagacgatatggcactgaactgagagtggtgctcatctgtgtgacaagcaggatggaagcttgctataaatattgtgatataatgctaatgacctttacacagctaaaatcagtcctttcacttttccggttttatgtgatactgccatactagtcagtctaacactgacccctgttggttgtgcttcagcataacgaaattaggatgacgagaatctgaaattacatctaccatccaggtgactaagttatgcagaatatagtccaacttatttgcccatatttggttaatcagatatctgtgtttgcaggaagtttgctgtatggattaccaatttcaaaaatcaaactacactaaaattcagatgagtccgttgtgttccttttgaacactcctcgttgaagaggctgctgttcaggcttcctcgtggtgctggtgagtgagcgagtgccactcactggtattgccttgaagaggctgctggacagcagacttcgtcgcgtgctattttctttagaacatgccatgaatccatacaaattgtgggtgcattgcttttacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccaggtaagggcgccctgatctccactgctgagagctgggccagcctcggggacgtgctggtgacagggcctgtgttggggctctgagagccccgggcagttcatttgctcttgatgcaggtttctcttatactaaccagttaataatcacactttgagaaatccttatttaatgcttctaattaacttttgtctttctaactgtttacattctataataaagaagaattaaggaaaatcttttctttttctgattattgaagtataacatatccaccctaaaccatttgtttctctgaagtatgtaatatagaaaaaccatggatgccataatccccttttatttggacatgtatttctccactttttccctatatggatattaatgtttattattgttatcttgttgaacacatcccacaacgcaaacacgtttgtcacttggcttttgacttaacgcttacccttgaccctttcctatgtgtgtaggttgtgttttgtcgtgaggattgccgcattgaagagtctaaggctgggctagaggtttcccggttttattcccattggcgtattcaggggtatttatgtcctcattcctttggtgacagtcttttaaaatctttgccaatctgataaaaccatgtgttaacgcttttaaatttatatttctttaatgattagtggggttaaacacattgctatttatgaattccacaaattttgattgagcgtctgttaggtgagataccattcttactgttggtgataaaatcgttggcggacgggtgacagaacaggtggtggagagcccagctccaggcgcgtgtccctgggccttctcctctgtgtggctctgtgtgctgtccgcccggttgctggctgccctcctctgctgtgtgcaaggcctgtgtgtgtcagggaagcctttcttgtcacacatgtcatactttttccaatttgttttttgcatttgtatttttttattcagctcctatacatttaaaaaaacacctcagatttaatggttgtttttgttttatggcttctgggatgtgagctttatttatttcctaaagatcgtctcaaggaaaacacattggctgatgtgttttgttgttgtttatagatggcatgatttgtgcaggctcttgagtggttttcttggtagcacggtatggcagtgtatcatccatttttgtccgttggatgagtcacattggagacattggcattgtcttcaagtgtctgctgaaatgtactcaaaaaacaaagacccacataatcgttgagttataatataaatctagaaaagataaaactccagtacttagaacatatatcctttaaaagaaatccacacttaacctgattgtgaagaatgagttgtttgtagattaaaattcgaaacagtgcatttcttatgaaaattaagcttctcctgactggcttccttggtgactgctgtgacagattcctttgatttgctgtcccagttttccacacgtgagaattcacattccattctaaaggatttacttcctgtaggttccattagcgttgactgagttgtgatgcacttggggtgagctgcccttctacctgccctgttggggcactgtgaggcctcctgattgtcagatcagcgatcacagtgggtcggtgctgctggtctgcacaatggtagtctttggcttcctcatgtttctgccacctggagaggtggctttttgtgggctgtcactccgtctgtgaatggcagccgcctccgtgaggtgggccatgagcacaggggcactgatgatgcagaccagtcctctcggcactcacagactgtgccctgtgcatggtgattgacagggcctttgccagtgccaagtgccacccgtgcccattgtgttcgcctgtctgggctttgctggtagggtctggaagagtttcagtggtgagggcctgcttcagagtcacttgtatgagaagatccgaaacatgtggacgatggtgtgcatgtggggagggtctgacatagcctttttgctgcagggaatgacgttggccggagctcctatggcgccatgcaggtgaagcaggtcttcgattatgcctacatagtgctcagccatgccgtgtcaccgctggccaggtcctatccaaacagagacgccgaaaggtaatgggttgtgtgtctgcgtctgggctcagcgtgcctgtgggatggtacttatccctttcctgtgtcatttacctccatgaaatttatgaagggatgttctgccgtatttcagtagaatctagatatgttggtgaaggaaggccttctaggaatatgggatggctgtgtgggattcatccatggttgagagttgaaaatttctttcttggagatttgacattttcttcagggtcttttgttttggggaggtgatttctggcttttaaaattcagtccctaccatcttctcttatgtacactcgtcccttgttctacattttggggcatttttacagtcccaaaatgtagtcagaagtatttacttctcacccagatcatgctgtggtagtggaaagggtggtatttgaaggggtgggagatgagataggaatgggaaggaagagtaacgtggtcgtcaagagtggaattcgaaacagtttgatagatctgttctgtggtggatgatggaataaacaggtttcgaggcctggctcagcagccgctgcaggtgctggtggtgctggagctctgtgtgttcctgagccgctgtctgctcggtgttttcaggcggagctctgggccccatgtagggcactcgtctcggtaccgtctccattctcgtccgtgcagtgggaagtgaaatgtcagcactgtatgatcatcgtgggtgggaaggccccgctcccctacttggagctgcatttcacagtggtcttctgtaggtagatgtactgcgatcccagggtatgcttgagctgaatcattaaaagtcagagatatttgtcaacgtattttagctcctttcctactgtccttcacctagcgagatgatctgttaggggtataaggtagctgttcgagaggggttctcagctccctgacacctgttgtactctgttgatctccaacaatgtccctttgcagtactttaggaagaatcatcaaagtaactcaggaggtgattgactaccggaggtggatcaaagagaagtggggcagcaaagcccacccgtcgccaggcatgggtgagagattaattcatttgtgttcatcctaaccactggctggcatgttcatgcagaagtgtctctattcctttgtggtaaattggtcaaattaagaaaatagctagtttttctgatgagcattaattaagaagacaataagatctagagcagcactgtccagtagaagcaatataatgcatgccacacatagaatttcaaagtttctaggctgtgtcaaatgtgaaaagaaacaggtgaaataattttgatagattttattccactcaagtcaaaatattaacatttcaacatgtaatcaacataaaaataattaagatattttatagctgtttcttgtactgtctgaaatccggtgtgtatttattcgtacttatagtacatcctaattaggatgctaaattttcgtaaaaaatacttgatctatatttagattttagaaagttcacagttgaagatgatttgcatacccaagttattacaaacatgtttaatgttttccaacaactaattgaatgtaatttttaaaattaaattaggcaaaacctaatgttgggtttgttagtcacattagcagcgttcccggctcagcagagcccgtgactgatgctgccggggcggctccacgccgcagttctcaggagttattaaccaaggctttttccctccacagacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgtaagtgccctcccctcctccgtgtgtctgttggacagtttgtgtctctggtaaatgtccatagccgcgagcttaaaatctcccccttggttttgctcaggttttgtttccttgtatgtgtgtggaggtgggtggggggcagccccgtgatgtgggcaccaggcttcctttcccctgccgtgaaccttcagaacctgtctgtgcgactcatgcggctgtcgagggcagtaatcctctaaatggttgaactacagtggacttccttgagtagtttttaaaaatttatttgaagattaaaaaaaaaattaaatccaagtatctcttctgtatttcctttaacattctttttcagttgtgatgaaattacttgaaggaagcctgggtaggtttgggctgcctgttcagaagttagacttaatttgaataacctttcatagccagcctggatgcaggcgtttcttttcatagctttaaggaagtagtagtgcacctttgtggtacagctgtcctttttgttttttgtaccgggttcaaggattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcaggtacgtggccctctggcacccttcccgctggtggcccctgggaacagcatccgagctgtgatatgcactagaggagattgatggtcctttgaattagaagagtaactttttgagtctttggccattggtgtgttgttctaggaaatcctctcttttttgtggtgttgaggtcccccatgtatagtttcagcagcgaggacactgtggttcttgagtgctgccgtggcttttcacgggggccaggttgactgccttcctgcaagtttcctcactgccccagcatgagactgctgtcgagggtcatcttgagagagcgactcagtcacgacccacttagctgggcgccaagccgtgccagacacttgtccctacttcctctcagaatctcaatgaaagttttaatgtgaacttattagacttttttcatgtttgaaattaggcataatttctaaggctttttctgttggaatatactgtttttaaaatttagataaaattagaaatctaaaggataattttataaatactaaattttgtatctacttgcgattatacatcacttgaatatgtgtgggtataaaacccaacatgttaattgacttaaaaccattttctgaaatgtggggtataatttgagcataaagctatgtaggtacatgcaaaagtgttttgactcatttcttggagttttgcactctgctctggggaagacattctcacaggatccaccgtgattctggcggagcttctgggatgctggctctgtaatgacccacagagctgatgagcagagccatggcccagccggacaccgtaacgtgtctaattgcagcataagtgtaaaattcaggggcaattatttacactcttaaaatgaattataccacagataaacttggtcgcctttttatggtcatcacagtggccctgacgtcctggccatgtgtcacaaaggtgtttgttttaaccacccacaagccttggggcccttgagagcccagtgcggctgctgagctacagagccacactctgcggctgcttgtgtggttcgagtgtgaagtccagggacgctgagggtttataggtttttatctaagaagactcttggccacagtcaatctccagaggttgttggggtaaatgcacgggatgccaagatgcaaccaggtcagtattgcaagtctgagaaaaggggttctcgttagcgcacttctgctgctgacagtaacgggtgatgctgacatagaagcagcctgggacctggacagcaggcaaggaaggaactgccagccgtcccacggcctctcaggccaccagttgggccagccttgggctgtgacccctgagttcagcgtgtgagtagggggttcaccacgggggtgacggttgttcttctgatgactctaatgtcttgatcgtttgatcttcaatgagtttcaaactttatgacttggattactgggcatactttatatgccagttgctgttttagaatacgaagtatttccaattcaaagcacaatattgttaggtaatagtaaaacagactgctctatggagcccacatgcaactgtgccatttatcagctgccctttggtggtgctgagcttagaagccggatggttttcctctgattgctttggtacccatggccgtctctcattttgttcctagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataaggtatagctctgtcctggtgcattcacctacctgttcaagctgccatgtgagaggcggtgctaaatgttttctcctccagagagaattccagagagatcatttgaaaacggaatttgctttgttgtcattcagcctgtttgcttgtctttccaaacaaaacttaaaaaagttaaattattttaagatgtaatatatagtttaattggttgccacaaacatctcttaattcctctgttgaactgattagcataaaactgaagtttgaaataaggctcaaaatgaagacttttcccatttacataattcatttatatgctaaataccttggttttcaagaagcaaatgataaaaccaagagcagatcttgccatgatgtcccgtgtatgctgctgtcattcccacgttgcctgatccccgcctggggcaggagcaagcgtcagggctggcagagctgtgtgctgggcctcagcagggccctggcatgcgtgcccttgtggctcctctcaagtccagctgtgtgcatggaggaaacaggtcacgttaagtctctatattcttgaagtacctgaatgattgggagagccatggcgaggatcttccaggtcagcccccgtcgtgtgtgatgttccttgggctctgcggatgctcggtgctttcatcggtgtccacacctctttattccgctcctcctttgcttgtctaatcctattttgccagtaagttttttattcttgaggctttgttggccctgtgttgtatgatgattgtttttaggagttaagtaatagaacatttcctcttggatttatccatccccgatagacacattcagggtgaaagaacaacttcgcacaccggcctcttctttgcattttggctttgctttcccagtctcctcctgctgtttttcttgctctgagactttcctgaagccggcgtgtgttccctctcagtctgcttggccgcgactttgcagtgcagggaatgtgctttgggtgtagcccaagcacaggctgctgcatgctgggatcgacaggctgctgagggcgagagcgccaggtcctggcacgtgtgacttgcttggttctttctagaaggtcacagctgggggaagaacatgacagggaccttcttacttctgtttttttggagacagaatctcactccatcacccaggctggagtgcagtggtgtgatctcagctcactgcaacctccgcctcccgggttcaagcaattcttgtgcctcagcctcttgagtagctggaattacaggtgtgtgccaccacacccagccaatttttgtatttttagtagagacggggtttcaccatgttggtcaggctggtctcaagctcctgacctcaagtgacatgcctgcctcggcctcccaaagtggtggaattacaggtgcaagccattggcacctggctagggaccttcttatttctatggataagtggaacaagttagaagtgaggttctgctgaatttgtgtggtttgatcctggtacatggttcttgcctttagtcattcacggaatgggaagaatgcttttctctcagatggaggagttgggaagtcccagagggcaggtgtccatccctgctccctatgtaacatcacgtcggtgcttagtgtggtcactgcccgaggacgtgggcattgtgcctgctgtctggctccaacactgctgtctctctctttctccagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccagttttgtgtttgtgtccaagtgtatgctttcaagggcaagagtggcttctacattttccgtattgaatttctaaattagggcagtgctttagccatttattctaaataagattcaagagaaggcagatgattccagtcctataaagcaagttgcagcagggagattatgttgtcactggtccattgaagtaggaggaggtaaaaatacaaaaattagccgggtgtggtggctcacacctataatcctagctattcgggagggtgaggcgtgagaattgctcaaacccgggaggcagaggttgcagtgagctgagaccgtgctactgcactccagcctgagcaacagagcaagaccctgtctcaaaaacaaacaaaaaaaagtgggtggaggttctagactttgcataaggcctatgtaacagtaacagaaacctgtcctctgtcctcacattctgatgctaacaggaattcagtaaaactgtttaaatgattcttatatgaagtttctggcaagctgctatgtgatactatgtacttagaccgcccaggggcaacattttagtttcttcatttcttttaggtcagcattgcgtcacttgcaaacaagacattacaaaccaaacaatcataatgtggcttaaaatttaactgacgtttgggatttatttatttatttattttgagacagagtcttgctctgttgcccaggctggagtatagtggcacaatcttgtctcactgcaggctctgcctcccaggttcaagcgattctcctgcctcagcctgccgagtagctgggattagaggtacccaccccatgcccggctgatttttgtatttttagtagaggtggggtgtcaccatgtcggccaggctggtctcgaactcctgacttcaggtgatctgcccacctttgcctcccaaagtgctgggattacaggcgtgagccaccgtgccctgccgacgtttggaatttatgaggaaaggtacaagaattcttctaggccagtaagtgacagaactgcatgtcccagcctgtgcagccccttgagtgcatgttctagagccatcagctctagagtccttccggttgtcaaggtgggtgttgtgggtaaaacacacattccttccacctggagaacagagcagccctatcctcatggcacctggttcctaagagtgtgcagaagccgctgacagcaccatatggtggtgctggggggaagacgacaggcagctgagtgggactccaaagcctctccagggggcagagccctgtgcagcttctgcatgagctgcggtgggcagggtggggctggcaggagttgagcagggcctccgagggaactggagggcttacagctaggggcatctggaggaggaacccaggacagtgctgaggtgcagggcactggaggcaggagacgtggctgagttagcctctgtgttggaggcaggactgatgggtatccggggggaggcactcttgacctgccctggatttccctgtgagttgtgatgcttcctactcagctactgatacctgcaggagagctgcctttaggaggcttccaggagcagcctctggagcagctgtgttaccagggagcctgaggccccacagaggcacctgaggtgtcaaatgggtcccgctctcctcggaagctgggagtactggaaggtaagggctttctgagggcacagtgaacctgtccaggccactacgtgaacatcagcaagcccaccatgtagtctcgggaccccatgcgctggatctcgtggtaacaggtaaccccctcgtgaccagcttccgtgtgttccttttgatttgcccagggtctcgagtgccacctctctaccctgtgagatacgcagaggaccctgtaaatgccgtgccccgcatgcctcggcctgggcgtgagccgtacgcgggggaggtggtgacgtttgtaatccagacgtcgtttcgttgcgactgggtcacctgtgatgccctaag

SEQ ID NO: 12650 - DNA, 29574 bp, Human
ttttattctcacatctgcagtatcttggcttaaatgctgctgttctctactaaatttgtttacctggtaaaccatgggggtaaaacactcttttgttgaataaactcttctgtttatttctttgaagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagtaagtggaaagacatacaactctctttccacactgcttccatgggtgactgataaggttatatacttaatgagttgacctatttatgactggattatatggcaaagtgtgtttgtaaggctgatgtttagaactgtgcaagcattctcttattaaaattctcttataaaagcagtggcatgtgcctataatccgagctactcaggagactgagacaagaggattgcttgagcctaggaattcaaggccagccccggtaacagcaaaaaacaaaaaccaaaaaaacaaaaataccatgtacaggagttagggtctcaggccagtctacaaacctgggttagccatttaataacaaatgttttcagtccagaaatttaccgtttttacaaagcttatgtatttttctattgacaagtgttatattaatgtgtatgtatatattcacttactagtgcctgtacttgtacacatacatatatgtataatatgagtgtatacacatgtatgtgcacgtgtatgcacacaggtatggacagcatacagtaaggttttggtggggattatctctaggtaggatttatttattatttattttcatagtttatatttcggtggggataaggttttggggattatctctaggtggtgggatttatttattattttcatagtttatattttattgtacacaatattttgtattctgtttttcctacttaatgttataagcatttgtccatggttttacaaatgtctttaaacaatattttaatgactgtacaacatttctatatttgtaggtactgtagctgactgtaaattcttactgtatctcttaggctagattctaagaaataattatttcctaattactagattacttcctttttcttttttcttcttctttttttttttttttttttttgagacggacttgttctctttcgcccaggctggagtgcggtggcgtgatcttggctcactgcaacctccgcctcccgggttcaggcaattctcctgcctcagcctcccaagtagctgggattagaggcatacgccaccacgcctggctaatttttatatttttagtatagatgggggtttcaccatgttggccaggctggtctcgaactcctgaccttgagtgatcgcctgcctggacctcccaaagtgctgggattacaggcatgagtcactgcgcccagcctcattagattactttctgactttttggttctaaagaaataaaatggaatctaagctcctccttcagactcagaacacctggagttttttccttcctgtcttggcagattgagtggaagataaactagggcacatgtcaagtcaccagtcccattgtaataggtcagactagttttagagggtctgtgtgcatttacaagtttaactgtagtagtcactcacattcttttgcagtttttcttgcacattgtaatttgtaacaatttctttctattcagcatttttctataatctcttaaacgggttcttttactctccaaacttacctggctgtttatgtagtttctcaggtgcacttttatacttcccttcgtttgcatgtgttacttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtctgtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaagtaattaatatattttttataattcagacaaatacgatattagttcattaatgctgtcgaacagaactttctataatcttggaatgttcttgatcttctgtccaaaacagtaaccactagctcagtgtggctgttgagcacttgaaatgtggctgatggagctgaggaacagaatttaatttcaattaatttaatagccacatattgagtaccatattgagcaatacaggtctgagttcttttggccaataatacaaatcagctcttattgtagtccctcttggagagtggtataaccatttcccctctccagttaccctagctaaaaatacagcaggggttctcaactctttcttttccattactctcctgtgcttccagttggtctctaaatcctgctgactgcatccagagagctctcaaactggtccctttctgtcatctccccttctctagcttttaattagtctcatcctagcgattgtaatagtttccacactggccttccatgtcttctctcttggtctacgctgtatcttgacacactgcaaatctgactgttccactttcccatgtgattctcagtcccatcagaatatacacgacccttctccatctgaaatccacccgtctttttcttttatcacagtatttggtctggctcactactttcctgtggtttcctcaaacaccacgttttctcctgcctctacacctttgcatgtactgtcttctccctgctgacccccttacctaactccaacttgtcttcaaaataaaggtcagagatcccctctcttttttttctcattaaaagcctatttcttctcaggtgcccacaattcaaggttagcaaccttggtcatagcactgttcacacaatgttctggggagcccaggagctccttgaaggcagtagctggacctccatctctgtgtcccagcacctgtcatagggtcacttagtgaatgcagcatctgttgattgggttaattatgcaaaagcctatcttttgcagtagtccatgaattatgacagttccccagtttttgtcatttaacccagactggcccagaccccagggtggtagggaggcctgcagaggacacaagtaagtaagacgtggtcactgccatctagcagcagacatctgactaatagtcctggcaagtgaaagcaagggccacacctaaaagataggggctagatgtttgaaggttaggcagatggttatgtctgttatttttgtgggtatacacattggggaatggaatttttttactttgaggtattttggagggagatgatagggtggtaggattgccacttcttttcatagttataaaagtgtaataaatactattctaggaagtttggataacacaaaaatgtcccaagaagaaagtaaaaatcatatgtatgccttcatttaaagataatctgttaaatgttgaatttattttcatatttttctgtcatgcagtcatacatagctaatctaattttcaaataatttcatcatgttagccttaagatattgaattgtgtgtcacagtttttgatgtgtcaaatgttgtcaccagagttttacttcagccgaatggaataaatcacaaaatcaggtagtcttcaagggcagcctatgaactgcccttgaaggatagttttgagggaatggatgaatattgtggtagtggtttgctttatttttatacctcaaaagaatagaagtatcaacattttcttggtcaagtgctgacaacacaataatctttgttgttatatttaaaagggcaaacaattccatgtcatgcattttacatattatgcatttattgccaataggaattccatgtttaataagatggtaaacctagaccttgaacaaaatcaaatgtagcagtctttcttacctattctcatataaaattagaaaatcattgtagatctttttagtagttaggctacaagtatctgtattgtctacatttaacattttttaatgggtgtatatattattttttagggacttcattgatggaaatgtagagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaaggtttgtcttcttgtggtttggggtgtgagctcagtgtgggtgagtcagcttactgtccacctgaaggattagaaagagaatgtgtgtgataagaggacagttgtccaagtcagacagccaggttccaggctggactctgctagttaagaagatgtgagaatttgtgcaagtcatataagtcccctggctttgcttttcttatctataaattcaggctaagaatacgtaggcttttcggcatggattaaataaaacagcgtatttaaaattcctgaagttacttagttcctagcacaccccacgtccttatcctgtgtgtatcttttatatttaattatttgggttctgctacctgtgtttttttaaataggtcaatctttatattcttattaagctacaatggacctcacaagtattactttggtcttcaggttgataatgatacaaaatattttttggtcagagataattttcttttttttgtttgagatggtgtctcgctctgtcacccaggctggagtggagtggcgcaatcttggctcactgcaacctccgcctcccgggttcaagcgattctcctgcctcagcctcctgagtagagacggggtttcaccatgttggtcaggctggttttgaactcctaaccttgtgatcctgcctcagcttcccaaagttctgggattacaggcgtgagccactgcgcctggcccgataatattctttagaccacaacacagagggaagttggggagaaaaaggagttaccttttattgagccactgctgtggctacacatggccattttgtaaatgtttcatttaaccttcctggcagccctgtgtagatgatgttagcttggtttactgatgtagctcagagaggctcattactggcccagagtcacatagccaagggctcttttagttagatgagaattccaggatgaaaagagttccttacccacatgaaacacctcaggaactattatttgtattttgctatttcaacatgaatctatttaaattaaaagcagtctattacctaggaactaaattatttattaaagaaattctgtgagtaattaagaatggaaaaagtccttttcagatgagctgttccttctgttgtcatatgttggattactgtgagagaaaatagatgtgagcagaactagaggaaaaaaaatcactggtataataatatataataagatattttgataatatatcaaaatatcactggtatattttgattataaattttggtatattttggttatatattaatatatataggtatagatatataaaatcatcaaaagaaaattgatggcagtggtagtaggcagaggtagtaagtcaaccaaggctggtaagttctttcaccttcatcctcccaaaatgactcagggaggcagcttggtaagaaggaggaggagagagaaagtagtggtgttttggaaggagtgtgccagacatgttaaaacctgacatagaaggagacaaaaaactatttggtggcttttctggaatgcatagccagttttatccagtgctttgctggtgaaactgacagaaacaagctatctgaaatggaaagacgtatggtaaaatatgtagctctctgggagcttgccaacccttttgcatccacacagatatttaataggcaaatttaacatacggactcctctggctttagtacaatggcagacttcagttttttttggctgaaggtgagtcactgctcaaccaagtgcaaaccacactctatttatttttggaacttttgatgtcattgttttaagcatcttatgttaggcagaaaaagaaaccaagttgattaaaaaaaaatgtgtttttaccaaatcttatataggaagattttaaacatttgcaaagtatttaatgtttgtgtttgtcagccgtaattacattatcaccagatcaatgcatttttacttcgcttgataataactatagagtgcagcaagaatttctgtgtggaggaaatcttggtaaaatcacttccttcccacttagttgggtagatagttttaatatttaaaatgatataatagtattacagattattttgaaataaaaagcatctttagttccactactttcaaatgactgtatttatttttatatagtctttctgtctttgttgacacatgtagttttacacagttgctctcacagtgcttataccattttaaatttatttttctcagccaacataatattaacattcttccgtgttgctacattgtcatctgatcatttgaaaggctacacagtattccactttgttaatgcattatcacttagcctattattatttgtcaggtcttatattattatacattgagcatttttatatagtagttctttgcttctgaattatttaccgagaattagagttacagtgaatggacatttttatgtctttctgtaccatcttgttttccaaaagagctgtactggtttacatggccagtagctgtgagtgagtattgtaactgaatggcttttaatgacagtttcttttctagacaaaaaatgctgttgaaaagttcactgatgccaagagaagtttattgcaaactgagtcagatgctgaggaattagaaaggagagctcaggaaactgctgttaacctcgtcaaagctgatcagcagctaaggtaggtggattccctaagccgttgatgtatacattgagatgaatgaaaagtttgcttctaaggggataataattggtttatgataaataatgcatggtaagtctacaggacctggggggaataaagcaatgtgctttagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtatggcaatagacaccttgaaaaaacaactgacacagcactttatgattataaaagtaatacatgtttaattgtagaaaagaataaatgcggctatgtattatagttgttaagcatgaagtctgaactaaatttgaatcccaactcaatacaatacttctgaataaaaaaagtgagtctcaaaacatggtatactctatgagatcatttctgttaaatgcctttatcaacacttatggttgtatttttagtcaataccaaagtacaaaagtggtcatctgataaggggggattttgagtattttctgttgtcttccttttgcatatctgcatggtcttcttttttttttgtaaacaaatacgtattgtctttaaaattgcaacgaatttttaattttaaaaatgaatacattttaaaaatctctgactaacttccatcaccaaggatgtcaaaatggaattagggtataaaaataaaagttcttggaaaactgtaacctgagggatgatcatgattatcatattgttgttcttactgtgatcactgtgatttgagtggttttaagtatgtgagctcaaggttttcattaggcatttcacccttgcactccttgcctggcttttctgactcttgggggctaggatattagctcctgattttacctcacaactaaattatctccaggttagcactgagggctgtatggcctttgtcaaacttactcttcccttttctttaatacaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggtgtgttttttattagggttttctgaagagtcgtaggacagtgctataggtttactttgatgtattttcattgcttctccccaaatgaaaatataaattcctgaaatcttgcctcctctgtaaaatcagtttggtgttgttacatatccatgcagtggctgtcatgtgtagttccccctctgttgttttctggatatgctcaaagttctcctgcccctgtacctttctcataccatttcttctccaggaattccctttctcccctatcactagccagatcccacctgtttctcatggcgcagcttcatgccacctcctcttagaaaacttctggccgggtacagtggctcacatctgtaatcccagcactttgggaggccaaggcaggcagatcacgaggttaagagattgagaccatcctggccaacatggtgaaaccccatctctactaaaaatacaaaaattagccaggcatggtggcatgcgcctgtaatcctagctactcgggagactgagataggagaattgcttgaaattgggaggtggttggttgcagtgagccgagattgcaccacggcactcttgaacccgggaggcggaggttgcagtgagccgagatcgtgccactgcaccctggctggtgacagagtgagactcaatttcaaaaaaaaaaaaaaagaaaacttctctgacctttttctttcttctggaagaaggagtttccttcttttgagtttagaaacactctatctgcatgtttcctagggcatgaaggcctagccttttgtgatcatgtttatcttccctgccttaccactcaacaaggtactaagcccctccagagcaggagccatgtctcagtcaggcttttctctctatagacgttgccttgcttacagtaatgttgcaaatatatttagatgaagagaatatgttactttcttctattatatagaaataggtttctgtaaaatataatgctgttcttgacataaaaggcaaaaatgagcttgtttccaaattagaatttctatgatataaaacaataaataacagaacttattttgaagtaattttcatttacagtcacaggagggaataactttttttttttcaaacacaggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccggtaagtttaaaggaaaacaatcatacaaagtttgaggttggaaatgtctgtattacaagtcacagaaaaaataacaaatggccaaaaaaactttaaagtttaaccttactgctaataagcaaagcaagcaggttataaaaggaatatgatgttattttctgccattttaattgataaactttatttaaaagcaaaataatcatgctcattgctgatcagagtgtgctgaaagaagagcactcacagtctatcaattgaggtataaactggaacaatctcccagtgtttcaaggctcttaaaattcacacctgttgaactagtcagcccatttctactcctccagaaagggcaagtatgtacatcgcagcaatatttataatgacaaaatttggaaacaggctgggtgtggtggttcatgcctataatcccagctctttgggaggctgaggctagaggattgcttgagcccaggagttcaaaactacctgggcaatgtatgagaccccatctctacaaaaatattcaaaaattagcgatgcacattgatgtgcacctatagtcccagctattcagaaggccaagcagggaggatcccttgagctcaggagatcaaggctgcagtgagctatgattatgccactatgcttcagcctgggaaacagaggaagaccctgttccaccacaccccccaaaaaattggaaacagatgaccaatttaaaagccatatttttaacctttaatgacatgcaaacatgaccatgagaagaatgaaaaaaagtaggtaaaaaatgaatatggagtatagtcccagtttattttaaaatgtgtgagagtgtgtgtgtgtgcgcgcgtgctcacgcgcacacacatgcattcttagaaggaaatacatcaaaatgctattgtaaaagtgatttggggtggtgaaataatggtgggttttcatttttttctcttatgctttttttttgtattttccagcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgttaaaatgtttgtctgtttatttatttatatagagatgggatcttgctctgtcaaccaggctagtctcaaacccctgggctcaagcagtccttacacctcagcctgccaaatggctgggattacaggtgcgtgctgctgcacctggcttgttaaaatgtttttaacaaattaaatagtatttagcgatacttttagagaattttttattaaaaataaaattagcaccattaattcagctcaacaaaatttttaaaattgtcttgtattagtcaatagcattgttttctgtttcattttgtaaatgttttccaagttcatttaatatcatggaccatgctttgtttctatcccttagaactaaagaatattctggacatgttgcaacttgaaaaccatgagctacaaggtttgaagctacaacatgaccaaagggtatctgaattagagaagactcaggtggcagtgctagaggtaatgaacaaagccagtgtacccttaagaaactgaagtctttctcatttaagatgtttgagtcctcttttatctgatttaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaaggtgagagcaagaacaaataagcttgcaggatcacttcttcaggccaaagcattataaacacactataaaaaatttggaaaatagagaaaaagataaaatacaccacaaacttggtatcataatacattttgccagttgcatttttttggagaatttccttctagctttttttttttttgctcaaaagcatttttttaaaatctattttgttttttttaagtaaaatgatacatgctggaaataaatggagatatatatcttgttcatggaccaaaagacaacattgttaaagatttagttctgttcaaattgatctctagattcaaaacagttaacaattaaaatctcaatagcctttccttgtggaaattgacaagctggttctaaaattatatgaacctagaatcgaattattctaagacctagaatagaatttatacaattttttaggtatgacaccaaaacaacttttagaaagtagaacaaaaatttaggactaacactacctgatttgtaacacttttataaacctgtagtaatcaaaacactgtggtattagtgtaaagataaacacatagatcaatggaacagaatagaaagtctagaaataaactgacatatatgtgaacaactgattttgataaagatacaaaggcatctttttcagtagagaaaagatggtcttttagaaaaatgttggctgaaacaattggatatacaaaaccaaaaaaagaatctcaattcatacctcactatgtataatatataaatatgaatttaaaatgaggccaggcacgttggctcatgccagtaatcccagcattttgggaggccgaggcaggaggatcacttgagcccaggagtttgagaccagcctaggcaacatagaaagaacctgtctctgccaaaaaaaaaaaaaaataataaaaatagccaggttgggaagctgaggtgggagaattgtttgagccagggagattgaggctgcagtgagccataatgataccattgcactccagccagggtgacagagtgagaccctgtttcaaaaaaatatatatatatatatacatatttattttatatttatatataggaccataaacatatatgtaaaacctaaatataaaacttctagaagaaaacataaaacatagcagaaaacttttgtgaccttggagtgggcaaaaattcttggtatgacaccaaaagcatgatccataaaataataaattgataaaattagacttcaaaatttaaaacatctcctcaaaagacacaaggtaatgaaaagatatgtcacaggttgggaaaaaaatatttgcaacccatgtatctgataaaggacttgtattcagaatacatgtataaagaactctcaaaactcaataagaagacaacccagttatttaaatgggcaaaagatttgaatagacatttcattacagaagataaatggatggcaaataaacacatgaaaagatacgcaggataattaatcattagagaaatgcaaattaaaaccacagtgagatatcactacacacctattagaacaacagccataccaaatgttaatattaaccaggaacttttttttttttttttttgagatggagcctcgctctgttgcccaggctggagtgcagtggcgctatcttggctcactgcaagctccaccttccgggttcacggcattctcctgcctcagcctcttgagtagctgggactacaggcacccgtcaccacgcctggctaattttttgtatttttagtagagacggggtttcaccatgttagccaggatggtctccatcccctgacctcgtgatccacctgccttggcctcccaaagtgctgggattgcaggcatgagccaccgcatctggccggaactttcatatatgattgaggggcatgtaaaatggtattaagtaactgttaaactttggaagacagtttaacagttacttaaaaatcaaacatacgccaatcggaagatctagccattccactcctaggtattatatttattcaagagaaatgaaagcatatttctacacagtatatatgctaatgttcatgacagccttatttgtaatagccaaaaactagaaatgacccaaattgtctatcacctggtaaatagataaacaaattgtggtatatccacactgtagaatactactcagcaataagaagggaatgaagtattgatatacacaacatggatgaatctcaaagtaactacgttgagtgaaagaagccagaccaaaagcaagtccacactgtatgactccctttatgtactacaatacatgctcatgcatgtctgctatatggacagatcctactgtacacacaattgttttctactctctcgattgtcacagctccatttttatcagatttttggaattctgaatgttatccatgtttttaatccatgatttttataaaacttcaatttagtgagtcagtttttgaaaaaagtctccacttagaaagctgataataagattctgaaaatgagttgagtcttaaattttgtgaagatttataatcatttatactttccataactgtatgttgtgaaaggataacactgttcctcagtcatctcctgtgtgtgcttgtatatttgacagtctgacttactctctgtggtagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaaggtataaggcagcaaaacagtgaaagtgtgtgatttccttgcccttcgttagattctttgatttttcttacgacaagtaattcctgctaatgagcatggagtttctttctaaaattagattgtggtaatgtttgcacaacttggaatatactaaaagcctttgaattgtacactttaaataggacatgatatgtgaattttatctcaataaagtcagttaaaaaaaaaacctaattcatgttccttagagaacaattttaaaacagcaaaaagaaataaaaattgctgttgacctcactcctcatagattcctagtaacagtttggtgaatatccttccagatttttcctaggggtgtgtctagtttgaaaaacaaaaacaaagatgtaaataatgaagattttaaaattaccaaatgtttataaatatgataatttatttagaagaaattgctgagtaattctagctaataatatacttgttgaacattttttatatccttggtatttcattttctcacttaatcctcataacatttttatgagataaaaattattttactcatttgtaaataaggaaactgaagcttagttttcttgtgactgcttaaatgagaagtgacttgctagaggtcacacagctagtaattgacaaagccaatatagataaaaaatttattcccaaattgccttcctgaaaggttaagtttctatttctaccagcaatgcagaaggtagctgtttttaaacacctaacattaagtattatctgtaattttttcgttgtgagattttgaacatgaaaatctttaaaaacctgagctccaagcccaaatctggattgtgcatgtaactctcttttggcctttaatgagatagtgtggcatagtcatacatgtaacaggagtaagcttaaaacaacttctctactttttgggaatgctaatgggaatctgtacagtaaatacgtatgtatttcttatttcatgagaatgtcatttctttagaaaaacgagaagcagtaaactcactgcaggaggaactagctaatgtccaagaccatttgaacctagcaaaacaggtaaggttaacaaatgtaatattctagcagtatactgagggtatgcagaccattggtttaaataacaaagaaatcaagtaggctggttcctcttcacaacagcagataccatagggccatttatgtaacataaccatcacataaataaaagttttgatggagagcagtggtttgctaatttattttagccttagaactcttgatacaaacagttttactcaaagctagtaagtagggtggtggctagaccagagcccagcagcagtctctcagcagcccttcttggggtttcagggaccagatgggccatctctcatccatgacacagatgaggcctctaaaggctgggcttagatttgattactccttgagccatagagtacccgccaaatctgggcctctatcttgtcagatattgaatatagcagatttttgaccctcatacttctaatgattttcttaaaggtaattcagtgttgtcctgtgagactagtgctgtaattcaaagcacttcaaacaagttctagacttcagtttctattatgtaaattaagagttatgccaggtgcagtggctcacacctgtaatcccagcactttgggaggccaaggcgggcagatcacctgaagtcgggagttcaagaccagcctgaccaacatggagaaaccccatctctactaaaaatacaaaattagccaggcgtggtggcacatgcctgtaatcccagctactcgggaggctgaggcaggagaatcgcttgaacccgagaggcggaggttgccgtgagctgagattgcaccattgtactccagcctgggcaacaagagtgaagctctgtctcaaaaaaaaaaaaaagttaacattagacacaggccatcccagcactttgggaggccaaggcaggtggatcacttgagcccaggagttcgagatcagcctggccaacatggtgaaaccccgtctctacgaaaaagacaaaaaattagctgggtatggtggcatgtgcctgtagtcccagctactcgagaggctgagacgggaggattgcttgaacctgggaggcagaggttgcagtgagccgagatcatgccactgcactccagccttggcaacagagcaagactgtcaaaaaaaaaaaaagttggattagacatctaaattctcttgtacctgtaagtttattgagataataaaggaaataaacttttatgcctctcgttctgtcagacttagtagatactggattggcactgaccacctctagtaaagatggctttattagtagtttccacttgttctttcacctaaaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatggtactacacatttatgattttacataaaaaaagcattttgtggctcatgtgagcctatttttcccctggcagaaagctgctgagaaatatccccaatgggactatgtgtcccttaactgccctgtgtagccatgggtggcatttataccaactgtgtgactctcttacagacctttaacgatcatagaacatcagtcctgtaaagatacttaacagccacgtgccatttgctgcttgaatcccctcctcacatgctggccagatagcttcccaagccctcttgatcacctctgtaatggaattgtccctgtgggctgtcttctactttcttttgacctggcatctgtctcatgtccatgcaggttctctgggacactatttgttgtttaatgactaatcaagattattctttattaagatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactagtatgtattctggaacttctcactgggagatggggtatggattggctctgctggttgtcttgcaaaagtatttaaagagatccggaccccagccagagcccaggagaggaggcaggagaagtaaagcaggaggtatgatagccctgtgaaagatgaggaagcaggttcagaggagatacaatcctgagactgaccagcaagtccttccttgctcatattgtctcctttgagaatgccatctcaagaaagtggaacattcacgtgaataattgccaaaagatactcttaaagtatattacctatgagctttgggaataatgatctacttcatctcaagtgtcaaaaaaatcatattaacagttcttctgtccagatttggcatagtgaatggtaccagaatacaggtgtttgcttttaggtcagtttgttctctcttgaaccatatataaatgaagttgacgtgggaatccagggtaaatgattgttctcacatcagtaaatggtttttctctttcttaggctccagggtttaataatgcttggaaaatgttgtgggcttggggatctgaaagggttgttattcctttttccctgggaactcttgatatacccagacccaatcatttcattatgaaaatgaaacttaaaaaaatatgtcgagttctgatcatgccagagttgttgaaaagtaaaatctgggcagggtgctcctctagggtgataagaaaaatattttttaaatgtcacttttatttcgtaagcattatctgtcgagtactcactatgtaccaggcgtttgcacacattattccaattgaacatcaggaaatgttttcctcttctataaaatggggctcatgccagtgtaggagccagctccaaatcctgtgcactttccactgcactgcctcctgtggaaggaagtagtactggtgtgtctccctttatgaaaatcaatgtttataaaaaacatttcagctgttccacacacttcaggattggtgctgggtttcctctcactggtctcaaagacttgaaagagaagatagtagctatctgtcactctgggatcaggccctccaggaaccaattacttcaaaaggcacccttatctgggttttttctgggcctttggtgtgggtcagggtaggcttgtacgactttgtaatggaggaaagcacctgcatgggtagcatatcaccattatgcatctgccacaagggaaggggagctctgcccacagctggctcggggtctttggctaaacctactgaaaatgctcatttcagaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgtgagtacctgctgccgtggcagtttgtgaggaaatgataaatttaaaattttaaactgcaacaccacttcaacacagagaaaataaattacccatcaacccagtcctgaacccagctgttgttattgatgtatttatgcatcatttgtccttgaagttgatggtaagttttacctgggacgggtgcagcctcaatggagctctggctggctggggagactgttggtgtgaacagccattatcagcacaaagtagacagcatgttctgccagcaagcctcagtttacacctccactggcagggaggagggggtgttgaagaagccttctctagacggttgttttttaagatggcatcttgctttgtctcccatgctagattgagtggcgcaatctcagctcactgcagcctctgcttcctgggttcaagcgattctcatgcctcagcctcctgagtagctgggactacaggtgtgcgccaccacgcccgactaatttttgtatttttagtagagatggggtttcaccaggttgaccaggctagtcctgaactcctgacctcaggtgatccacctgcctcagcctcccaaggtgctgggattacaggcatgagctaccgtgcctggcttatagagagtttatttttatttttattttcaagacagagttttgctctgtcgcccagtctggagtgcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgcgcctagccagttttattacactgctgtagtcagtgcctacaaatttttctcatcctgccctttttggccaacattagctttaatcattatcctaaaaccaggaagctcaatctaccatgctttcatccttgaaataaatttgggaagtgacactcaggtcagaataatttatggtggatggagacaggtgagcagcaatggaactgtcaagggggaggatttttccactaccctctggaggggttagtggagccctgttgtatgaaaggaacttttaaaccatgtgtgtctctcaaaggggatacgctgataactagtgataggcagatcgtcataaagatggaatatagatgtctaaaatttaatcctaccagtaaccctgtgatgatgggtattattattctcattttacagacaattaatgaagactcagaaagggatagtagcttattatcaaaggtaatgctaacagactctgacgtgtatatacgcccagctgtatttgatctgcccatgaaaggccgatagaattatccccatttgacagctagagaagctgaggcccagaaggggaatgaagttatagagctagtgagtgtgtaagccagcaaaccacacctccatgtgttagatcgcagagttattttcttcctcctgtgctaggagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacaggtgtgtgcccagaaagcccagctggccagcctggggagagaggactcactgggctcaggcagattgtattgtttttaatatcccttctatagtagtatagaaaagctgattataagaatgttctttaagtcaaatctggttttttagccttaaaatttagaaacacaccttgactattaaaaatataaatttctcttaaatttgacaagctcttaaaatgttagtttttcaaggaaaaaaggtaattcttgagcatcatatttcatgtcccaaagaactatgttgaaatgctagattttatgccataaacaagtctataggagccaaaacctcccctaccccttgagcaagaaaagatggtccgggggaaacctttgatatcacataatgtagccaggcagagagtattaaaccagttcatgcctggactggtagagtctctaatccttgatatctctggtgtcctttagagcatctgggccatccctgaactctagtcgggctgctgtagccactcatttggccctgctatacttagtcttttgggtgaccccacgtggccattctagtttcatctgtgcttccaatcccctgatgccccacatatacccaccatttaattcaagaaaaaataactaaaaaaaaattatttaaagaccacaagcccttagtgattttgcctttgcaaatttggtaaggcaattagcagtaggtataaatttcatatttcactaagctctatatggggtagagccacatagagtagtctcaggcatcaaatgcagttggtaacactttaagaaacctctaggctgggtgcggtgctgcattcctgtaatcccagcactttaggaggccaagataggtggatcgcttgagctcaggagttcaagaccagcctgggaaacatgccgagaccccgtctctactaaaaatacaaaaagtagctaggtgtggtggtgtacacctgtagtcccagctattcgggaggctgaggggggaggattgcttgagcctgggaggttgagactgcagtgagccaagattgtgccaccgccctccagcctgggtgacagagcaagaccctgtctttaaaaaaacaaaacaaaacaaaaatgtatattgccaagccaccagattcttcacttataaaattccagcattagcatttataatccagatcacttatgacttatttcagtaaatggcccttttctcatttgtggcttatttactctagttgccagttgggtgccactgaggtgcttcatgtaaattctcacttagtttttacatttctgagcagaaggtatttatctccatgtataaatgaggtaatggaggatcagatgttagccaacttgccctgtcatactggtaatactggaaatcagattggtaactagctttgtctgactccaaagagattgtcttctatagagtaattcaccttcaaggaactttatgcacatggcttttctaaatgaaagttgttccagttaaaatgccaataaaataatttattcagtagcttatagagtcttgagtatctgaaaaatcacaagtttttacagttctagtaatcatagtagttgatatttatagatctttaaatacatggcacatcatacagctcaattccaagtaagtctgaaattttatacaatgatatttgacaccaactcactgtttagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggttgccctttaaaacaaacaaaaaatcagtatgagatactgggcacattggggaggggaggggaaagttacatttacctgatgctttcacatccatgctgttgcagccctgccagcagtgtcagggatggcatgtctgaagcttcgaggagttggtgtcacacagtaaatggcaatcagtgttcaaaaccatgacttcttgtgttgactccagtgttctttaacctatgtaatgctgctttacctcagctagaaccgatagaatctaagtatttgggagaggaagtagaaacacagtgatgaactgtaaggttttcataggccagtggtggcaggaaagatttgggatactggaaaagtaggctgaatgtcaggtaaggaattgtttggctcagaacatgttgactttgaaggccttgtgagatatccagggaaggatatctgtctgtaggcagccaaaaataggagtctaggattaccgatcagtgttgacctaaagatttgagagttaagagtataggtgggaggttacatttatgtggggggaatggctatgtagacagcatgggatgagagagtacagtgctatagtattgagtggagccctgtgatgtccaacaatagtctccagccatgtgtggttatttaaattttaataaattataattaagttaaaaattcagttattcatttgccacatttcaagtgcttaatagccacatgtgtctagtggcttctatatttatagccagaggtagaacattcccatcattgcagaaagttctgttggacagcgctgctatagactttgagagaataatttgattatagcaggggcaaaagccaaaaagtagtatgaagttgaggattaaatacctaatcatttatagacaagaaactaagacttaggaaaaaatacataatcaggagacactccagttgtcaagtataaactgatcttctcagtcataacagaaaaggaaaaaagagatgaggcaataatttaatggagaagcaagggatacagaaatcctaagcactgctagcatggaaaaactgggccaagtgaaagaccccgttaatgacaacacagaaaagtaaaggtttatgcacactaagtatccacctggcacctcctacaattctttttaaagatgagcatttttgacagccattcctactgttagccagatttgcctatcaaatgtatgtgaggaagctgagcggcagttctggtacatttcttctgtgtaaaaccctaagtcttatcacacttttcaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggtaagcagcagctctttttaaaaacaaaacaatagcctgaggttgttttttgtcttttttgagacaaggtcttgccctaccgcccaggctggagtgcactggtaccatcacagctcactgcagccttgacctcccaggctcaagtgatcctcccacctcagcctcccatgtagctgggactacaggcacacaccacttggcttggccactttttaaaattttttgtagagatggaggtcttgctgggttgccagggctggtctcaaactcctgggctcaagcgatcctcctgcctcggcctcccaaaatgctgggattacaggcgtgagccaccacgctgagccaagaggaaactcgtaagataggatttaatatattacatagaaagtacttaaaagccgtggggtgtataatctagaggagattcagaaaaatatagattatgccgccttcaactctctgaaaaacttgtcttagcaaagacttggtagaggtagataagctgatggcttaggaaacagactacgactgcagattggatgacctggcagggatatagttaattctactattcatgtcctccacttctggatttatttatttcctactctgtcaatataaagagcttagacctgtgaggccaatatgagtcctagtttagtatgtctccctgcattttgtaacttacatttacagagttggaattcagacctcttaacctaaggtctataaaaaccctgaatttcacaaaggttttctgtgtgagcttagataaggttaataagcatttaagaggaacatgaaatatactcatggaactggtaagtagtagcacacacaactgtcagagataggtaacagcttccattttccagtgcctattgtgtgcacatacaaaactttatatatatcatctaatttttacatccttggaggtaggacttatccttttatatagataaggaatctgtacaaaatgataaatgatttggtcaaggacatagcaaaggacaacagcaggacttgcgggctaatctatctttaccacagagcagtatattttaatggtggagccacaaggagctttcaaggacagttgcctctttaatgtgcccaaggtgggcaagtgacttacctagttcacacagctaattagcagcagggccattagcagcagggccatctgaatatgattatcttaacaccatctgtggtggacccagtcaggtaaaggccaaaatcatcatgggccttagggcagggttcgaggaggagtgtgagaggcactgggcattgaatagggaagctttggggatgagacagcccagagtagtgagagaagagtagagtgcacaagggcttaaaagccagcttcaattaccagctcaaggtggcagccagagttatttagttgctttaaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagattttttttttaaactagaacttttaattggaggatcttgaattttagcagttttaagaataaccgtttaattttttctctcagaattttgtacactggttcatcttaaaacatttttccaaagaggtaactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaacttgggtctgtcctctgactttacacttcacaggtcattctatggaaaagccgtcaaatttttaccttattccaagtaagtaatctttcaggtggttttcttttacctggaggctgaagtacattatacttatcaatgaagatttcatcatttggaaatacatcaattataaaactattatgcttcagatgcctttccttagccaacatattctttggtggaaaatcaggaaaactttgtaccttggagaatgtgacccagtgataaattcaaattgtgttgcctttcagattttgaactaccataattaacagctcaactccatgatgtatacatttctttaaaaactagaatagcaactgctctcacagtctggcataattattcccaagggggaaatatgtaataagaagttttaaaatattctcgggaactcttttctagatcactactagacagcttttgagtcacaacaggtatgttaccctgttactaataatacagagcagcacagtgcagtcatccctcaccaccaaggtttttattccaaaacagttatttggctagacgtgaaccgttaagatacgggatcaatggagttacaataaagacaatgaaagtgacaatttattaatacacagtaagttctagaaggcatctttcaaaacaaaacttgatttcttttgtatttacattttttgtttcaagtcttagcaaaatgctaaaaggcctggcctagtcacaattactgacatccttctgggacacaattttctgggcctgtgttgaatgaggataaattatcttttctctaaaatgccacatgaaccctctctatattcccacatgaagaggaatggaaggtaattatttggtcttttcttctgtttaggggaatgaactgaacgactcatttttttaaaatcacacttaaaagacacatgggcaaaaaagttccccaaaactactgtcttaccgaatttgagaagggaggtaatgtatgaagcttaacagctggcttcaaaagacacctttccaaagaaattgtactacctctattaacgtgtaaaccaccaaccaaaaaaaaataataagttactccatcaaacacgttattatccataaaaaagacttcaacattgtagtggaagatctatttaagcataaatagtactaagcaccaattactaatctgagggcctcctcacaggtccaagggcaatgagcaacctcgagaggcaggtgactgcacaagcagtaagctatggattaaaaattaaaaggatttcacattctttccaaagtgtactgcccggtgtctggcacacgcatgttacaatatgacaatctgctctatttgtgagcacctgagtgtattacaggggattacacatgcatatgatagaatctggctcccggtacagtcaaaggagaacagcatcagccaccaaatgtgctgatcttacactgaaaagggttgactgaaaacatttcaagggtaatgtaaacacaagaataaagctgtgggtctattacttagtgatgtggttttatatgctacatacgtagacctctctttatacaatgaatatggacagtgctgcaataaaaactgatgacacgtcaaattgttcacctgaagaaaaaccctattatagttcagaaaataatgcaaccaattttaatttaatctagatacaggtactttatttacaaatatttagattaatagcattttgttacatcaaatgaagagtacagcagtctgaataaatccttcagtcacaaaaacaataaaacccactgtaactaactttgggagtcagggtattgcacctcaacaagccgcagtctttagtttgtgattgctaccttatatcccaatgggtggtttgtttgttttgtttttgtaaatatacacacacaccagcaggtcatggtccctgggtgagtcccttgtgatgcaacagtgtaagcaaaatggatcactgtaagtcttt

SEQ ID NO: 12651 - DNA, 133360 bp, Human
caggggaagaggatgaggaattcagaggagtccaggacaatcccgtgtgtccggctggaatctgaatggctggtgggaaccagcaaccaaaagaaaagaaaacaggtggcagtggagcagcagcagagaacaggatttcggggaaagaaaacagaactttttttggcatcctgagtgtgaggtgccaggtagagaagccaggctagcaaggcacatccgagctgcaagtaggaatgggctgggacaacaatttaggtttagaaaccaccagcatatatggggtacctggaactgtgagactaaacaaaatctcttggggagattcttaacagaatcaaagtcaggaattttggtctttattcctttttctatcagacttcccaggaaagtgtattttctttttttgggtagtctggtgatttctcttaaaaataaaacaaactgagaatgtcagtgatgggggagataatatctgttcttttaagcagattctaaatgtattagtaccatcagtaactaaataaaactttatcttaaaacctctattacacattgtagttcatattgtatgggctcactcaagagtttatagaaagtatttttggatcaggtaaatgaaatcatccaacagcagtgccgttaaaatctaaactacaaagccctgtgtgatctggccactgcctacatctccaacttcatctcataacactcgcccccccaaccccaacttattggtctttcaaaccactcctagggcacgtgaagctctttcctgcctctgcataggcggtttccgctcatttctcttcagatctgagctgattatcagcccagagaggccttcccagaacagcctatcaagaagagcaacctccttccctttttgctattatctggttttctttttccttttttcttttcttttctttttgagacggagtttcgctcttgttgcccaggccggagtgcaatgctgcgatctcggctcaccgcaacctccgcctcccaggttcaagcgattctcctgcctcagcctcccgagtactgagattacaggcatgcgccaccatgcccggctaattctgtatttttagtagagccggggtttcaccatgttggtccggctggtctcgaactcccgacctcaggtgatccgcccgcctcggcttcccagagtgctgggattacatgcgtgagacaccgcgcccggcctgctacctggttttcatttcctttactacacttacacaaggtctactttatttgcctgtttgcctccttgctttattactaatagatcctcgagggtagtgattttgtctgtcttctctcctgcagccccgtcacgtaaaggtgctggtcaaaggaaggcggcaatcaccgaccggacaccagggcaaatcagggcagcccagtgattcgagatgccggctggggaatcggacccatgtgggtcttttctcagcttccccgcttactgtgactttcataagtaacggaaccccctcaacccgtttccttaagtgtaaaaaggcactagacacagcaagaagcggttccggcagcgcggaaaccgaagcacacgctgggtgtcacgacaacacgtggaagccgcattccgtgccggggccctggccctagccccagccccggcccccggcccgccatgtggcgcggctgaccgcggccgtgcgcccacctgtctccctctgcgtcttcacgctgatgtactggcgcagcttcttcaccgctcggtcccggatgcccttctcgctggacgccagccgctgggcaaattggatctcggccggctgcatggcgggggccatcgcgcccgctggagcatccccggccgcgcaacccgcggtgccgctgcagccagccgagcgctgcggagcagccagccaccgtccgcccgggccgcgactgcacagaaggcggcggcggcggcgcgcgggctgatggcgtcacaaaggcgccgcggctcgcagcgcgctctgggagtgagcgcggcagtggccctggcagctggcggagcggcccagcccgtgtgcacgtggcgccggcgctgcctttcggttgccaaaattcaggctgtagacggcgaggttagccagggttaggacttgaccaggaagagacggaaggctgtttgtaaacggtctaggattttttgtttgtttttgagacagggtctccctctgtcgcccaggctggaatgcagtggcgcgatcttggcggtgatcctggctcactgcagcctcgacctcccagactcgatcgatcctcccatctcgaccgcccaagtagctgagactacaggcgcgcgccatcacgccccactatttgttatttttttgtagagacggtgtctcgctatgttgcccaagctggtctcaaactcctgggctcaagcaatcctcccgcggcggcctccctgatcgctgggattacaggcttgagccgccgcgcctggccacggtccaggatctttaatcccatttagcacacctcgttgagccagcagcttacctgcgatctccgtggcgtggagtttttaactgtggagcccccgggcccccgggtggagttgagactggaaggaaaggccggcactggggcctgttgagcgggtggagggctcgccttcctccagtgcctgcagaggcttgggcagatcggtgcgcccctaccccggagccctggtgccagtgcaagggcgcccgcgcaggcgtcccgaggcctggcgagcacgcgcgcttccaggggagttgggcagggcgggctgcttgctaattccagagagggaagaaatcttagctttgggttcatctaaaacccgaggccatcctatattttgcggactcagcgggcgtgctggggcaagttaatggactaggtcactccacacgtagcgggggttatctcagttgctccgctcagttgtctaggcgacctcccgaggtgcctgttgacacaaaaattcaacccttaacgtaaaagcgcctgaatccgagcgagggaaggcgcgcggaggcgaggtttccagcaaagactgcccatttgaacgcagtcccccttagtgtagcattcctcgccaaacaggaaaggacccatccgatttattttacttgacacttacatcaggggctgactttccttctgctttgcagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccgggttagtgaggaagccctggccgacgccagcgtgtttgaaccgtcgccattcgctcccctcagggcctcgccccgtgcgctcggagacggctcgctgtcgcgtgcttgggggaagcctggagacttcctcccctaacggcgtgggctgggccggagcggggtggagacctggggcgggaggcgacttcgcctccaaacccacgcggggacccggtctgtgaggctgcgcgtggtgggggcactcagtggcgccaaagcgggcatgggagcgtgggatggatggtcactctcttctctgctccgtggaagcccagttcccctccgaaggccctggccccctgcttcgggacttagcgtcaggcttagagagaatctgccctccatcgattttataactgtaactgattgcatgcgatggagaaggcgcttggactggggccagatccgtgttcacatcctgcttccacccgttattaattgtgctgcattgagagtcatctagctcccgtgccttaatttccatctagacaatcttggaggcttggggtgaatagtagatgagatcacgggcggagggcttggcaaacccagtaggaaaccagatgacttccttttcctcctgattagtttggtgctgcagtgataaaaagttgcaggcgttttctttgacttttaggaatagagctcttgtatgacttttctttttcgtggtcttgctctgttgcccagactggagtgcagtggcacgatcatagctcactgcagcctccaactcctgagctcaagccttcttcccgtgtcagcctgctgcgtacaggcgccggccaccacacctggctaatttttgtatttttagtgagatggagtttcaccatactggtcaggctggtcttgaactcctgacctcaggtgatccacccgcctcggcctcccaaagtgctgggattacaggcgtgagccactgcgccgggcctcctgggcacgttttcatatttttgtagtgacagggtctctccatgttgctcagactggtcttgaactcctggcctcccaaattcctgggatttcaagtgtgagccaccatgcctggcctgtttgtccttattatttttaacatctggctccctttttgaaggctgaagcttcagctttcaaaatgtttgtatgtacataaaatatatctatagcagaatatacagtaggtagagacatgatttgaaacaacgatgcacataagaggtgtgaaagaaaagcaagttaacttgagctgttgttttttttctcatgtgaagagaaatataataagatctgcttgttcttttagcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaagtgagtcttcattttcagcagtcattggtggtaacagtaatttgttctagcagatttaccctaggtaaataattgtaaacgaattttaaggtactcttacagtccttgtgatgatatttgggagagtctgatgacctaagaaagggaggtttcctcagtgtagtgacttggacatatgtaagttggtataagttggttgccagttttctgagcatctattaacagcttctctttctctctctcttcattggcagaagaattttatacttttgataactgaaaagctctattctgaaaattaagtacttactgtgtaagttaaggatcttgccaaatggaaaccttgcatggagtttacttgtcagtagagatagctggaagtgtgttcacttatctttaggtggatgggtgagccagtatctagaactgattgaagtttaggctttctggtgtccattcagacttttgagatttgagctgagctgttatgttgaataccagtttaggagcctattgaagttcctggacatactctgagattgtctcagcacttgcttgattgaggccaaatcatgattaaatcagcctttgacggtaaaggccaatttactgcatgacatttggttgttatccctccctgtgtgccctctagaaaaggtgcatccagggggcccaggtagctgtagcacttgtccagacaagaagatagctcaccccgagaatatgagtttctggcatgtgcaaacgtatctggtcagtgggccagccacatccagttagaagggacagttctcatccaccgtaccttgtcctgtttatattctctccgaagtccttggatccagtcttctctgccctgtggtgtgctctgggaggtagatccctacagatggggctctcctggttcccttgctggctgccagtggggctcaccaatggaaggcattgctgggtggagagagaggttggggtgtttcttcctgctccctccctgctttgctgctgttttgtggcagtagctgcatccctccacaacagagactcctgtctagaggcctcttccgtagtcctagctcttgctggactgcccctgctcctgtggctgtagggctgttgctagtccctgggtacctcgctgtcccttggtggttctgttatctctgctctcccctctgtaagtggtcccttcagaaaagtctcaacatctgggttgatttctctttcccactgggactctgccagatacatggcgtgtcattggttgccagaatgccaggtcattgacttctaatttctctagttttgatttcatgctcatccagcaactttctgagattagtcattccttgtgcatttatcttcaggaaaggaaggtaaataggcatacaccagtagcagcgtatggcagcctgctggttggttatattctcactgtaaattaataaactggcattctaaaaaatacatcagggtctcatgagttagttaacatgagtgtctttagtgatcagtcccgctgccaaaatcaaaccgagtgagggccacaaacaaatctgtggtcacttgatcacagtctgcctttgggagatcttatctcatagtcccggcctttcccaggctatagagtcacctttttccccatagtctctctggcaattcctgcttattcccctttgctgaaatttatccttctctgctttgcagccttccaatagggcttgagactcaggcctaggccccgctcattgcctcaccccatggcttctccctaggcagtctcatgcacactcacagcttcagttaccgtcttgatgccagtggctgctggatttactctctagcccagaactctccaagctcacggccttgtgcctgactccgacttggcatttcttcctgcttgtttcatgattatttcaaattctaaatgtctgccctagcctaatcagtctaaggtcgccaggaacagacccacagtctgacagagtgaggtttatggctctttgcagtgaggaagaccataccagaacaccgagaaactgtggggcatgtcaacaaaaaagaggatagagttgttgtaggacttggagacagagtggtattaggtgaagcataaatgaagcaaaatagaactgtgtctaaagggaccaatattaagtctgactgcgaagcggacccaggtcccgtttccttgaaaactacaacgttcaaatagacgtggaacattgttctagaaatcccttacttgaagctctgcagtagctggaaatagggttcttttctgtgtcacagtgacttagatcctgcaggcaagagtgggatcttcttacttgtataatttcaaagaacaaaatttgtgcgagtctgggattttacagaataaggcttctcagtgaataagaagttagcagtcactcaaagaagaggtcattatgacactttacagttgcattgtctttgagagatattttctgttaacttggcacctgactttatctgtgtttgttattccagcctgacagaagtcaggacagacttttgctttctcggtgcaagctgatttttacttcctgttgtcatatctgcctcatgctatctgttccctgcccctgtcttacactggcctgcctcagtctccccagagcaccaacacccagactagagacccaggagtcttccttgttacctgtctctcttcctcactactccgcatgaaacctgtccgctagtaagtcttgtgagtgttacttcatggatgcatcctgaatcatcagcctgcgtctgtctccactgctgtgttctgcctcctcctggcggtctcctcactgccactctccagtccctcagacacactgtagcctgagtagtttgtggcagttcaatctgatgatgccattcacctgcgtaagtcttcagacgcttctctttgtttttaggataaagagcaaaaacctaaaaaccccacccagactcattatcatccaaaaacctaagcaaaaccatactacggcttaaaaggctttatattattgggcacagccccggctcagagtcactgcctaatctgactacctcgacatgatcaatcttcctttgaaatgttgtcatggtaccctatgcttccttcagacacatggttttatttccattttactttataagctgttgggagtgcagggcccctgattttatctgtcattatctcggcccctgattttgtctgtcattatctccctggctgattattcggtcttgagggagcaccctactgtctctgcatgcccttctttctttctctctctctcttccttccttctcccttcccttccctcccctcccctccccttcccttccccttcccttcccttccccttcccttcccttccccttcccttcctttcccttttctctctctctctctctctgtgtctctctttctctctttcttccgagtctcactctgttgcccaggcttgagtgcagtggcatgatctcagctcactgcaaccctgcaacctctgccccctgggttcaagcgattctcttgcctcagtctcccgagtagctgggattacaggtgtgtgccaccacgccagctaatttttgtatttttagttagagaccaggtttcaccacgttggccagactagtcttgaactcctgacctcaggtgatctgcccgcctcggcctcccaaagcactggattacagttatgagccactgcgcctggcctgatgcccttctttctagtttgcagtcctatctcatgaaactcacatgtgctccaggaaacgtggtgttaacagaaaggaaggatcagattgggctgggctggttccaggaggtttactgtggcctcctaaggcatcttttatctaattttggcttttgagtttttaccatttagccaacatcaagaaaaataaaaattcttctttttataaggcctagatctgatggccctccccaagccttcccacgagcctgtcttcctagactaatcatgctagacatgactctaagaatagagctctacagaggaaattcacgattgtactgtggcagcaagagccgtttgacatactgattcttctactctcccactagccctattgtccagtatccactccttttgcttctagaggttaatgtgcacttccagttgttttttttttttttttttttgatggtgtctggctctgtctcccaggctggagtgcagtggtgtgatctcagctcactgcaacctctgcctcccgggttcaagctattctcctgcctcagcctccagagtagctgggaatacaggcgcctgccatcacgcctggctaatttttgtatttttagtagaggcaggatttcaccatattggccacgctggtctcgatctcctgacctcaagtgatctgcccgccttggcctcccaaagtgctggaattacaggcatgagtcaccatgtgcttccaatcttaagcagtgactaaaggcaacctgaaggtaggaatgaatacaggcagggaaggagtagacctgatttgagaagtttcttttagagtgtggatatagttttgtttggatgggcttgggctatacagtaacttgtaagccagctagaggattgaggtgacacatcaagtagcgaatggggcttgattttgactctagcccagcatctccctttgggaggactgggcaaggtaaatggcagtttgcaataatactgacgaaggtgttgcctgagagtcttagggagttgatgggtactggggagaggcatgatttgttaggaggagaaggggagatattctaggccagggcggtggcatgtgaaagtcacacatgggattgagcaggaccgattgcaggttcatcagctagtgtttgattgctgtatggaataaggattgggggtatagcagaattagggatggaaaatgaacagtttatggaagacaatcatagattgtttttaatttgagatgagagtcaactggaaattaccacatggaaataaccatcaaaatagtgatcaaaatgacgttttttaggagaatggtttttataggtgagtgtaggataggtttgaagaattgggtggaagatgaattagagcattcatcaaggaaggtcgtgagttccattagtgtgtgggactgtggctgtatggatggaatggaagggacgtttgattagtcttggtggttaagtcaggacaaagtgtcatgatttatgatcggcagtgagagtatggagatacaggatcatctatatactgcctgctgattagtgtctacaaaatgtggacagtaatgcttacctcataggctatggcaaagcttaaaatgagataagctctgtaaggtgtgtgccactgtgactggctcataggagtccctggtaaataacacctcctcagatggtgtgggaaactatgtgaacccttggggaaatgaagagagactccaattcacagcccagcagcttagcttctggctcggccattgtcacttcatgagtttgggaaaagtttagggaggttcgagtaagactcagctatgtttgcaagagatgtaaaccgggccgggtgcggtggctcacgcctgtaatcccaacactttgggaagccaaggctggcagatcacttgaggtcaggagttcgagaccagactggccgacaaggtgaaaccccatctctactaaaaatacaaaaattagccgggtgtgatggcatgtacctgtaatcctggctactcaggaggctgagacaggagaatcgcttgaacccaggaagcagaggttgcagtgagctcagatcatgccactgcactccaaactgggtgacaaagtgagactccatctcaaaaaaaaaaaaaaaaaaaaaaagcaagcctgaaaacactataggaacctccatttgacttgttaaggtagtggcacttaagtacttagtaagatatcaccctctgttttctttcatcccttcttgtgctttattcatccaacagtggtgaataaatcagtgggtatcaaaaatttgtttaaaactaggaaaatcctattttttataaataaaattttatgggccgggcacggtggctcatgcctgtaatcccagcactttgggaggccgaagtgggcggatcacgaggtcaggagatcgagaccatcctggctaacatggcgaaaccctgtatctactaaaaatacaaaaattagccgggcatggtggcgggcgcctgtagtcccagctactcgggaggctgaggcaggagaatggtgtgaaccccagaggcggagcttgcagtgagccgagatcgcaccactgcactccagcccgggcgacagagcgagactctgtctcaaaaaaaaaattatataatagtatatgatggttctagatgtaaaatagatgaaaactgtatcttctgggtatttgtttttaaaattaagttttagaacattgacttataaaatcagtaagtacaatgaaggtggtgcgatgaaaacacaaatttagtatcagggattttggaaggtacttggatgatcactttcagcatccagtttgtttttagttttgcttgtgaagtcgcaagaagacacaatcccacagataaggagttgcagatggtggttttgaagtagttcacctagcaacatgaagacactttctaattaaactgatatgaagcttgaaataagaggagtcagatatttttgttttacaattaaatcgctaagatcgagcaattctttgctttccttgattggcaattgttcattttggagagaaataataaaaaagccattcagtctgtttaaatcttcattgtcttacagaaaacacttttcatgcattatgctgcatttgacaatttggcaccttagtggcagtcagatattcactgacagtctcagaggagctggaattatttttgtatgttgacagcacacctaaaatgttggcctcatttctgaaataattaaaatgttaaataattttaaccttttaaaatttgtttatatgttttttgatgttaatgtgaaccagccttgttttggtcattgaaaatatcagcagtgaatgcgaactagtgtagccatgatacgctggtgagatatttgaccaacagatttttctttctttttttttgagatggagtctccctctgtcacccaggctggagtacagtggcatcatcttgactcactgcaaccccagccttcctggttcatgccattctcctgcctcagtctcccgaatagctgggactacaggtgcgcgccatcatgcccggctcatttttgtatttaaaaattttttttcaaaaaaataaaaaaaaccccaaactgaaaaacaaacaaaaggccaggcgcggtcagcacacctgtaatcccaactacttgggaggctgaggcaggagagtcgcttgagcccaggaggcagaagtgacaatgagttgagatcatgccactgcactccagcctgggcaacagagggaaactccatctcaaaaaaatttttttaattaaataaatgaatgatgagcaaatgaggcaaacaaaatgttaatagtaggtaagtctgggtaaagagagataacaggaattttttttggcattagtttttgtgaatttgaaattacttccaaataaaaattgtaaataacattgtaaaatggagatattaattgaatgtttatgggactgtagttgttccccaggtactcttagattcttagcagtaggatttgaaaaccactgcgctatgtgatttctaaagtgtaggatattttgagattaatttcctgagagtttgatacggggtacccccatttcagttctgggaagaattatttgtagtctgtagaaataagaacttgagaaatatccatgaagagtagaaccaaagagtcagcaccaaaaaaggattattactttgactcggagtttattgtggcccagataaaagaacatgaagagtgtgtcacatccatatcctggcagggaacaaaaggagtaaacggagtaaagtgaagagattaaagtgtgatcagggttgggggaaccagtgcctggagaaagaagcatccgggaactaacgagtggagcgccattgcctcccctgggctgaaggagcagaagggagagaggtaccagacgtggcgagaggcgttgctccagacaagatgcttgacagcacctgggacctcacccaggaggatgaagcccagcagggaggatggagtggggagacatgtcccatccttggtcatcttctctagtcctccagtttcctgcggggctgctattgcatccaacaggaagccataggacgagggagccttgttactgtgggtcttcacatctgcctcttggggcacagatcagggtggagattgtccagaacataggaaagtagagggaaaaaaaacacttggggagcttatggacagagaaggtggcaaggtggtcaagatggaggcggaagaggtgtgtggtgttttaatatcacccgtgaccgctctgctgttcatgtcatatatgtgtgtcagtgaatgaaaagcaaaattccctgactctggtttgggaaatcaacagaattaatttgagttcagcaagattgattttagttttttttttttttttttttttttgagatgaagtcttgctctgtcgcccaggctggagcgcactggcgtgatcttggctcactgcaacttccgcctcccaggttcaagcagtcctcatacctcagcctcccgagtagctgggactatgggcgtgtaccaccacgctgggctaatttttgtatttttagtagagatggggttttgccatgttgtctaggctgctcttgaactcctgacctcacataccaggtgataaagaaatggtaagataaattgacgccgtttgtgcagttttctttgattagtgttttagaaacccttattttcctttctagctttctgtaccctccctgtgaataaattgagcatcaagagacacagccattctcatgttattagacctgtattaagaaaggattatggactgcgtgcagcagctcacgcctgtaatcccagcactttgggaggccaagatgggcagatcacttgaggtcaggagttcaagaccagcctggccaacatagtgaaaccccatctctactaaaaatacaaaaattagccaggcgtggttggtggcaggcgcctgtagtcccagctactcgggaggctgagttaagaggatcacttgaacctgggaggcgttggttgcagtgagctgagatcgtgccactgcactgacagagagacaccgtctcggggaaaaaaaaaattgttgtttcagaagatacatagatgtttaaatggtctatgatttaggttgtttgtaatattcactgttcatattatttctgtctctgggcttaaaaaaatataaaagtaatatattcttattgtatgagaatgagacatacagataaagtagccatgtgtttttcttggttcaaagattagcagaaggaatgtataaagaagtgaaataaatttatgtgacaaatatttatgtattgcctactatattccatatagacatttggagggtgggcatagaagaaaacctatgcaaatccctgccttcagggtgcttttaggtagcatgcatgcagtggggccaagttgaaaatgcaaggtcagggttctgttccgaggcagcagcaatgctcccatctggccacaaggtggcggcctcatacagcagaagggcacttgtcacctccccaggagcctggcgtagatgggtgtggcctccctgatgactgactggaattctatgagattgcctatcgtagagtgggatgttttaaccctgtccctttggtatgttaacttacactagggttgcatacagctgtctggaacaagtgattatgaaattaccgtaatgcaagagagccgttttgggtggtcaaagttaattcccacaggtttttacacatgataaggcttgtagagatttcctgtctcttttaccatgtttgagtaatataccgtttaatagtagaagccaaatttaacagttaaatgcaaagaaaaaattttaaatcacaaatttcatctcagtttttcagtttgttcatttttgtctgtgaccataggtggtatttcatatgattgtagtgtgtatgtgtataaataatgtatttccatttaactttgttacaaataatgcaagtatgtagtttttaaagcatagtgcttcctagttgattttttggctgggattaggataaaatcaagaattccagtgaaagtcattgtggcacaatatttcttaaaagagcagaaaatgaaactgtgatttgagggagaggaaatagtccaaaggcactctgctctatttctgagaaccacttttttttttttttttttaagagatgggagtcttaccctggctggtctcgaactcctggcctcaagtgatcctcccacctcagctttccaaagtgctgtaattacacaggcataagccaccgagccgggcccctaagaaacgcattttatgagaagctttgccagccaattttatgatgtttagctggtctgaatatttacttttaggttctaatttttcttctaggacggggtctctagaaaatttagagactagcttgctttcttccttcctttttaacatttcctttagagctttggggatacacgtgtggttctaagcagtccccacaagtgtcttattctggcttcctcttgtcctctcagacccctagattcgaaagccctacccgcttctcgtttgtttgcagatagttgaggaagtgtctgtgagctttttctcctctagggtggagtaatgttccgttttccaggcgcctggctctttgaggctttctcactcatcgcaagtgacagtacaagaatgaaacagataaccagagttgccttgtgtttttctcagttcaaggattaggagagggaatgtgtaaagaagtgaaattccttcatgtgacaaatattaggtagctgccttccattactctccatttttttgctttttcacattcctgtggatgggttcccttgtttgctgttgctggtcatgtgttgcatgttcattttattttattggtgatgagagaccaggttatcgcccagaagtagttctcaaagtgtgggtcccagacaggcagcatgagtctcatctgggaacttgttagaaatgtaaattctcaggctcaccccagacgttccaaattggaaactgtggatggaacccagccgactctgtattatcaagtcctccagggattctgatgtacgctaaagtttgagaatcattgtcctaaagcatcgctactttaatcaaagaagttagaccattagctcttagcaccctcaaatcttggtatatgttggcataaaaactgatgatttcctagcttttgagatcaaacacttaaaaatttgtattatatatttgttttttcgagtgtcagtatttctgcaacataaaattttaaatttaaagttgatagtacttttgcttgatttattgacgtggatttttttgggatttttgttggctgttgttgactcatcaactaaatgagtgcggtggagaggaagtattacatagtttccactctttcactatagcattttctcatttttatcactgttctttccctcctccagtgcctactactgcagttgttcccattgagtcagtctgccagtgggtgacactagctttgtgaatcagcctgtgctggcgccgtgcactccctgagctgccttctgcttttcatggagtagcgacaagtctgtgccatgagacagtcgggcttctcagctctgccttccatcctttaaataacatgttttcttgaagccttgagtactagtctggcagtaaagtgaaaccttaaaaacacaaaacagaaaacaaccaaagtcctttgtgctgtgggctaaaaactgagatgaacttagagaacaggactgttagaatattggttattcaaggacaggctagaagtcaagaaatgcaaatattctcacctaagaaatcagtacacattttactaagtcaagactgggcaaaatagatgcttagggagagattagtgacttgaaatatcttgagtaattttatgtctttctcctagacctggaaaggaaagagcaagaattagagcagctgaaaatggattgtgagcactttaaagcccgcctggaaaccgtgcaggccgacaacataagagagaagaaggtaccatgctcagggacagactctcaccaagccagaaagtggggctggcttacagcctttcacttatgataagcagtgggactgaattttttactcttaatcctcaataaattgtatttgtaaatgtatgtattctgagtgggttggaatgtagttgaacagatggattttataaccatttaacacgtagatcattcacttggtatcttttaacttttatgtttaaaaatctgccctacaacataaaggttcataattatcttagttcattttgtgttgctataacaaaatatctgatactgagtaattaattttttttttcctttttttttttgagacagagtcttgctctgtcgcccaggctggagtgcagtggtgcaatctcggctcactgcaagctccgcctcctgggttcacgccattcccctgcctcagcctcccgagtagatgggacaggtggccgccaccacggccggctaagtttttgtatttttagtagagacggggtttcattgtgttagccaggatggtctcgatctccagacctcttgatctgcccgcctcagcctcccaaagggctgggattacaggcgtgagccatcacgcccggcgaggctgagtaatttataaagaaaagaggtttatttatgtcaagattttggtggctggaaggttcaagattgggcatctttttctggtgagggcctcaggctgcttcaaatcatgacagaaggggagctggctgtgtgacgagatcacatgatgagagaaagcaagagagagaaactgaggaagccagactctttaccaacctgctctcagggaaactaatccattcctgtgagagcaagaactcactcaccctccagagagcacattaatcgcttcatgaggaatccactcccatgacccatacacctctcactaggccccacctctcaagagtgccacattggggatcaaatttcaacatgagtttgcagggggacaaaccatagcgatgagagtctcggaggaaaaaatcatgtacataatatcttatagttggacatagatgtattaaatcagaagtacatgtaattaatttggggattattacattttagccagttatattttatataaatattagagaaactaatatttcttaaaaattgcttagtttaactttttgtgtggcataacttccttttccatagaactagaactattctgacactttttataaaatttggggcctggatatatttttattttggatgataatagtactaacaggccaggtacagtggctcaagcctgtaatcccagcactttgggaggccagggtgggcggttcgcttgcggtcaggagttcgagaccagcctggctgaggcaggagaattgcttgaacctgggaggtggaggttgcagtgagccgaaatcgtgccactgcactccagcctgggcaacagagcgagactctgtctcaaaaaaaaaaaaaaaaaaaaagaaaagaagccattccagtaaatgcatactgagaagaaggaaacagccatggtaaagtagcattgaaatcgctagggttttgttgccctggaactttgaccttaaaatgtgggaatattttacccaactattccctatttatagttaaaaatcttgttgaatagtccaatttaatatagagggaagcccctgcaaggtgaatacagagggaagcccctgcaaggtgaatgcagagggaagctcctgcaaggtgaatacagagggaagctcctgtaaggtgaatacagaggaaagctcctgcaaggttgctgtaacaaggccatttctcttctagcagctgccttatctgtagcctttgctgtagtctctgttgaggcctgtacggatcatgaggagggactctagaaacttattttatttatttatttattttttgagacagggtgttgctctgttgccaggctggagtgcagtggtgcaataatagttgcagtagcttcgacctcctgggcttaagcgatcctcctccttggcctccagagtggctgggactacagagatgtgccatgacatccagctaaatttaattaattaattaatttttattttttacaagaacaattctattgtataatttttaaaacaatttttaaaatttttttatagagatggggtctcactatgttgcccaagttggtcttcaactcctgggctcaagtgatcctcctgctttgggcctcccaaaatgctgggattacaggcatgggccactgcacctggccctggaaacttattatagaattgaggacccaggaaagaatccagagactagatcctcaattagattactgctagtaagtacttttttttttttttttttgagacagagtcttgctctgtcgtccaggctggagtgcagtggcacaatctcagctcactgcaacctccacctcctggatacctgggattacaggcacgtgccaccatgcctggctaatttttgtatttttagtagagatgaggtttcgccatgttggccaggctggtcttgaactcctgacctcaggtgatccatccactttggtctcccaaagtgctgggtttacaggcgtgagccaccgtgcctggctgctagtaagtacttctgtatgagtgaaaaattactaggaaaaggcagaagttattgagttcaatatgtaagaaaaggtcagaaacaaagtatggaacccaaatcataaagtgtgatgtatgagcaagcagcttctgaacccctagagaaaggctactcaaacaaggaagactttgttcctggccatggtggagatgtttcctccacagagattttgttgggtcagtggaggaggtgcactgggtcttgatacctgcttatgatgtgaggaggctgggccaggaaagagtcctggcagtagcaacgtttgaactttagaggaaaaagatcccagcttcctggtaaaggcacaactgttggagaatattggccgggcgcggtggctcacgcctgtaatcccagcactttgggaggctgaggtgggcggatcataaggtcaggagatcgagaccattctggctaacacggtgaaaccccgtttctactaaaaaaagaaaatacaaaaaattagccaggcgtggtggtgggcgcctgtagtcccagctactcgggaggctgaggcaggagaatggcgtgaacctgggaggcggagcttgcagtgagccaagaaacttttaaaagaaaaattgtagttaagctaaaatacagaatgaactacagaaagatattgaggaaatcttgggagttttgtgcttgataaactgttatgtatgagtattcctttaaacaggaaaatatatcagggtttgattattgtttctttaaaacagcattattgaggtatattttgtaccacaaaaatttttttgcattgtaattgtatagtttgatagtttttagtaaatttatacagcttttttttttttggttaaaattttttggtccaatcccactggaaacaaaaaaatttttttgtgtttacttatagattcactagaagtttcaaaaagtccagggaagttatctatacccttcacccggttttccctagtggtgatatcttgcgtaactatagtagaagataaaaaccaggaaattggaattggtacaattaacaactttcaggtttcaccagtttcacctggacttctttgtatttcatcaattctgtatgtactcatttgtgtgtgcatgtatgtacatagttctgtgcaattttatgacatttgtagattcatgtaaccaccaccacacttggaactgtaccattgccgtaaggctccttggtgctacccctttatagccacatccaccccattccctctgccttgcccctggcaatcactaatacattttccatctctaattttgttatctcaagaatgtcataacgtagaataaccttttgcgactgacttttccttgagacagagtctcactgtgtcacccaggcagtgacatgcagtggcaggatcatggctcacagcatccttgacctcctgggccaaagcagtcctcccatgtcagcctcccaagtagctaggtccacaggcacatgtcaccatgcccagctaatttttaattttttttgtagagacaggttcgctatgttactcaggctggtcttgaacccctgggctcagttgatcctttggccttgtcctcccaaagtgctgggattacaggcatgagccatgggtgcctggcagagactgactttcactcagatacatccaagttgcatgtatcgttagatatttttattgcctcatattccatggtatgtatatgttgcaatttgtttgcaatatgttgtaattcctccactgaaagaagtttgaatagttcttacggtttttttttctattactgataaagacactagtaacatccatgtataggtttttgtgtgaatgtgtgtctttatttttgtgtgataaatgcccgagagtacaattactgggttgtatggtaagtgcacatttagttttggaagaaattgccaaattgttttccagagtgtctgtaccattttagagtcccaccaaaatgtatgagtgattcactttctccatgtcctaaccagtatttggtgttattctattttgaattttagtcattttgataggtttgttgtggttttaatttgcatttccctaacagctaatgatgttgagcatcatttcatgcatttattttctgtctgtgtattctcttttatgaaatgtttttttcgtgtcttttacccatgttctaattggattttttctttttttacttttgcgtttgagctcttgatatattctagatagaagtcctttgctgagtatatgttttgcaagtcttttctcccagtctgtagctgctcttttcatcttcacaggttctttcaaaaagcgaatgttttaaattttaatgaagtccaatttactgatttctccttttatagactgttttcttgttgttatgtctaagaatttttcacatagctctaggtcaccacaattttctcccattcttttttcttaatggttttatagttttacattttacatttaagtctatgattcattttgagttaatttttgtagaaggtatgaggattaagttcaagttaatatttttttctttggcttatcgttgtccagttgcttcagcactgtttctcaaaaagactctctctccttcattgaattgcttttgcaccattgtcaaaattcagtcatactggcctgggtctgttgtgggttctctactcaggtactttgatctgttcctgcaccaataatacattattctgattactgtagcgacatagtaagccttaacactggataaaatgattcttcccatttcattcctctttttcagagttgccctaactattctagcttctttgcttttccgcataaattttagagtaagcttgtttatgtctacaaaaaccttgctggaattttaatagaaattgtggtacgtttgtagatcagtttgtagagaattgatatctttactatgttgaatctttcaattcataaacatagcatgtctctccatttctttaagttgtctttaatttctttcatcagcagtttacaattattttcagcatctagatttgtgttagatttttacctaattattttcagcatacacatttgtattagatttttacctaagtatttaattttatttggagtaaccgtaaatggtattgtgtttttaattttggtttccattttttaattagcacatagaaatgtggttgctttttgtttgtttatcttgtcccccaggctggagtgcagtggtgtgatcgcagctcactacaacctctgcctctcaggttcaggcaattttcctgcctcagcctcacgagtagctgggattacagatgtgcgccaccatgcctgggtaatttttgtatttttagtacagacacagttttaccatgttggccaggctggtctcgaattcctgacctcaagtgatccgcctgccttggtctcttggtgctgggattacaggtgtgagccaccgcacccggcccctgtagtctttctgaactctttttgacttctaggagttcttttatggatttcttgagattttctacatggacaatcatgtcatctgaaaataggggctgttctagttcttcattctgctttgtataccttttatttcttcctctttccttcttgcgtagccaggccttccagcactacagcactgtgctgaataagagtggtgagagtggatatctttgccttgttcctgatctcaggggaaagtattcaatctttcagcgttaattatgattttagctgtaggtttttgcagatgcgtttataaaattgagaaggttcccctctattcctagtttgctgagttccttttttctttcttttttttttttccagagacagggcctcactctgtagcccaggctggagtgcagtagtgtgatcaaagctcactgcagccttgaactcctgggcccaaaggatccaattgcctgaacctcctgagtctataggcatatgccaccatacagctaattttttttttttttaagtttttgtagagatagggtcttgctgtgttgccaaggctggtctccaagttctctctcttgtcaagtgaacctcccaccttggttccttaaaatgctgggattacaggcatgagccactgggcctgactgagaatttttatttatttatttatttatttatttttataattactgagtgttggattttgtccaatcaacttttagaacatttccatcacatatctgttgcaattagtccctgctctcttgcacagccccaggcaaacactgatctttctgtctctttagatttccttttctgaatattttgtaggaacagaattatataatatgtgtataatatgtagtcttctgtgtctggcataatgttttgaaggtttatttgtgttatagcatacatcatttattcttttttattgcaaaacaatattccattggatggatatatcacattttcttcatccattcaccagttgatgggcatttagattgtttccagttttctttttttcttttttattttatagatgcagggtttcgccatgttggccaggctggtctcgaactcctggccccaagtgatctgcccgccttggccttccaaagtgctgggattataggcgtgagccacttcgctcgtcctgttccagtttttgactgttatgaataatgccactataaacatttgtgtacaggtttttctgcggtcgtatgttttcatttttctttatttcttttttttttttttttttttgttttgagacggggtttcgctctcgcccaggctggagtgtagtggtgtgatctccgcttactgcagcctccacctcccaggttcaagcaattcttctgcctcagcctcctgagcagctgggattacaggcttacgccaccacacccagctaatttttgtatttttattagagacagggtttcaccatgttggccagactggtcctaaactcctgacctcaagtgatccgcctgcctcggcctctcaaagtgctgggattaccatcgcgcccggacacatttatatgttttctttggttaaatatctcttcaaatcttttgcccatttttaattgggttgtcttattgatgtgtaagaattctttaatctggacacaagtccttttttagatatgtgattagaagtactttctcttagcctgtggcgtgtctttttactttctttataaggtatcttttgaagagtagaacttttaagttttgatgaaacttactttattattattttttaataggtcatgattttgtgatatctaagaaatatttgcctaacctatggtcataacgatttttttgagaaattttacatttatgtttatgattctctttttttccccttcgttttttcttttcttttcttttcttttcttttcttttcttttcttttcttttcttttcttttcttttctttcttttttttctttcttgagatggtgtcttgctctgtcacctaggctggagtgtagtggtgtgatcatggctcacttcagcttcgaccttccaggctcaagtgatcctacttcagcctcaccatgcctggctatttaaaaaaaatttttttttttttttgtagagatggggtctcactatggtgcccaggatggtctcgatcctcccgtctcagcctcccaaggtacaattagccactgtgcctggcctatgattctgtttttttttttttttttttgagatggagtctcgctctgtcacccaggctggagtgcagtggcacgatctcggctcactgcagtcgccccctcctgggttcaagcgattctcctgcctcagcctcccgagtaggtgggattataggtgggattacaggcccgtgccaccatgctcaactaacttttgtatttttagtagagacggggttttaccatgttggtcaggctagtcttgaactcctgacctcaagcaatccacccacctcagcctcccagaatgctaggattgtaggtgtgagccaccgcacccggccctatgattcattttgaattattttttttttgcatatgaatattcggttgttttagcatcagttgttgaaaagactatcctttttccattgaattgcattggcacctttgttaaaatcagttgacatgtcagtgtttcactgatctatatgtccatccttatagcaataccacaatggttctatttcggtaggtttatagttagttttttcctctaaatcaggcactgttagtcttctaacattgttcttctttttcagacaattttttagatattctgtcttgaatttccatagaaattttagaatcagattatcactttgtacagaagtctgctgagattttgatagggattgtgttgaatctgtagatcagtttgggaagaattgacatcctgccaatttttgaacatggtgtatctctttatttagctctactttctctcagtaatgctttgtagttttcattgtataggtcttgcaccttaaaaaattattcttatttttgatgttactgggaatgctatgattttctttgaggtttgtttgttttttttttgatattattatactatgtgtggaaccctgcgttggggaatatcctcctgcaactaccaaatgtgactgtagtgagcaaagtccttcctggttcttctcagtagtctttttgtggtcgtgcagaagaaccaccatatcctgactaattgagatgcagacagcttaagttgtgagaaaagctagaattccaaaaggaagtgctgtgacatagttttcttcatgtgtcaccatgacttgtgttcagctacgtacactgaaaggatgaatctaggagtccagattgttgctataatgaagacattaaaaacccggagctgacagatcacatgatgcagtattagcatgtgccagaggctcagtggccatttttttcttaaatacatgtgtgcatatacgtatgaatgtgtatgaatctctgtgtgccaaacgcattgtctccaggtaactatgagtgggccaccctaatccaagttatgaggtcaacagttttgatttgtggctccaaagctccctttttcctccagggggtgaaaagccccctctactttgtcttgtatttatctctctaaaagaaaatctacagcatttaatatactttaattttgtggtttatgtaactaattacatttggtataaatgaatttaactggggttttatatttttcagtttttgtcttattaaatcaggaaatgctatcaccttttaagggaatttcaggtacctggtgctggtggttggagaggacaggaagccccccatcactctagcagtacactcaaggtgaatcctcgaagtgtgcttgtgttgtcaggagggccatcaggacggccattccctgtgtttcccttgtgaagagtgccatggtggagacttgcccagctacaggtcacctcagacactgctggtgggagagtaggaaactcttcctagcctccatcttcttcttagactggcactggcttgctgcaccagggcatgaataggactcccagccttcacacttctttttgcccctcctcccatctttcctacctggtcttaggttttaggttttctttccctgtttagcttcacagattgtattttatatttactggcacctttggcaatattctcatgaggagttaaggatacgtttatacaggatgagtttttctaaagtacttgtttttttacaaatcctgatgtccaagtgccttttatttggtgtctgcctctggcagatggcgttttttcaatggagtgagccatttggaggaggcagtctcctgtcttagaaatgttgctttctgggtaaattgctttgtgaggttgtttttgttcagaagcctcggttggtgctggttctgggtatagttacttggggcttgagatatttcatgtagttacttaaagcagatgaattcagctctgtgggtttatcaaccataatgtggtagtatgttctttcctcagatatttctcaaatatttttgcctttgaaatttcttttgtagatacagattatggttctcttaggactagctttcatttgcaactattttctataattatacatgcatttctttaataaatatctttgtgaaagaggaaatgtaataaagatatatcaaggttgaatgctattatttatttttcaattttgttttgcttttaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagtaagtatggtcagtgggctctccagatattgttgattactgcttgtgtaaattagagcatatagcttattaaggcatttaaagactaagtccatatctttccattttcttttgttcactcatcagctagttattgaatacttatcgtatatggttcattgtaacctgatgcaaagggaatgaaataagatcccttctctccaggagaccttgtggtatatgtggacatattaccacttcagtattaatactttacatgtgtttaagaagatcaaaagtgcttttatatatattatctcatggttaatatagtatttattgaatattgtgttatctaacatatatacatgtatgtagatgtgtgtgtgtgtttatacatacacacacacacacatacatatagatgcagaaccttgagcaacatggaggttggaggcgctgaccccctgcacagtcgaaaagccacatagaacttttgactctctctactgttggctggaagccttactgacaacataaatcgttgattaacacattttttgtatgttagatcatcatgaaggtcttccccctcatcatcttcaaattgagtaggctgaagaggaggaggaagaggagtggttgggttggcattgctgtctaaagggtggtagaggtggaggaggtggaaggggaggctggagcagcagacacacttggtgtaacttttactgaagaaaattcttgtgtaagtggacctgtgcagttcaaacccttgttttcaaggttcaactgtgtgtgtgtgtggcagcgtgtgtgtgtgagcatgtgtgtttgagcatgtgcatgtgtgtgtgactgtgtgtgtgtgtgggagcatgtgtgtgtgggggagtgtgtgtgtgtggggggggagcgtgtgtgtgtgggagcgtgtgtgtatgggagcatgtgtgtgtgggggagtgtgtgtgtgggagcgtgtgtgtgtatgtgggagcctgtgtgtgtgtgtggggggagcgtgtgtgtgggggagtgtgtgtgtgtgtgtgtgagcctgtgtatgtgggatcgtatgtgtgtttgtgtgggggagcatgtgtgtgtgtgggggagcgtgtgtgtgtgagactgtgtgagtgtgtgtgtgggagcgtgtgtgtgtttgggggagcgtgtgtggggggggagcgtgtgtgtgtgtgggagcatgtgtgtgtatgtgggagcctgtgtgtgtgggagtgtgtgtgtggggagcgtgtgtggggggggagtgtgtgtgcctgtgagcctgtgtatgtgggatcgtgtgtgtgggagcgtgtgggtgtgtgggagcatgtgtgtgtgtgggagcgtgcacacgcacatgtatgcatgcgtgcaggcatttgtcagggaacttcacagaaggggataaatttgaaatgggccttgatgaataggtagaaatggcagaaaatgggtgggtttgttttaggacagtgagtaggtcagttgacacagtggagagttaatgtcatagagtagtggggaggtaaagcttaaacgtaggttgggatgtgactttgggaccttgaataccaggttggtgattcattctgtaggtgggaagactggattttccctaagggtttttcaataaaagtgataggataagagcagaattttagaaagattcacctgacagtgggtgaggatggattaggaggtggagttgtggcacatcgcgtctacacaggatgactgatgaggtggtcattctagctggtctggctggagtgagctcggccctctgcaggggagatgggaaagaaggaacatgtatgagagctgtggcagttgaggcagatgcgatggccgggcagagtgggcacctggaggggacaagaggagccaaaaaagatcggtgtttgactctgggagcatggcgtgatcatgactggaaatgaaggtgaagagggggacgtgtggcaggaaaccagtgagaaattagttactgctaatagaaataacagttgtgtttgactttaggtggaaagactaaatgtgtttttaaaagtttgttgagctttattaggtttaatttacatactgtaagattgtaaatgtacaatttagtggtttttagcaaatttttagagttgcattaaccatcaccacaacccagttttagattatttgatcatccatgaagttttcttatatcatttgtaaatgcaaatatttccaattttttaactgggttaaaatgtacattggttttaaaattcttcttcagaactctagcaccccaaaggaagtaactcaaaggttcaaacttggaaatgctttttgccaagtgatgaagatttaaactaccagaggagccagtctttacctcttttacatgttttcattaagatttttttttttgaaaaaagttatgctaaaggtttgaacacctctggtttaatgcccagagcaaataggcagcatgtttttctagtatatttttattacattttgagtgaattcttcccatttactttcatcatcatgtacatttgtcctatatcatatttatgcgtgtgaagagtccaccaatcttcagggtagtttttgttgctcctgcatgcctcaagctgctttctctgttcttttaatgggaacttttaatgagggaatagattttacaatattctacaattaaaactagaatcttctgtatcctgcacttttaaaatgttttcacactagtgtctgtaaaaagatatgacactctgattttcaaactttcaggataaagctttgaagtttttcagcatcactggtcaaacaatggagagttttgtgaagtcgttagacggtgatgtccaggagctggattcggatgaaagtcagtttgttttcgctctggctggaattgtcacgagtaagtgcaggcgcacctgagagatgttgcctgtttgcttccagaccactgcagtaaagcaaatactgcaataatacatgagtcacatgaatgtttttggtttcccagtgcatatacaaattatgtttacactatactgtagtctgttgtatgtacaatagcattatgtctaaaaaatgtacaaactttaattagaaaattcattattgctaaaaatgctaatgatcatctgagccttcagcaagttacaattttttgctggtagagggtcttgccgtgatattgatgactgctaactgatcagggtggtagttactgaaggttggggtggctgtgccaatttcttaaaataaggaacaatgaagtttgccacattgattaattcttcctttcatgtaagatttctcagtagcatgtgatgctgtttgatagcattttttccacagtagaacatctttcaaaattggagtcagccctctcaaaccttactgctgctttgtcaactaagtttatgtaatattctgaatctcttgttcttatttcaacaatgtcttagcatcttcaccaagagtagattccatctcaagaaaccactttctttgttcttccataagaagcaacttatcctttttttctgccaccacgtctgtagttacttactccactgaagtcatgaacccttcaaagtcatccatgaggattgaaatcaacttcttccgaactcctgttaatgttgttattttgacctcctcccatgaatcatgaatattctcttgttgcccaggctggagtgcaacggcgtgatctcggctcactgcagcctccacatcctgtatttaagtgattctcctgcctcagcctcccaagtagctgggattacaggcatgcgccaccatgcccagctaattttgtatttttagtagagatggggtttctccatgttggccaggctggtcttgaactcctgacctcaggtgatctgcccacctcagcctcccaaagtgctgggattataggcatgagccactgcgcttggctgaatcatgaatattcttaatggcatctagaatggtgaatcctttttagaaggttttcagtttacttcacccagatccatcagaggaatcactgtctatggcagctgtagcgttatgaaatgtagttcttaaaaaaaataggacttgaaagttgaaatttctttttgatatatgagctgaagaataggtattgtattagcaggcatggagtcaacattactttccttgtacctctccatcatggctcttgattgaccaggtgcattgtcaatgaacagtagtgttttgaaagaaatctttttttctgagcagtaggtctcaacagtgggctgaaaatattcagtaaaccatgctggaaacaggtgtgctgtcatccaggctttgtttttctatttctagagcataggcaagagtagatttagcataattcttaagggctctaggattttcagaatggttaaatgagcattggcttcaattaaagtcacccgcaccattggcccctaacaagagagtcagcctgtcttttgatgctttgaagccaggcattgacttttctctagcggtgaaagtcctagatggcgtcttcttccaatagaaagcgactttgtctacattgaaaatctcttgtttagtgtaaccaccctcggcagtgatcttagctagatcttctggataacttgctgcagcttctccatcagcacttgctgctgcacgttgtttttatgttatggagacaacttctttccttaaacctcatgaagcaacctgtactagcttccagcttttcttctgcagcttccttacccctgtcagccttcacagaattgaagagcattggggcttttctctgaattaggctttggcttaagggatttttgatgatttttgatcttctgtctagaatacttgggctttctccatatcagcaataaggctgttttgcgttcttatcattcatgtgttcactggaatagagcttttaatttctatcgagaactttgcatttgcagtcataacttggctgtttggcacaagaggtctaactttcagcaggtctcagctttggccatgccttcactaagcttaatcatttctagcttttgctttcagatatgtatcttttccttttgcttgaacatttagaggtcattgtagggttattaactgtccgaatttcagtattgttgtgtctcagggaatagcaagttcctaggagagggagagaaacgggaatggccagtcattggaaaaatcagaagataagtagcatgtattgattaaatttgctgtcttacatgggtgtggctcatggtgccctaaaacaattacagtggtaacatcaaagatcattgatcacagatgaccataacagatgtaataataatgaaaaagtttcaactattgcaagaattaccaaaatgtgacacagagacatgaattaagcacacactgttggaaaaatggcaccaacagacttgctcaatgtagggttgccacattccttcaatttgtaaaaaaacagtatctgcaaagcacaataaagtgaatgcaataaaacgaaatgtgcctgtaattcttttcagctgtagtgactgttacagagactggtgtttacagtcagggttgagagtgtgtaaacatctctcaggagtgttttcagatattaatgctggggagcaccctggataatctgattccatagttctgggataggtaccgggtatgtttattttggaaaatcaccccaggtgattctgataagtatcagttattaagaatgaatgatctgaaggaaacagatgagtttgcatgttctgtgtagttatgtaccttgacagaaaaaaacaagtaagtttagctgcttttattcagaatcataattttactgtctggctagctaaagtaaaagccttaagctaagcttaagctgagctctttgctgttgttttagtataataattatataattccaaaaacctaaattgcctcttcagtaaaattctcctaaaagataataaagtaaacctttccctgagagttatgataaaattccgtctcagaactatcataagggataaagtccaggaactaaataatttctcagtatagaagcaaggcatggtggcttacgcctgtaatcccagcattttgggaggcttgaggcgggtggatcatttgaagtcaggaagaattcgagaccagcctggccaacatggggaaacctgtctttattaaaatacaaaaaaattagccaggcgtggtggcgcacacctgtaatcccagctactcagtaggctgaggcaggagaattgcttgaacctgggaggtggaggttgtagtgagctgagatcgtgccactacactccaccctgggtgacagagcaagactccgtctcttaaaaaaaaaaaaaaaatttcttggtatagaaagaggtggaatgtactagtgagtattgaggctctttgttctgaagtcagtgaaatggttcaatacattgctgtgacttatcagccttaacgagattcagaaaatatgactaagtacagagtttatttgtgcacagagcttgacggtggccactcagaaacaccaacttcaaaccagtggggtcagggttccaaagtgaagaagatatcactgatataggcagagacagagaagttccagcaggattagaacattttccatacaagaccagtgtgtgtgccacagtgatttgactgtttatagattgctacattccaaggagggttatctgaggaagtcttatcttcagcagtttggtcttaattatttacaggaaagaaaaatgcagaatttgcagccgcatatctacattcctcacaatggttgggataatttaaagtcccaacagctttaagtttgaattatttaatttcagacttttttttttacattgatctttaatctctgctttatttgctttattattttcccatgctgttcttaggaaaattctctgctgttaaagtgagagaaaattttatttttcttttggtgttattcttttattgaaatcctaatggggtaggtctgtgtagacatttgtttcttaatcctttaaaacttgatgatagttcttgcggggtggatgctgagactgtgatgttttctggctattccttactccagtgcagggcagcattctatacgttcatcatggcacctacagttgtagcaggcttgcattgccctccctttaaaaacattgtttgaaggttgtcttttaacagaaggcatttgcaaattaaataatttgcgttttcttctctttgcaagtgaccccaaaggcgtatgacctatgtgacttgtcatgttgctggttgtgaatctgagctgcctgaattgctggctgacatgctggtgaggcagtgggctgtgagtgaagccgccctgttgcccagcattcaagctcagcgcggctgttttcctgtgtttgtggtggtttacataggaactcttatgaagagttggatagtgggcacttatatttgcatgttaatgaatttgactgggaagaatattttattaaagtgctgatttgcagaggcttgggggcttatgagtctcaaataccaagactatcctgtggggataggtaatagagaccatgggttagctctcaaatggatccttttccttctgaaacaaatgttctttttaaaattttacatacagtgaattcattctttagtttttttttttaaacctttttgcagttctgtaaatttctacaaaagtatacagtcatttacccaccacaattaggttgtggaactaattccttcccccagacttcctgcacgccatccttctgtagtccagttctccactcatcaccagcccaaggcaaccactgattttgtgatttgttcagtattttagctggggtttttttattttttattttttttgctgccttgtatggtgtccagcatatgccccaggtgagcaagtgcttgcttcatgtatctgcttggaggctgttgtctttcgtcatttttcagattggttggctgatgtccagccttagctctctaatgtgttcaagaagacctgtgattttggtaaattatctctccctctgcccccggaaagaatggggtagctgttaccagttttctgtatcctaagctaaagctggaaatcagaaatttatttaaaccttgaaattgttaaatttctactcaactgtagtcactgttctttaatgataggttagtgtagtgcagaggtttggctcagtgaatctacttcccaggatgtcagttctctggacatctgtaaggtggaatagtaacatctgctcttattactttacatattgtgaattttctactgaaccgtagtaaatgatagcacattgatatcaatgtgattgtttccagtaacttggataagagggcaaatgaagagtgtgaaagagacggaaatcttcacagtcctgtgaagattaactgcttaacttcctagtgaaatcttttaaatgctttttctgcttttcagtgatttgaaaatcatgattgtactccttgtctctggtttatgtattcaaataatgttagataataattgcagcatcaaaattactttttgatgattgataatttgggggcaggactggatccagcttagtcttccagggaccttcctagttacacaaagttaccagcagagcacctttgtgtcagtgaccgtggctgctcttggcctgccaatccctcctcctccacacgctcacaccaacacatggaggcagtgtggcgtgcagaaaaggccaggtggggcttgaggcctcatgtccattgctgcttctgccactgactaaccctgtattcttgaatatatgaccttcggtttttgtcttctgagaagagtctgacactagatgacaattatggtatcccagtcctagaattgtgtgactctgcatgtggaagaataaggtgccagttttgagcttaaacttactggtcttctgttgtcagagtctaagtcagcagtgaagggtcaataaacaggcatttgggttgtttccaccttttgactgttatggataatgctgatacgagcatttgtgcagaagtttatgtgtggatgtatgtttcagtttttctgggtatctacctcggggtggaatagcagggtgtagtaactctgtttagctttttgaggaactgccagacaggtttccacagtgactgtaccattttatgtgctggtggctccctttccccatgtcttcagaacagcccatctttttctaggtgtgcaggagtccttgttgctgtttttggttctttgagcacccatttgtttctcatgtaccttgatctctaggagagatcattagcattgtcctgtttcccccattgtggttgaacctcctgaaaggtgaggttagtttggagagagttgatttacaacttgagcactgatcaacattattttttcgtcttttttttgcggaatcacctgttgaatcatctgtcaggacaatagctgaacagaaacttttaatgcaacaggtagcaaacaaatataatttgaggcactataagaaggaagaccactctggaaccttgacccaggtgacttcatcaccagccttgtattgactctgtacttttaagatgagaccctcttaacaaacagcataaagtcaggctttggtatgggagtgtcgtctacaagatctcttctgggcatggacacttgttggactacggagataaccttgaggctctcgaggtttcattaattttctgcattttttagttttaatttcatgtatttatggtctgatctttattatttctttccttctagtatttttgagtttagtttgttcttttctatttccttggtgcatcattagattgtttatttggagtcattctacttttttgatacaggcatttattgctataaacttccctcttagtatcgcttttgccatgtcctagagattttggtatgttgtttttccattttcatttgtttcaagaaaattttaaatttcttcccaattttttcattgacgcatttggttgttcaggtgtatgttgtttaatttccatgtgtttatatagtttctgagggtcctcttgctattaatttctagttttattgtattgtggtcagaaaagatacctgagctgggcatagtggcccatgcctgtaatcctagcactatgagagactcaggtgggaggactgcttgaggtcaggagtttcagacgagcctgggcacatggcaagatcctatctctacgaaaaaaaaaaaaaagctgtttgatatgattctactttttgaatttgttgagacttgttttgtggtataagatgttgtctgtaatggagaatgttccatatgctgatgaaaagaatgtatattctgtaacagttgggtgaaatgttctgtaaagattcaggtctatttggtctagtgtgtagtttacctctgatgtttctttgttgatttttttttggtctggaccatccggccattactgagagtggaatgttgaagtctctactgttattgtactgcagtcaatttctccctttagatttattaatgattgatttatatacttggataatgctgtgttgggtgcatagatatttacaattgttatatcctctagctgagttggtccatttttcattatatagtgacttggtctcttttcacagtctttgacttgtagtctattttgtctgatatagatgtagctactcctgttttttttggtttccagttgcatagatatctttttccacccttcactttcagtctgtatgtgcctttatgggtgaagtgggtttcttgtaggcagcatgtagttaagtcttgtttctttccattcagccactccatatttcttttaattagaaaattgaatctgtttatattcaatgttactatcgataagtaaggacttattactgctaatttgttgcttgtttcctggttgttttgtaactcctcttcttttttcttgctttcttactgtcatcctttatggttaagtgattttctctggtgtgttttagttcattgctttttatttttagtgcatctattacagatttttgctttgtggttaccatgaggcttacaaaaaaatctttagatataacaggttattttaaagagatgacttatctttgatcacaaaaaataatagaaacaaagaaaaaactaaaaatacccctatactttaactccatcccccatattttgactttttgttatctcaatttacgtgtttatattacctgtcttttaataggtcgctgtagctctgattgtttctgtttctaggcttcacactagagttttgcatggattgcacatcatgagtacagtattagagtattctggggttgtctgtgtaccagtgtgttttatatttattttatatattatttaagtatttctttttccagtgggttttataccctcaatttttttctttctgcatgttagtgtgtttttctttcagtttgaggaacttcctttagcatttcttctaagataggtctggttggtgttaaattctctcagtgtttgtttgggaaagactttattagtccttcatatttgaaggatggctttgctggatacgatattcttatatagtgttttctttctttcagaaccttgaaaatatcatcccactccttcctggcctatatggtttcttcttcttcttttttttttttctgagacagaatcttgctctcttgcccaggctggagtgcagtggcacagtctcggctcactgcagccttccactcccaggttcaagtgattctcttgccttagcctcctgagtagctgagaccacaggcatgtgccaccacgcctggctaatttctgttttcttagtggagacagggtttcaccatgttggccagactggtctcaaactcctaacctcaagtgatctgcctgccttggcctccctaagtgctgggattacaggcatgagctactgtgcccagcctggcttgtatagtttctgttgagaagtctgtcaccagatgaattggagttcctttgttacttgtttcttttcttttgctgtttttaagtttctctctttatttctgaatgttgagagtttgattagtatataccttggggtacactcatttaagttgactctggtgttctgtggttttcctgtagctggatatttatatcttaagttttggaagttttctgttatttctttgaataagctttctaccccttattgttgctcatcaccttgttgaacaccataattcttagattgggtcttttgaggtaattttctgtatcttgtaggtgatcttcattcctttggttttttctttttctcctctctgtgtttttgatagcttgtctctgagctcagtgattctctgcttgatccattccgctgttgagagcctcaaattaatttttcagttcagcaaatgtgtttctcagttccaggatttctgtttgatggtgatgatgatggtgatgatggtgatgatgatgatgatgatgatgatgttgattttttagagatgggatcttgctctgttacccaggctggagtctggtggtacaattctagctcactgcaacctcgaactcctgggctcaagcagtgcttccacctcagcctcctgagtaggtaagactacaggcgatcaccacagtgcttggctaattttttatgttttttgtagagatggggtcttgctgtgttgctgaggctgttctcaaactcctggccccaaggcccctatctcagccttccacagtgttgggattacagtcatgagccactgtgcccagcagtttgattgttttaagtttcaatctctttattaaatttctctgacaaatttccgaattacttttctatgttatcttggagatgactgaatttccttaaaactactattttgaattcttggtcagagagctcatatattgccatcttgttagagacagtcactggttccttgctttgtctgtttggggaggccgtggttccctgtttcctgttgtttcttatggatatatgtctatgtctttgcattgaaagagtatttattccagtcttgtctgtctgggttattttgttttttattggatatgtttacttagagattctttgtaatttacttgttgaatttcttcctttttttctgctaggttgctgcctctttataggcactagatggtgccttaagcccaggtttaccttggctctagggaaccatcagagtattgcccatcccgaatgggggaggtcacaaagaggataacccggcagtgtgggaatactggcaaggcgtctgtgcccaggggacctgtgggacataccttctactgtgtgcatctgctgaacagccgctctgatttggtgtcttctctggccaagttacagagcagcgtttccagggctgggaatagtagttctgcttccccactttgcctctggctatcctcagggatagtttcccttcaggtacttacagtggttcccatgggttgaagcagggacaggtcttctgccagggaacctaagatggtgggacagtagttgttcacctccatctgctttttccagtgtagcaactgagttgtggaaattttcctcacgcttggtgctgggcacattatggagacgggtgtcacaggtatgaaagtccagttgtcttactgtctgttcagagttttttcacttgtctgttgccgtgagagctgtctgagcctcatatttagagttctgggatattgctgctgataatcttggagctgctgtatgttcgtttttggttttcttttgggaggcagtgaagccaacttgcttctatgccaccatttggaactagaaactccttgttgcccatattttaattgggttattttcctttctgttactgagttgtaagaggtatttgtaatatactagtaccttatcagagatatgattttgaaatacagccatacctcagagataccgtaggtttggttccagattactgcagtaaagcaaatagcacaataaagtgagtcacatgaattttttggtttcccagcatatataaaagttgtgtttacagtgtactttagtctgttaagtatgaaattagctgggtgtggcggtgcaggcctgtagtcccagctactcaggaggttgagggtgcagtgagctgcgattgtgccactgcactccagcccaggtgacagcgtaagattcaaaaaaataaataaagaattttatagctttaattttttcttttttttttttctttttttgagacggagtcttgctctgtcgctcaggctggagtgcagcagtgcgatctccactcactgcaagctctgcctcccgggttcacgccattcttttgcctcagcatcctgagtagctgggactaaggcacctgccaccgcgcctggctaattttttttttttttttgtatttttagtagagacggggtttcaccatactagccaggatggtcttgatctcctgacctcgtgatctgcccgcctcagcctcccaaagtactgggattacaggcgtgagccactgcgcccggccagctttaattcttatattcagatctttgatccattttgagttaatatttgtatatggtgtgtggtaggtattcaacttccttcctttgcatgtggatatccagttgttttagcaccatttgttcaaaagattattcttttatcatttctccattgatttgtcttggcacctttgttggaattcagttgaccataaatgtgaggatttatttctgtactctcaattctaccattgatttatatgtctatcattctgccaataccctattattactttttttgctcaaaataagatgaaactattacagtctaaagcaaaagtatcagacatagtacgtctcaactctgtatatccttttcagcacaaataattgacaccagattctttttttttttaaatggggtctcactttaattgcccaggctggagtacagtggcctgatcataattcgctgtagcctcaaactcccgggttcaagcaatcctcccacctcagcctgggtagctgggactataggcatgagccaccacacctagctaatttttatttttatttttgtagagatggggtctcattatgttgcctaagactcatctcaaacttctagactcaagtgatcctcctaccttggcctccaaaagtattgggattataggtgtgagccactatgcttggcccagatttatttccttttttgtttgagactgagttttgctctgttgcccaggctggagtgcagtggcaccatctcagctcactgcagcctctgcctcccgggttcaagtgattcttctgcctcagcctcttgagtagatgggattacaggtgcatgccaccacacctggctaatttttgtatttttagtagagatggggtttctccatgttggccaggctggtctcaaactcttgacctcaggtgatccacccgccttggcctctgaaagtactgggattacaggtgggagccaccgtacctggccccatttcttgaattatgtaattactatactaatctctagaattacctataagcacttttaatgaaaaatgaacctagaaaaatcattttaacagaaaaattaactggcagttttttagttttggtagatggtaacaaagtcaattctgtaggccttgaattgactcacaggcattctagatagattaaatatcagtaagcaaagtacaaattaccatgtaaaacaaagaaattccaacagattgacaaatactgaagctgtgtaggaatttattcacatttattttactttgtagttcatgttttagtgatatttaatgaaatgcagcattggcatttgcagttaaaatactagatatatgatacagacttcatttaccagtacatttgttgtgttgggcattgttgcttgctatgagatacatatatatatattttttttcttcagcgatgtattagtaatgtttctattttctattgctgtgtaacaaacctcctcaaaatataaagtcttaacatttatcttgctcgtgggtctacagtttggtcaggcttggcagggacagtttgctgcttctgctctccaacatctggggccttagctgggatgactcaaatcgttgagggatggaacagctgggggctagtggggtgtctttctctctcttctttcctcatagagtctcaaggcttcttcactgtgctatttcttatcctttttttccttttttcttttttttttgagatggagtcttgctctatcacccaggctggagtgcaatggtgtgatctcagctcactgcaaactctgcctcccaggttcacaccattctcctgcctcagcatctggagtagctgggactacaggcacctgccaccgcgcccggctaattttttgtatttttagtagagacggtttcatcatgttagccaggatgatcttgatctccagaccgcgtgatccgcccacctcggcctcccaaagtgctgggattacaggcgtgagccaccgtgttttttcttttttttaaagacagagtttcgctctgtctcctaggctggagtgcagtagtgcaatctcggcttactgcagcatccacctcctgggttcaaatgattctcctgccttagcctcccaagtaactaggattacgggtgtaagccacgacgcctggctaatttcgtatttttagtagagacagggttttgccatgttggccaggctcatctcaaactcctgacctcaggtgattcacccaccttggccttccaaagtgctgggattactggcgtgagccaccacatctggccttcactgtgctatttctgtgtggtctcttcatcatggcagccttagggtagctggactctttcatagtgactcagggatcctagagcaagtggcaggagaccaaagtggaaatcttaaggcttcttcctgtccatccttggaaggctcatggtgtgcattctgctgcgttctacttgttacaagtgagtcgcagtgtaggtgactactcaagggtctgaacatgaggccaggcccacctggtagccatctctggagtcaggctaccaaatagttctatgttgcttgctatgatatatatatatatatattttttttttttcttcagcgatgtattagtaatgtttctattttctattgctgtgtaacaaacctcctcaaaatataaagtcttaacatttatcttgatcatgggtctacagtttggtcaggtttggcagggacagtttgctgttgctgctctccaacatctgggtttctgctgggtttcagtatattatctgaagttatttacatgaataatgctttcccctgaaaagctacctaaaagctatcttttatgtgtttctgatgccaaatgcttacttgctttgtttttctcctaaaatatttccttagtaaaactagaatgtgtcatattctggaaaatgtacctatcaggttaaaattcattgaccaaagaaggtaagtttatgtcattgaaaggttctgtcaataaagttatggctgtcatcaaagcgtgtacttgaagacactgcaccaatgatatagttaaaatgctgcaaagacaagtagaaagggggaaacatctgttaggtttagtagactttactatccctcttgtggtccatctgagaccaggtgaacaaaagtaaatagtaatgtcaaagatctgagttcatgaagctggccgggtaacatgaaattttatattctgccatcagattacatccagtcaaaggcagaagaaataagtgataaaattcagcttccatttttgataattcttagcaagccaaaaatagaagaagacttctttaaactgataaagggtatctaccagaaacagatcagacatcacacttaactgtgaatttttagaagcgtttccattaaaatcaggagcaaggcagtgctgctgccccatctcttttccaccttggtctcgtcatttggcttagaaatcttagtcagtttgaatcatgctttactgtcagacccaactaaagaaaactcttaacaaacacatacataaatgcacttggatcattggatacttcgaggtatttggaaatgttgatggagccagtaatggctgcagcactgcccattgggagcagtgtaattactcggtctggtcttcaggccgattcgcagggcctcaggcatgaagaaatgggatacttgctgttccacaatgggacataaaattgagaaaataagttttcttcaaaatccattttcatactcttttttgactacatataatttcagtttgtatcatggctaaaagttattagcaaatatagattgaatattccttatctgaaatgcccgggaccagaagtgttttggattttggaatacttgcattatacctactggttcaacactctaattcaaaaatctgaaatctgcaatgctctgtgagcatgacctttgtgcatctttgtcagtgctcaaaaatttttagattttggagcattttggattttgggttttcagattacggatgccattaaaagtgaattttcacatcctcagtcccagataagataatcagcccccaccttatgtttggaccctgactgcccacagctgtttaatgcagcactctggagcatagtgaccgcagacttggttagattccagggctctgtttcactctttcggcgcttgctaatcacactgcacattacttgatatttcagtaactcttgtggttgtcagtgattctttctgagctgtcatttttgttgataattttttttttttttttttgagacagggctttgctctgtcacccaggctggagtgcagtgtcatgatcatggctcactgcagcctctacctcctaggctcaagcaatccttctgcctctacctcctgaatagctaggactacaggtgcacacaccgtgcccggctaatttttaaattttttgtagagatagggtcttgctgtgttgcccaggctggtcttgaacttgtggcctcaagcagtcctcccacctcagtctctcaaaatgttgggattacaggtgtgaacaaccatgcctagcaatttcatttataaatgcctcattttcagctgtgttttcattaggtcttttaggagaaaatactctgttctgcacaaaattgtctaggttctgagtcataatgatcttgatgttttgtttcattttctgttgcagatgttgctgctatagcatgtggtcgtgaattcttggttaattcaagccgggtgctcttggacaccatattgcagcttctgggagacttgaagccaggacagtgtaccaaactcaaagtgtatggtggataatgttaaaaagttaattctatttacatattaattagactgtgctgattgggcctctcttcaagtaaacacagttaattttggtggtagttttaaaaactagaagaaataaattcctggagaagttaagggcgtgcactgtctcttaaatagcattttagaaaataaatttaaggaaggaatgttctcaccttagagcaatcagtgagtcccagtattatcacatggtacttcatgggtatgtcaaaatgaatttaaataggtatctgtcttccagctactaaaatctgtatttgttttctatttttatgtaacaaattatcaccaacttggtggctaaaacaacaccatttattatttcatagtttggcaagtcagaagtctgagtgggtttgagaggttctctgcataggtcaaaagtgaggtgttttccagggtgggatcttttcagagaatctaggggaggaatctgcttctgggcactttgaagtggctggtagagtccagtgtcttggtttctaggagcgagttccctgtttcccagctggctggtcagctgtgggtcagctgctgaggcagcttgcattgcttctcacagggaccccatcttcaagccacagtcgctcattgaatccttcccacgtttccagtctctgagacttcctcttctgctaccagcaagatgaaactctctctgcttttattcttttgttaaaaagtttacttcaagaaggcaaaaactctgcttcttatagatttgtgtgtttagatgaggcatacctggataaactccttttgattaactcttgagtcagctggttagtaaccttaattacatctacagaatcctcttttccaggcaatgacataatcagcgtgtgataatttatagtcccagagattagggcaggaaatcttggggagaggggcagtgtaggattctgccactcacactgttcgttctgagtgttgcctttgacttcttagagcatctttattttttaattatttttttaaagagaccgagtctctacagaccttgcctaggctggcctcaaactcctaggcgttcaaataatccttccacctcagcctcctgagtagctgggactacaggcatgtgccaccatcccctgctgtggagcacttttttttttttttttttttttgagacggagtcttgctctgtcacccgggctggagtgcagtggcgtgatctcggctcactgcaagctccgcctcccgggttcacaccattctcctgcctcagccttccaagtagctgggactacaggcgcccgccaccacgcccagctaattttttgtatttttagtagagacggggtttcaccgtgttagccaggatggtctcaatctcctgacctcgtgatccacccgccttggcctcccaaagtgctgggattacaggcgtgagcccctgcgcccggcctagcacttttaaaaagtaagagcttctgtaaagtctgtgccaggtgcttccaacacctgtgtcatcctggcctcggtgtctcttgattgttttttcccatgagagttgagattttcctgtttcttcatatgccaagtaattttggatttatcctggacatttacgtgatcactggtcttgtttaaatccttgggaaatgctggtgtttatattttcacaggcagtcaacccctttgggtcagattccagccagccttttctctgtttggtttcagtgtgtcgtcctgttttcagagtctttacagtgctattggaactgcccctcgtgagtgccgcccagtggccagtctgagacctgggtggtctggatcttaggttcagagtctttcagatactgtttatgatcagatccacacaggcacaacttgggatgaggccaggaatttataaacaactttttggggtcacttttctgagctgttaactctctgggtacactttagttacctgggactgcctttttcagtcccccacctggaatgctggggcttcatataccctgctgtgtccaagtgcctgcaactctgccctcatcccgccctgcggcaggagttgagaagctcttagagctttcaggtgtaaggaaaaaattcctttcccccagagtttgagttacctgggggatgtccccactgctaccgtgcttggttgctggcaggagacccctttcccactccttgagcctcactagagaccttctcctggtgctctctgtgtggctcagggctacttttgggttttggagctccctcgagtccaggccagggacactaaaggaaaaagtggtaaactctctgctggtttagtggttcttaaaattttgatcttcttcccctatctgcctgctactgtttacttttcagagtcctcaaatagctgcttcatgtattctctttggaatttatagctgcattcagtggaagcgagactggagggtgtgttcaggccatcttatccagaaccaagctttctagtccattttaatattttgtgctaacaaatatctatacatacataatacatataatacagtgtaacatatatgcaaaaaaaattttttttttgagacagagtcttgctttgtaacccaggctggagcacagtggtatgaacatggctcactgcagcctcgacctcttaggcttaagttatcctcccagctcagccttctgagcagctgggaccgtcagtgcatgccaccatgcctggctaattgttaaattttaaaaatttttttgtagagacggggtctctccatgttgcccaggctggcatagatggttttgtttgggggtataattttacaaattgcttgtggatctagttcattccttttaagtaccttgcatcaaaggagatgtaatatttggattatccttccctgactgatgggcatttaagttactttcgggttttacttgacaaatataatgccgtagtgagcatccttgataaactctttgctaacctgtctgagagttctccaggagttttcccagaggaaatatttgagaagtagtacatggacattttcaatttgataagatactgccaaattggtcaccatagtgtacatttctacctgcaccatgtcagtgttcgtgtttcccacgtccttgtcagcactttgctatttattatattcctctaaagagaaaaaatatatgtgtatatggagagagaggtgccgggggaagagggggagagacagggtcttgctgtgttacccaggctggagtgcagtggtgcaatcacggctcactgcagccgcgacctctggggctcaagtgatcctcccatcccagcctcccaagtaactggggtcccagctactctgcacgccaccatgcgcagctaattttttttttttttttggtattttttgtagagacagggtctcaccttgttgcccaggcttgtctcaaactcctaagctcaagtgatccacctgcctcagcctcccagaatgttgggattacagcgtgagccactggacctggccttaaagagtatttttatcatccacctatcatctgtctgtctttgtccttctctcccttccttcagatttagattgccagtgaggttgaggctcttcacatgtttgtaccattccagtttttcctttgagtcacctgtctgtgtcttgtgcccactttcctgttgggctgcatttttcttagtgatctgctgtaggtctttgtgtgttctggatactaatccattgcctcttttgcttctgtggtctgtacaaggtccatatttatgggccagctaaagtcccccttcaacttccaaggcaaagctgtgtgtgagggctgggtcacttctagcctctccggttccagtccctggagctctgtgcctttgggtcctggtgagctcttgttgattgcagtgggagatggggagaattgccttcagagccattcactgactttcttggcagtcttccatttggccactgagcaaagccgcgtgtttaccctctatcctgactcgggatctcagcatgcaccagcctgagaggggccttccccctgggatctttggctgccttccaacatgctcatggcttgttccgtctcaccacatctccaaggcactcttctcccctcttttcacctcccccacttcactaacgcccacccttgagtcctctggagccccaagacctttctcatactataaatcagcctcttttcttcctggcctccccctgccttgtgtatagcttgcctctctctggggaactacactttcactgccactttcatgatcgaaggtcactcattttcagcagttagtaccttagacccagagataggggttatttttttcctagttgcccattttttaaaaaaatttaaatttaaattttagattcagggggtacatgtgcaggtttgttacaagagtatattgcgtgatgccaaggtttgggcttctgttgaatctgtcactcagatagtagatatagtacccaataggagatttttcagtccttgttcctctccctccctctctccttttggagtctccagtgtctcttgttcccatctttatgtccgcgtataccaagggtttagctcccacttataaatgagaacatgcaatatttggttttctacttctggattaattcacttaagataagtggaggcagcctccagctgcatccatgttgctgcaaaggacatggtggtggtctttctttctggctgcgaagtattccatggcttgtatgtaccacattttctttatccaatccactgttgatggacacctgggttgattctatgtctttgctatttttgttttgtttagttttgtttttgagacagggtctggctgttccattcacactggcatgcagtggtgctatcttatctcactgcagtctgaaaatcctgggctcaagcaatccttctgcctcggcctcccaagtacttgggattacaggcatgtgacatcatgcctggctaattaaaaaaaatttttttttttttggtagcgataggggtctcactttcttgcccaggatagtcttgaactcctgaactcaagtgatcctttcacctcagcctcccaaagtgctgggatttcaggcatgagccaccacttatctttgctattgtgagcagtgctgtgataaacttataagggcaggtgtctttttggtagaacaattttattttcctttggctatttaccaagtaatgggattgctgggttgaatgctaggtctgtttttagttctttgagaaatctccagactgctttccataggtgctgaattaatttacattcccaccaacagtgtatacgagttcccttttttcagtggttttgccaacatgatgttttttgactttctagtaatagccattttgactggtgtgagatagtacctcattgtggttttgatttgcgtttccctgatgactagtgatgttgggcattttttcatgtttcgttggctgcttatatgttttcttttaagaagtgtctgttcttgccctttgcctgctttttaatgaggttgtgtgttttttcttgttgatttgtttaacttaacttccctatagattctggatattagacttttgttggatccatagtttgcgaatattttctcccattctgtaggttgtctgtttactctgttgatagttttttttgctgtggagaagctctttattttaattatgtcccaattgtcaattttcggttttgttgcaattgcttttgaggactcagtcaaattctttgcctaggccgatatccagaagactatttcctagattttgttctaggacttttatagtttgaggtcttacatttaagtccttaatccatcttgagttaatttttatctgtggttagaggtagtggtccagtttcattcgtttacatatggttagctatttttcccagcaccatttattgaacagggagtcctttcctcattgcttatttttgtcaatgttgtcaaaggtcaattggctgtatgtgtgcagctttaatttctgggttctgtattctgttccattggtctatgtgtttatttttgtaccagtgttatgctgttttagttagtgtagcctggtagtatagtttgaaggtgggcagtgtgatggctctagctttgttcttttttcttagcgttgctttggctatttgggctcttttttggttctataagaattttagaagagtttgttctaattctatgaaaaatgatgttggtaatttaatagcaatagcattgaatctgtagattgctttgggcagtttggacattttcatgatattgattcttccagtccatgaacatgaatgtttttccagttgtgtcatctatgatacttctttcagcagtgttctgtagttcttcttgaagagatctttcactcccttggttagatgtattcctaggtttttgtgtgtgtgtgtggctgttgtaaataggattgtgttgttgatttggctctcagcttgaacctttttttttttttttgagacagggtctcacccttttacccaggctggagtgcagtggcataatcacggctcactgcagcctcgacctgctgatctcaagcgattctcctgcctgagcatcctgagtagctgggactacaggtgtgtgccaccacacctgactaatttctgtagttttttgtagagacagggtttcgccatgttgcacaagctggtcttgaactcctgagctcaagtgatccgccttccttggctcttcccaaagtgctgggactacaggcttgagccaccacacctggcctccagttctgtgttgaataggtgcggtaagagtggatatctctatgtcttattccagttcttaggggaagtgtttcttctagctgcccatttttatttttaatgaaatgtcccagaatgctcatttttaaaaggctgtttctcttccaatctcatgcgaatttttttcctccttgaaaattcaagcaaccagttgctctcttcacatccagcctttctcatcactgtacttttctgaccatccaggcatttcccttgttcactgagtactggcttgttggtgtccccctccccatttcctgctatcttgaatgacttgaacatgtttaggggtgattcattcaacaatctaatttcaaggccacctgcctttctcagctcccaagatttgctgtgcccttcactgtggcagtagtctgccttgggccagaccctgcacattgtcatcaggtggactgtctggtaaacattgctgtagcactcaggccatacctcctctcctccctgcctccttttcctaccattgttccctctaaactgcaagacctcctgctcctcctccctcctctttcctcctgctcacaccattgcctccatggcctcccctccctccagctcacccagccccagtgtgcatcacatttcctgatgctttcaaccttggatcagcccagccatccttcttctctgttcctacagctggggctgttgagtgaggtttgggaagaagctttcttgtgtgcacggactctcgtcatttctcccggtttccagcaccctggaatcctcttctatgtcctttctcagctcccactcatttccacactggtggaggcagacctcgggtgtgatcctcacggcctccctgctctgctcttccttggtaggtgggtgtcccggcaggcggctttacttcctgctctgctcttccttggtaggtgggtgtcccggcaggcggctttacttcctgctgcacagagtcaagggtgtgagtgtggccgcctcagcttggccctcccttgtttattccactcccctttgctttttcttctcacgtgtcagaggcacgtatggcctggatgtgtgtgtgtggtgtgggtgtgtatatgtggcggggcgtggggaaatgaggatgtatttgggtgtggtgtatgtgtatgtgggtattttttggggtgtatggtgtgtatgcgtttgtgtggggcatgtttatggtgtgagtgtgagggaatgtgtgtggtgtgtgtgtatatatgttggggggaggtgggtgtcatgtgatgtgtgtgactgtggtgtgtttgtatatgtgggactatgagggattgggatgtgtgtattttgtgtgtgggtggagatgtgggtgtggtatgcatggtgtgtgtggctatgtgagggggatgtgtgtgtgtggtatgtgtatgttgggggatgtttgtggtgtgtatgtacatgtggagggtatggggtatgtgtgtttgtgggaggtgcgtggggggatatgtgtgggtgtgtgtgtgggtgtggcgtgtgggggtgtgtgggctgcatatgtgggggtgtgtgtatgtgtgtgtgttggagtgtgtgtgtggtgtggggaatgtgtggtgtgtgtgtggtgtgtgtgtcggggggtgggtgatgtgtgtttgtgggctctttcagccaaggctggggcagttagtgcagtcagctggtgtgttgtgtgtggggtgtgatgtgtgtgtgatctgtggtgtgtgatgtgggtgcgtggtgtgtggtgtgtgtctggtatgtgtgtggtgtgggtgtgtgggctctgtcagccaaggctggggcaattagtgcagtcagctggtgtgtgtgtggtgtgtctgatgtgtgtgtggtatctgtgtggtgtgtgtgtgatgtgtgtgatgtatgtgtgttgtgttatgtggtacgtgtgatgtgtgtggtgtctggtgtgtgtgtggtgggtatgtggtgtgtgtgatgtgtgtgtggtgtctgatgtgtgtggtgtgatgtgtgatgtgtgtgtggtgtgtagtgtgtgtgtggtgtatggtgtgtgatgtctgtggtatgtgatgtgtctttgtggtgtgtgtgtgatgtgtgtggtgtgtagtgtatggtgtgtatgtggtgtgtgggtgtggtgtgtgtgatgtgtggtgtgtgtggtgtgcgatgtgggtggtgtgtgtggcgtgtagtgtggcatgtgtgtggtgtggcatgcgagtggtgtgcgtatggtgtgtgagtggtgtgtgtgtggtgtatgtggtgtctgagatgcgtgtgagtgcagtgtgtagtgtgtgtgtggtgtgtggtggtgtgtgtgtgtggtgtgtgtgtggtgtgtgtgctgtatgattgtgtggtgtatgatgtggtatgtgtgatgtgtgtatggtggtgtgtgtatattggtgtgtgtgcaatgtgtgtggggtgtgtatggtgtgtgtggtgtgtgtgtggggtgtgtatagtgtgtgtagtgtgtggtgtgtgtgtgtatggtgtgcgtgctgtgtgttgtgtgtgtggtgtgtgcgtggtgtgtgtgtggtgtggtgtgtggggtgtgtatggtgtgtgtgtagtgtgtgtggtgtgtgtgtggtgtgcgtgctgtgtggtgtgtgtgtggtgtgtgcgtgatgtgtgtgtgtgtggtgtgtttgtggtttgtgcatggtgtgtgtggtgtgtgtgatgtgtgtgagtggtgtgtggtatgtgtgatgtgtgtgagtggtgagtggtgtgtggtgtgtgctgtgtgctgtggtgtgtgtgtgtaatcctcctgcctctgtgttgagccttcctctgggatgtgccctgttgcctgtcatttcttgctccagtatttccagcgctcctgctccactggctcctgtttagccttttgtcttcccaggccacggctgccctttcaaaccactagccagcctgcgtttaccatgacatgttgcattttcccagaatgcagagctggctcatggtgtgttctttttgcctcccccagaaatccctgtgggccctgcaggtcagtggtggatcagactggattctgctattgggccacatgtccatgtcttttgtggcaaacattcatagggttgtacatgggacattgttgtgactcagcctctgtgagttttttcagtggcatagcctccccagccatatggtttcgggctgttcctagtttatctgcctttttttgtgaagaccctgtttttaactctccaaatctaggaacttccagcatatggtggccagacacaccagctgaccttggaggcccctcaaggtggttggtgctgccagcaggatgactggattctgtttactgtagtggtcatagcttttcagtcttagccatacctcatgggtaattttccccattcccatcagcctctcaggtgtctgctggagatggccacttgacagaactgtgtgcagggtgagctctgtcagccaaggctgcggcagttcagtgcagtcagctggtggcatgcccctggcagggttctgtctgtttcatctctgtgtatttctccttagtcattcagccatggaatgacatgtgtcaggagtgtcccccttcgtcaccacctcagtccatttccttcccctccggccactggtcacccaggcttgtgctcccagggcctggtgtgggcaggatctgtgctgtgcctggaccttgggattgcggggggccctgagcgctgtcctggcactgagctgcatgtggagggcccagagtctcctttctacggctcctctttctccgctgctgtgacatgaccctggcgtttccatcctccttgatacttggtaacacttaggcaactgcaattattattttttttattagacttgtggatttctccagcgtttaaagtttcccttcctttttttgtacttccttatggaggccgggttattttttttcctcactgcccacgctgcctatgattttaccagtccttgagtaggccatgaaaggccttttcacatctacactagcggcttctcaggtcagacctgctggaggtgttattgaaggggatggcagaaggcccagagtttaaggtggttcttcatcccgagtgaggagagaggcctctggggtgggagctacccacattcctgaatggtcacttggttctcaggataaccctctccttggatttccagttggggtgtagtgtctgtgatgagaacacctctgcttttactaagctgaggtaactgacacagtgcatttcactgtcaatgggccagagaatatttggcatgtgtgggagaacagtggctcagcaaggttttctcatccaggcacagggtagagggttacagaaatgcctcttggagtttgggctctatgtggttcctgtttctcgaagttactgttggtttatcctgcccagcatcttccccaggtgttaccagttgaatgtcatcagtgagagtatggcttgtgaaagtttctgggttctttgtgcagatgacttcagaagcagctctgagctctgcaggaaaaccagctcacctttgtgggcaaatgagggtgatggtatcgtcccatttctctgtggagtagctgtgtggctgcatctgcaggttggagccacccacaagctcccgttttccaaagaattcgtctggaatagtcacagtgcagattgcatttttcgaagatgcttctagaagtgtttccacaaaatgtcttaagacaatagcagccttttagaactaagtgtggagaggaagctgtgaagcttgtaccacactttgttcactagttgctttgtttgtctctctcccgtttcctgtaaacttctggagagtgtggagtccaggacagagaagatgctcagtaaatgttgcatgatgagtgagagcaaatcctcactttctgggtgtggttctcccttgtttgttattaaaagttctacagagtgttactgtgcattttggtggcccgatccctttttcacataagtattggctgaaaagaaatcttcagacatgatggggtttctaaccagtttccagtcaaagctttagtaactctagataggaaagttatcattagggatcttgtaagataattttaagacattgcattacaattaattgtcctaatgaaggaagtatgttttcaagacaaactgtatctagataatgttcaaattcctaagtttagagtcctcatcatttccagatattaacaaaagtcaatatctggaagtcatttggggcctgtgaactaatgtgtattatttccaggtggtacagctttcagctacaatgtgcttaccagccactgaattggtctctgttgagttataaattggtagatggtgctgtgaacatcggctcttctgaaaggcatttttgggttttaccctgtctagtttggtcattctgtgtacattttaagaaaaaacaggtatagctaagtaatttgcttatttggccttttcaataaggaaaaggcaaataaccaaatacacaaataggcaaaagaaaaaaatcaggcaatttatagaataaaacacgcagcagcttcataaacatgggaaagattcttgctctccatagtaatcaggggaaagcaaattataaccctaataagatgccttttcggtgcctctcattgaaaaaaaaatcacagtctgatgattacaagcttccgattggacgtgaagccacagtgaagcttacacctgtccatgtgctgctggagggtacgtggagccagctggcctgtgtctgtggaggctgtgtctgcacatgccgaggacagagtccccgtctgcatgtgtactccagagaacgttttccataggataccaggatgcttgtacagaaaatgttatagcagtggtgtttgtaatagcacaaactaggaaattacctaaatgtctacaagatggagaacagataaataaattgtgattagttaaaaagttggcatatatcagtggaaataggttggagctatagaaatcaacataaacaaatctcaccatggcgtggaagattgcctgcagtatgctgctgttgatgcagacgtgcaaagaaaaaagattccatacctaaagtattagcaatgcgtggctagtttaaatatcagacatagctgtggttacacctccctgaagcacgcctttgggtagcgttcaccaagggaattcaactctggttatagggtttctttcttaaccagggaggtgggtattgtattattctttatatctttttgtatgtcttcattgtaacataatagatacaaattgacatacagatatttgaggatgacatgatatagaccacaggtttttaggttctaacttgactgaggaaagaggcacagaatctaaagtctgttaagtcattacttactgtactctgtctaatgaaaaattggtaggcctcttaagtttctgtcaagaataatttggtctaaaaatgtaatattgctgtgccaattgctttctcaaattacatgcagtcttttgtaagaattttattacttattgtacagtagaattactttatggtgctaatttgactaccttagattttggtcagtttagcatcactgattggcttgtttctgagcagtgaacttcacagatactcctttttcttgcttatttttattgctagtttgttttgaagtactgggcgtgtttattctgttactcgtaggttgcaagttatattttcttttaagatgaagaataaggtggtcaagttgtcacttttacctttagtgactcagttgtgttggcctgtggaggagtgctttcttgcttttcacaccttgtgcttgttcagccctgagaccttgtatatttaggtaaagagaacttgctttttatcgaagatgagttactcgtgttgcttatgtagcatttcgagttcaccagtacctttattttagccatattttcagtccttttaaatgtcagatgtgtcttagatgatcaagactgcagagactgggaagttgctcttttggagcctgttagtcccatgtataacaggttttctgctgaggtttgtggcaggaagcagaatttgcctactttttttttttttttttgtcattggaagaaaaagtctaacacttagtacactagtttgagaaataacattttctttcttccttttttttttgagaccgagtctcactttattgcccaggctgtagtacagtggtgccatcttggctcgctgcaacctctgcctcccgggttcaaatgattctcctgcctcagcctcccgagtagctgggactacaggtgtgcgccaccacgcccagctaagttttgtatttttagtagagatgaggtttcaccatgttggccaggctggtctcgaactcctgacctcaagtgacctgcccgcctcagcctcccaaagtgctgggattacaggcatgagccactgcatctggccaagaaataacatttaatatttcaatactagaagagtaaaatgaatgggcagtctctttagacttgataattggaaacttgatacactatttacaaatatttttggttggaatagaaatgttatattagacgaaacatttgcataagaaacagttttttgggtttattttttgctaactcttgtgtgacctagaagtctttggtcttctgtgagatgtatcttggcagtgacgtgaggtctcaggtggcaacatggttgttgtaagtatgtgtttcattttagcttcttaaggataactgattttgaccaaatatgaaaatttaaagacatctgccaacttgggagttgtttttgccaccttaaatctaaatggcagtcagcaaagaatttcaactggccatcttttcagaaggtttccctgtattacagttattaccagatgctagctttgctttttaagacatacagaagattggtttatcttagtttcatgctgtaaggcagaggtcagcaaactttttccgtaaagtgtcagacagaaaatattttaggctcttggggtcgtacgatctctgttgcggtgactcagttctgctgttactgcctgtgtgaaagcagccttgggcaatatatttaattctaaggaattccaactctctgtgtttgtgatctgaagcaggaacttttcttggaatactggattcgacacctcactgaattctagttaaggtgctaaattttcctcatgaacactacatttgagtagcccttaatacctcattaaataggttactagtgagtagcttttgaattcatgtaaaaattgtcagtgaaacttgaaagaacttgcagtgtggcttattttgtagcccgctgggaggctgaggaccttgttttgagaactgagcaccctgttctggagggtgcttgcatagctctgtcttttctggctccagagcattgccagggactttgaaagtacccatggtcggccagggatggtggctcatgcctgtaatgccagcactttgggaagccaaggcaggtgggtcacctgaggtcaggagtttgagaccagcttggccaacatggtgaaaccccgtctctactaaaaaaaaaaaacaaaaaaacccacaaaaattagccgggtgtggtggtgcacgcctgtagtcccagctactcaggaggctgaggcaggagaattgctggaacctgggaggtggaggttgcagggagccgagattgcaccactgcactccagcctgtctgtctctctcagcgacagagcgagactctgtctcaaaacaaaaaaacaaaaaaacaaaaaaaaagaaagtgcctatggtcacatgggtgagaaggaagaccttagcttttatatattttgatctttaatcactgggagttgattcacttttcagtagataaattgagtgcttattgtgtccagtcttactatactagtttgtgagatgataaagataaggcacggagcttgcttttgacaaagtttagtggggaaaccagagattttaatagagaactacaatagaaattttctatggcatgcatgtgttacatgtaccatagtatatttagttagtccctttataatggacttggtcagtattactgatttttccttttgccttaggctccagtatgtgaccagttccatctttatttaaaattttgggctgggcacaatggcttatgcctgtaatcccagcactttgggaggccgacgtgggaaaattgcctgaggccgagaattcaagaccagccttggcaagatggcaagacctcatacaaaaaattaaaaaataagctgggtgtggtggcacatgcctgtagtctcagctactcaggaggctgaggcaggagaattgcttgagcccaggaattctaggtggcagtgaataatgactgtgccactgcattccagcctgagtgacaaagtgagaccctagctctaggaaaaaaaagtaaaaaattaaagttttgcttattagggcatttttaatatatttttttaaaatattgcattacatttttaaaaatatgggccactgggcattttgatactcccttaaatttacacccaaagcaagtggcttactctcctcatcctagccggctgtgctagttcagtgtttatttgatagcatgtgtactggaggtggcagaaggtaggttgtgggggctctggactctgttatcttttcctgaagggaattatgtgtgtcctagctggctgtcagctttgcctgactcatacctgagctctggctctctggatgtggtctgcagcagagctgtgcctcattcctctgccttgcagctctccctctttctctgcctcacacttgtgccatttagaggccaggaccttggagggttttcatgcacattttagtgctcccttgttctgaaaccctcctttctaggtatcttcttccctttctttccaccctggtgaccctggactctgtggttttacttctcaagctggtcatccccaggtttctgattgagggtcgctgcctggtgctatgtggccttgtctaaacctcaatatatttgcctctttataaaaaaaaattctctttttttttttttttttttgagacagggtcctgctctgtcacgcaggccagagtgcagtggctggcaccgtcacaaccctgcagccttgacatccctgggctcaagtaagtctcttgcctcagccttccgagtagctgagactctaggcatgtgtcaccatgcctatctaatggttttttttctgttgttgtttgttttttaatgaagagatgggatcttgttgtgttgcccaagctggttttgaactccgggctcaagcagtcttcccatgttggcctcccaaagtgctgggattataggcatgagccacccctcttctttcaagggggcacttctcttcagtttctgcctgcctttggctgctttccattccccttaaatggttcctatattttgttcagaatttgtgattcttattggtggagggttagtccaatgcaagttactctgccattgctgcagctatttttttctggaataagtattaaaggctgtgtgtgtgtgtgtgtgtgtgtgtatttcactagcatcacaagttttatttttgtatattcattcttgttcagtttcccaattttcctcataatttctttgacttattcttatagagatgtactttcagttttctaaatgttggagttttaaaacctacttaaaaaatgatttttaacttaattatgtggtggatcagagaatcagcttaatgtattaagtgctataagaggtgccttaaaatctaccattattgtggactggtcagcattttcttgtagttttatcaatttgtgcctttatgtatttttgaggctatattattaggtacatacaagtttaaaatgctaccctcctgatgaactgaacttttcagtatgaaatatttagccttgccgggcgtggtggctcatgcctgtaatctcagcacgttgggaggctgaggtgggcggatcatgaggtcaggagttcgagagcctaaccaacatggtgaaaccccatctctactaaaaatacaacaattagctgggtgtggtggcatatgcctgtaatcccagctactcaggaggctgaggcaggagagtcacttgaacccaggaggcggaggttgcagtgagccgagatggcgccactgcactctaactctgtttcacaaaaaaaaaaaaaaaaaaaaaaaaaaaaaaaaaattagcctcttaatttttaaagatgctttcccttcttttaacattattattatttttagttattatttttgagatagggtcttgctctgtcacacaggctggagtgtagtagcactgtcacagctcattgcagcctcgacctcctgggctcaagtgatcctcccacctcagctgctccagtagctgggaccacaggggcgtgccatcatgcccagctgtttttgtattttttgcagagacggggtcttgccatgttgcccaggctgacctccaactcctgggctcaagctgcccgcccacctcagcctctgaaagtgttgtgatgataagcctgagccactgcactcagtctgttttcttttctgttaatgtagctacctcagccttctctttcttcttttttcattagtatttgtttgatatatcttttcccattcttttactttcaactttctgcaaacttttttttttagagtctcactctgttgcccaggctggaatgcagtggtgcgatcttgcttcactataacctctgcctcctgcattcaagagattctcctgcctcagcctctctagtagttgggactacaggtacacatcaccacatgtggctattttttaatattttcagcagagacagggttttgccatgttggccagggtggtcttggactcctggcctcaagcagtttgcccaccctggcctcccaaagtgctgggattacaggtgtgagccaccactcctggcccctttctggaaacttttgtttcaggtgtgtttctttgaaacagtccatggttgcattttgtttttcctttaatctaaccatctataatctatgccttttaataggagtatcctgttcattaacatttgtgattaatgaaataattggatttatttattctgtcatattttgtttttctttttattatgatttttccaagttatctttccctccctacctctctttctccctcgcttcctccctccctgtctccctccttcccttcctcccaccgtctttcttccttctctctctcccttcttctcttttcgttccttttctattctttctttcaacagggtcttactctgttatctttctttcaaagtcactaagatcttttctgagttcattttattcttctagtgtcttgaaagtttacccttgtttctttcagtgatagccccttttttaaagcatgatttgatgtatttggtatacttgaaagtaattaatgtctttctcacctaaacagtagaaggatcttagaatgctctaatacttacatcctggattatatgcattcatggactgtatcttagctctgttgaaaagtttcaaaaatcccatagagtagacattttaatgactgcttttaccccccagtgtttacttctgtacactcacatccctttacttactccctccttgtatctcagaacattcttccaacgtcattttcctttttctgaagtctgtccttcaaattctttcagttcagatacatttaaaaatgtctgagattttctttgacaacatttttactttacctcttttgttgaaaatatttttgctgggttcacaattctagctttattattattttctctttacccttggtagatatagagagcccagcttttggtgtaattactcttttataggtaatatgtcctttctctctggctgctttacaaaatttgtctttaattttctaaagtttgattgtgatgtgtgtagatttgtatttattttttatctttcttgagatgtttttgtgcctcctgaatctgagggtttatatttactcatttctgggaaatatttttgaaacatttttttccttcattctttctgttctttctttgtggaccctatttggaagaatgttgaacttttccacctttgcctccttgtacttttatctttctttaatctgtttttctttcttgctgtagtttcttaagctgtcttttctgtttagtatttctccttttccatgtgtctaattacccttgagttttacattttaattattgttttcatttttgtacattctgctgttatttttgaattggctggtcattcaaaatagtaatcctagcttcttgattatgtttttaatttcttttaaaattatcttcacccattaaacataccagttttatattctgcagttgatacttctagtatctgaaaaatttttggttctagccctgttattggttctttgtgctggctgttgcttacctggtcttctttttctcatgcgtcatattatgatttttgttatgaactcccatttgctagtatgtatttgtgggaattctttgaagaccaggttgaggatcctttcctttaatgtccaggaagctgggggagcttctatcccaggtctgttttatattaaaattactggcttggggatttttcaggcctgccaaaaatgtgaattcatgctaagcttgaaagtttcctctcttctggtttctgcagggcctgtgaaatgaatgtccgtgtctctctgaggcttttcgctcggtccctctgcgtgaagccactgtaactgaagctctagtcttttggaattgtagcatcttttgcactttcctctaagattttgtgctcttactttgttcctgatcagagatgttttcctttgatttcttgcaaattcattcattatttcaaaggctttgcaaaaaatatttgtctagcctttttattgctctgcagtgtaaagtgtttgggttctctgtattttgcagtatttgcagaaaccaaagtcctgtagtttctgactttcatcagactctgcattgccagccacggttcaatcccaaaacagcttataaagtcctgtcctattcagtaaactgctctgttggttgtgagggatggttgggttgtagtattcttcattccttgtactgtgattatgtagtcctgtggcctgacctggctacctggatgtcatgcgtaatgttcattgaatgaaaatatgtcattaggttttagatggctgaattgaactttgagagtatagtactcttacaaattgagggtaacctgtatgttaatgcaggattggtaataaaagaaatgaatcaataaatatggtttgtgaggcttcccgtgggaccctctctgcaatcgagactcttgattatgtgaggctatgaaaggcggtattatgtgatatcattgctgaagtttcccattttcctgtagcctcacgtagacagatgttattaattcacattatagaattggacatctaaaatgtgagggaagctctaaatacgttaagttcctcttaactagtaggtatgtttagggtgaaatgtagtgtggatggagcattccaacacctttttcttttacatttcaggctaatgctgatgtccctatacaatgtaagcatcaatttgaaaggcttgaaatacatcagcgagagtccaggattcatccctttgctgtggtggcttttgagtggtaaggggggtggttatctgtccagctgcttgtacgggttatgcagtagtcctcccttatccacggggcatacgttccaagtttcctagtagatgtctgaaaccagagatagcaccaaatcctctctatatactatatttttaaacattcatacatctgtatgtaaagtttaatttataattaggcatagaggttatcaacaactaataataaaatagaacaattataataataagccagcaccgctactcttgtgctttagggtcattattaagtaaaataagggttacttggacaacagtgctgtggtactacagcagttgacctgatgacctagatagctactgagtgacctaaagggcgcatagcatatgctggacaaagggatgattcatgtccctgatgggatggagtgggatggcagcatgagatttcatcatgctacgcagaatggtgtgcaatttaaaacttaagaattgtttatttctggatttttccatttgatgtttccagaccatggttgactggctaagtgaaactgtggaaggtgaaactgtggataagaggggcctactgtatacctgttcttctgtagctgaaggaaattttaaagtattagaaagtaggattgattgtaagatgttctttcttttaaaaaaagtcaaattttagaaaatttcttggtatgttaagtttactctagttctgtttctgaagtattgctttcaatttggttataatttactggtgtccctacaacacaaagagaaattgtctcttataaaacagcaggtaaacagcatcagcctatcccattctctattacagcacagtactctatgtgggtatgtggttctgtcagataaaagagaagacccattgttaaataatttgggtaaaaagaaattggaaagacactgcagctatgaagagaagtacacatgtatagtatgtgtgtgttttaaaatttctttaaaaagctatctttactgcatcctttcctcttcacccttaactaccaatctaacctaaagttctgtcccaatttcatcataatttttaacactatatgttgtttaatgagtatacatttcacccatgtataaaaataaattaattttccttatttttttatgattcaaattaacctcttttttttagtgtcagttccatttggtggtgaatgcttttttaaaaaatagctttattgatgtgtaatcgacatgtaataagttgcatatatttaaagtgaacaattgataagtattgatataaatgtccacctgtaaaattattatcacaatcaaggtaatgtgcaaacccatcacctccaaaggcactttgtgcccctttgtggtccctccttcctgctcctctccctgctttccagagagtgactcgcctcctttctgcgctgtagttagttttcattttctttgattttatataagtggaatcatagtttgtattcttttttgccgtgcttctttcactcagcataattattttgagatccatccatgttgattttgagacccatccatgtctatccatgtgtctattaataggtcattattttttattgctaaatattccatgttgtggatatgccacaattgtgtattcattcagctagtgatggacatttgggttgtctccagcttttgactactatacataaagctgctgggagcattcttgtacaagtctttgcatggacatatgcttttgtttgtcttgggtaaatacctagaagtgggatcactgagacatgtggtaggtgcatgttagtttttatgaaactgccaccctgttttccaaagtgcttgtaccatcttacattcccagcagcattgtattagtgtatggtcattctctttaattttagacattccaatagggataccgtgatacttcactgtggttttaatttgtatttttgttgtgactaatgatgttgagtatcttttcatgttttgccattcacgtaacttctttgatgatatctgtttgtatgttttgtttattttaaaaaaattggatagattcttactgaatattgagagttctttatgtattcggtttgtgtcctttgacaaatgtgttggaaaaatattttttcccagcttgtggctcatctttcattctcttaagagcatcttctgaagagcagaagacctatcttaattgtgataaagtttataattctttttcttcgaagaagcatgcttttgttgtagaaattttttcctaaatcagtgtcacaaaggttttctaatgtgttttctcctagtagttttatagttttgcatttcacgtttaggtatatgatttgttttgaattggtatctgtttgtggtgagagtttttgttgttgttgttgtttttatttttatcgtttgctttgtttttttgcataagactttctatctagttgatccagtaccatttgttttgaagactttgttctccagggaattgcctttgcaccttgttgacagtcagttgacaatacatgtgaaggtcattttggattctgttctgttccattcatctatttttggatcattatgccaataccatgctttataataaatcttgatagctttataataaatcttaaagtcaggtagtataagtcgtccaactttgttctctttcaaggttgttttggctatttttaagccctttgcctttccatatgaatttaaaaatcagctcgtcacttgctaccaaaaagaatcctgttggaatttttattgggattgtgttgaatcaacagttcattttgggggataattgacactttagcaatattgagacttacaatccatgaacacaagtatatgtcttcatttatttagatattgtcgagacacaagggtcactcctgtttcttcatgtgttaagagcagaggaactgacctcctttgtttctggctagcttttcaaggatgtgtgtatagcagacatccttagaggacagagatactgtctccttccagagcaaaaagggtaggtttgtttacccttatgtagtaaagataatgtttccctctagggcaaagttcagccagagcttggggttcctctcctgtgacacagcccacacagcatgtatgtggccttgtggaattgggtcttaaactggcataaatgctctggctatggctgttgctataacaagttcttggtctcagactcaagagtttgtgtcttctgccagtgtctgtaagactctagcatgctagcttgttagcttgcaagcttgcaagtagggtaaagccctagaccctccacagtttgagggcaggtccagggggctatgcttgtactccattgacaacacttacccaccagggttggatacttgaccagacagcttttttcctctcaagaatcatagaatcagaggtggttcctagacctgacctgtaaggtaactattcaggctggttgttacgggccgtgagcaagcggacagtgtcagtctgtgggagaggatgctggtggtgccagggagagaataattaaataagaatacctaatacttcttgagtaccagtcatggctttaagtgtgttacgtttgttacatttatgtctgtcagtaccctgtaaggtaaatactgtttctgtatcatagatgaagaaactgaggcatggaagtgagtaaggtgccaaggttatatagttatggggtggtggagctgagatttgagaccccgaccgcctggctccagaccctgtttcccaacaacgctacaggactgctgctcagcaggacatgtctcgggtggaagccttagtgctggatgacttcttatttatttatttatttatttttgagatggagtttcactcttgttgcccaggctggagtgcagtgatgcaatcttggttcactgcaacttccgcctcctgggttcaagcgattctcctgcctcagcctcccaagtagctggaattacaggtgcctgccactacacctggctaatatttgtaattttagttgagacaaggtttcaccatgttggccaggctggtctcaaactcctgacctcaggtgatccacccgcctcggcctctcggagtgccgggattacaggcgtgagccaccgtgccgggccagtactggatgacttctcacatttagttgacattaggtctggctttgcttggcttctgggtcagttgccctgaaacaatatgccagtctctacttaggctaatttgcagccagtaatcctactttctcataaaaagaggagtttagcctaaatgttctctatggcccttttagctctggtcctccggaagtttccgggggtgagtgaaaattgtaatgagtttcatcttaatttatgcagttctgtcagtagcaagcaacccaagtttctgccactcatcagagagtgtgttctttgactcaggtggacttttcctgcttaagctttggcttatggataatatgaggtgcttgttaagttgtgttaatgcaatttttttttgcttctgggacatcatcccaggctttcctttttttttttttttttttttgagacagaatttcgcttttgttgtccaggttggagtgcaatggtgtgatctctgctcaccacaacctccgcctcccggcttcaagcgattctcctgcctcagcctcctgagtagctgggattacaggcatgtaccaccacgcccggctaattttgtatttttaatagagatgcggtttctccatgttggtcaggttggtctcgaactcccgccctcaggtgatctgcccgcctcagcctcccaaagtgctgggattataggcgtaagctaccgtgcctggccatcccaggctttcttatccgtgaaaataattactggttctttcaacacagtgagcacagcccaacccctcataaatccattgcaaggtcatcttactttagaatctttagaatcatttgttctaaagtcaaacaaaacaagatctgtttaagcctaggatgtttgactcctgagttatgtatgggattactttaaatcttaaattatagaatttcatatgtgttttagaaggtgaatatatagtttactatagaataggaaaataggaacaaaaatagttcgtggtgctggtggtagtgggactgttttcagaatttagactgttttcagaatctagaatcataactgcttaggactaagagataatttgaaaactggcttcttctattcctttggttttaggtagatctagtttatgaaaatatactggacagataagaagctcttctaatttttaaaagatcgaggaaaaggagaattgtttgaacccaggaggcagaggttgcagtgagccaagatcgtgccactgcacttcagtctgggcaacaagagtgaaacttcattaaaaaaaaaaataagatcgaggaaaaaaaagatctcattatccctttcagtaatcagttcctacttttatcaatttctgttaagaaatttgatgtattttaataagtacacgagctttggactcattcaacccagatttgaattgcagctttcctgcttgtgaacttacctaaccttttagaatcctgcttttctgatgtataaaatgagaatttctacctcaaggatcttaatgtatattaaaatgcaatagtgtttaggccaacacctaatgtagtaggtgttaaataggtgctagttttcctcttttatttctagtctaaatatctcatgctttagggataaaagacttgaaatgaaaaaaaaaatctcatgctgcaatgaaaactcattttcttttgtttgcttgctgtaaaggtggcaggttactttcaagtatctagacttccctgattcagagtacgagaccagttgctattaatcatccctgactaaatcatctcatttcctttaacgtttgctagatttcatttgtcttcccttcgttcagctacatggctggctttttcccaggctttgtccacattcttcacattcctcttaagccacagaactggcatagaactcgagcaaatagccgacgaggacagagtgtattgagatggtggccacatgttacgtaactgttaatgcagactagtattgtgatcacaggaaactgcatttcctaccatgttttcaatgctaaaagggcagataggcggttatttccatcttacatctatttggcttgtctgagtaacacaaagcattgatcaggttctccagatttgtgccttcagcccagacctctgtcccgagctctagcctcatagattgagctgtctacttgatatctccacatggacatctaataaacattcacattcaatgtgttcagactaaacccctaatcttccctcacaccaaattctaatttctattgattacaattctatttttctagtgtctcagacttttaaaaaaccttcgagtgattcttgactccttgactccttttaatctcttacgccctcattcagtctgttaggaaatcctgatggctctactttcaaaacatctccagaatctgatcaccagctagcactcccacctaggtgttttttttttttttgagacagagtcttggtcagttgcccaggctggagtgcagtggcacagtcttggctcattgcaaccctctgcctcctgggttcaagcgattcccctgtctcagcctcccagtagctgggattacaggcgcccatcaccacgcccagctaattttcccacccagttttgagccaccatcaccttgggttgagagcttcctataggtctccctatgttccatccttccaggccatgaactgggagccaggggtatgatggaaaaatccctgaccacctctccttactgaacagtcaaaatgcggagtgagacacaaaaaaacattttacttacttatttgatacagtgtcttgcagtgtcacctaggctggactgtagtggagtgatgctagctgactgtaaatcgaattcctgggctcatgggatcctcctgctccagcctcctgagtagctaggactacaggcatgcaccaccatacttggctagtttttacaacatttttttgtagagatgaggtttcactatgttgcccaggctggtcttgaactcctggtctcaagtgatcttcctgccttggcttccgaaagtgctgggattacaggtgtgggccactgttcctggccgcaaaataaataaataaataaataaataattaaataaaattatacctagagcatgaaagtcaagtgaaagtgggaggacagagaggttaacagagaacttaacttcttgctttgagggtatttttcaaacttgtcctttagtttccatggctcccagggtgtgggggataggagacaaagccccggtcccacctcaggtgagcatcctgagaggaaactcccaagggtctttcccagcagtgtcggggtaaactgaagatactcgcttaatccgaaagttttttaaggaaaattgttttgacctttggcattgagtgtagtggggggaaaatctcttctgagaattagtaggctggttttcatgcaggtttgaagcttttattcaagccacctaggtggtccctaagagagttaatttttatatcaacttgattggaccatgagatgcccagacatttggccaaacattaactctgggtatgtctatgaggatgtttctggataagattaacatttgaaccaggagactgagtacagcagattgccttcagccagttgggtggctctcatccagtcagttggagccccaacagaataaaaaggctgaataaaagggatctctgccttgactgtttgagctgggatgtgggccttttcctgcctttgaactcaaactgaaacaccagctcttgggtctcgagcctgctggctttcacactggcactacacattggctgtccagagtctccagtgcatggactgcagatattgggactccctcatctccctcatcaggtcttcatgtccctcagcaggcccttcatctccctcagcaggtcctcatctccctcagcaggcccttcatctccctcggcaggcccttcatctccttcggcaggtccttatcccccttagcaggtcttcatctccctcagcaggcccttcatctccctcagcaggcccttcatctccttcggcaggtcctcatctcccttagcaggtcttcatctccctcagcaggcccttcatctccctcagcaggcccttcatctccttcggcaggtcctcatctcccttagcaggtcttcatctccctcagcaggcccttcatctccctcagcaggtcttcatctccctcagcaggtcttcatctccctcagcaggcccttcatctccttcggcaggtcctcatctccctcagcaggcccttcatctctctcagcaggtcctcatctccctcagcaggcccttcatctccctcagcaggcccttcatctccctcggcaggtcctcatctcccttagcaggttttcatatctccctcagcaggcccttcatctctctcagcaggtcctcatctccctcagcaggtccttcatctccctcagcaggtcttcatctccctcagcagtcccttcatctccctcaggaggtcctcatctccctcagcaggtcttcatctccctcagcaggtcctcatctccctcagcaggcccttcatctccctcaggcccttcatctctctcagcaggtcctcatctccctcagcaggccttcatctccctcagcaggtcctcatctccctcagcaggtcctcatctccctcagcaggcccttcatctccctcagcaggcccttcatctccctcagcaggcccttcatctccctcagccggccctcatctccctcaacaggtactcatctcccgcaacaggccctcatctcctgcagcaggccctcatccccctcaccaggccctcatcccccacagcaggtcttcatctccctcagccggccctcatctcccgcaacaggcccttatctcccacagcaggtcttcatccccctcagcaggccttcatccccctcagcaggcactcatctccctcagcaggccctcatcccccacagcaggccctcatcccccacagcaggccctcatctcccacagcaggccctcatcccccacagcagggcctcattccccacagcaggccctcatcccccacagcagggcctcattccccacagcaggccctcatctcccacagcaggccctcatctcccacagcaggccctcatcccccacaacagggcccctcagcaggccctcatcccccacagcaggcactcatctcccacagcaggccctcatcccccacagcaggccctcatctcccacagcagaccctcatcccccacggcaggccctcatctcccacagcagggcctcattccccacagcaggccctcatcccccacagcagggcccctcagcaggccctcatctccctcagcaggccctcatctcccgcagcacagacccttctgaccactggctaaggtgagacttggcagtgccagctatatggctgtggccacagcagtgattttagtggtgggtgtgtgctctgagctgggccatagtctttctccaggagttttctggcttcagctgctgaagaacagtgttttttttgcctttcttgggccgtgaaactattggatgtgactctagagctgcctgtggccgtgttcctggccacctggagaaaatttatctgtgttgtcagttgctgaagccaagacataaatgctgacctgagatgcagaggagccctatggcttgcagtcagctttatccctgtccaggtgggctgtatagcttttcctcagattttgagttatcccagcatctttcataagtgactccttttatccttctttcttttctttctttttttttttttgagacagagtctcactctgccacccaggctggagttcagtggcgtgatcttggctcactgcaagccctgcctcccaggttcacgccattcttctgcctcagcctcccaagtagctgggactacaggcacctgccaccacgcccggctaatttttcgtatttttagtagagacagggtttcaccgtgttagccaggatggtctcgatctcctgacctcgtgatccgcccgcctcgtcttcccaaagtgctgggattacaggcgtgaaccactgcgtccggctgccttttacctttcttaagctaacttaagcatcatcttccttcccttgagggcagtgtgcccactcccccaactttgattccacatcttttccatggcaccagttgccttctgatatggcatctgattcccttcagtgtctggcatttggctatatcacgtaacacagagaaaggccagagggtttagtaactagtgaatattcagtgatgtgtcttcataattcttttcaacccaaatatgtggcattgtcagaatactgtatatgttatgattctagtaagcaacttctttattatgtgagctgtggatggccatttgatagaaaagcaaaatatttaagatcttcaccgacaaagaattttacatgtgaatgttttattatgttggtcaagtgtttctcttgatagttttgcgttagcccagtgttgagccttttagtgtaaacacggggctaataacgtgagctactacaaaatgtggtttttatcttttaaaaaatgtctcaaacattattgacttgaaacttctccttcagaatgtccaatagaacaaaggtgtcagcctttccacaagagaatgctgggactgttttctttgattaatcaatgcttacatgataactttaacaagaaacataatgtaaatgtttgatttttcactgttgatataattgagtggtcaaatggccacttcgtacgtcaaaggatgtcaaaaaacatttggcctgcatatgtccagtctgacaagctgagcgcaatagaaactttagtgtagtctggtcaggatacaattaactcataggcacattgagaaaggggagtgagtttacatgaagatgaatttggtgtgtgacatggtcagtctgacatagtaaaaaaaatccaaatggaaatgtccaagaagtagttggagacaagaagcttagagttcacaagaaacttgctagtgacatgggtttgggagtcattctgaaaaaggtgacaaacagaaagactggcagtgtagggaacatgacacggggaggctggccgagaggcctgagcagagggatgtagggctcatgagagccctgagctaggagacaggtcgaggcatcagaaagcaggctggcccctctcctcctgtattctggtttgtgattctgggtgagtcccttcacttccatgatattctgtcatccacaaaatagagatataaacactgttcctgtctgtttggaacagggtggctgtgagaattgagtggaacagcaattggaaatgctttatacattttaaaaagagggacagaaaccatttctttgagaagaatacaatggctgttagagtcggaactcaaagaaaacaagagtgaagagaagcatttggcaacagagagttattgatgaactctgaaaaggttcccatagagcacagggtcaggcacaagggtggcttaggaggaatgagcagagaagaaagaggggcgggtagtaaggttgatgctgctttggggatttgttggtgaaaggagagttttgtgtgtctgtattaagggtaatcagattctaattttcaggatttcagtctaaaatgaaaaataagaacaagaattaactattttacttcaaaatacactgtggctttcttcatattttcttgggctaggagttcaccgtcccctgcagttcatctttagacggtggcatctgtggcatcaaagtaggctactaaaatataatgcttgctccatttttgttgtttgttttactgtaagccacaaatattggaataatttttataataactctgcatgaattcttcattattctttaagaaaagatgtcgtcgaatgttcttcattaactcattgatgaaggatctgggtgtttaggattgttgttgtgagattagaaaaccgcagctaatgaaatcttccatatgatttgtaagcctcccagctgtgcatacagtcaactgatgacaatcttagttacataatgtcttggaaaccctttctattcagatgtcaaaagaaaccctttaggagatgaaaattggggagttagcatttgtcaaatatttgtgggttatgtttcttggatacaaatataccatttgtgtaagtgctgaaattgttaagaaaaacttggacatcctgggccctgtcaaagtcctgacatcccagaggcggtcctggccgggctggaaggtacacaactagtcttctcttctggctcatgcccctcctaagccagagtgccctgccaggccacagagacctgggtggagcagacagccatggccctggacagccacacagcttcagcccagaaacagcacagggtaggcgccctagccccatctaacctgggaggctgtgtaggagacctctgcttacattctgtggggctgtaggacccttcagaggctttcttatagttgtgtcagtgacagcatgctaaggttatcacctgtgtgttgtgcaacacagagccatccatgagagagcgatgagggtggtacagtgccgagctcgtcgcagcatggagaaggacctatgttgcctttcttcatgattgatttggttgtgtctgtgtagaatggacaccatggatggcttgttctgcaccctttttccctttcttcatttctaacagaaccccaactttattccgggctccatcctccctttcgtggatcatatgactcagggaaagagaagggagtttcatagagagagagaaaaaaagagaatgcacacacacacacacatctctagggaatctcatccctagagattgtattaattgggcaggagtatggagcagggcccaggcatcaggatttgtaagtctctctgaaggatcctaatgtgagacagggttgaaaatggatggtctgagccagccctagccatcttactgtgtgccggtgatgggtttagggctcaaggcataaggtggtcagtgcagggcatccttctgccaacagtgcatggtccatgtgacgcacgttcgtgtgaagagagtccaccaaacaggctttgtgtgagcaacaaggtgcaggcaggccgagtccaaaaaaggagtcagcaaagggtggtgggattatcattagttcttataggtttgggataggcggtggagttagaagcaattttttgtgggcagggagtagatctcacaaagtacattctcaagggcggggagaatattatgaagtaccttcttaagggcaggggaatatcacagagtccattatcgcaagggcagggagggtgtattgtcataaggtcagttgatcagttagggtggggcaggaacagatcacaatggtggaatgtcatcagctaaggcaggacctggctattttcacttcttttgtggatcttcagttgcttcaggccatctgggtgtatacgtgcaggtcacaggggatatgatggcttagcttgggctcagaggcctgacagtccagaggtgggcacatgacctgagtagctacatccagatccaagggatgggggagagacttcttcactggagttgaatgaggaagcctgtggccccgaatgccagccttacagttgatgctgttggggcaggcagagaaaataacccaggccttccataacataattgagacattggatccagccctggacttctcgttttaagaaataataaatgtgattacgtttaagccactttgagctgaagttttgtacttttagctgaagtattttgtacttccagttgaagtattttgactgtttctgtagtaatacagtcactaagtgtcctaagtcaattccagatttattgatatgcagaataaagggaaataaagaaggcgtgataattggaggtaacatcttcattttcttaaaaacatatcctgccagcaccaacttacttgctttggttttcttaaaatgtgaagacaccaaatgcaaataaagaggtgaacagagccccctgcatgtggttgagaagtggaggtcgagggatggggtggtggagtgccaacctgcatgtcagctgtgggtttggggcaagctccttgaccacctgaagaatggtgtcgctgacatcacttcagagcaattacgagaattaaattcgttgacctacatagagtacccagcacaggcactggtgataggcttaggttgaaccacatgaaattgccagtgtttatccactttagaccaatgaaaatgacaatttcacatggtttagctgaataatttctttaataatgatagctgttattaataataagtgaaattgggaattgaggatgtctgtgagcataactaaagcattaatttggcttcaaataatgttcagtgaaagtttttaaaaactgaaattcgccatgtttcacttcactttgcatgttttaagacctttagacaaatttaatttttcaagattttgcagcgtatttgtaggaatacagaagattataactgtgtcatcctttaaaatgcttagtgttaccaaggcaagcttttcatcaatgtgatgtggtagtggagggttgccttctatatagtgttgtgtagactgtacatgactggcgcctttgtcatgaacagcaatggaagcaaacgtgaatatagcacgttgacttgtgcatttactatgtgacagctgctggactagagcctttccttatgggatttggtgtaatctttatgccagacatagtttatatgtggggacactgaggcttagtagtgtagaggctctgtgtaaccactagtaatgactagtaagaggtggaaatgacttaaattcatggtttatagacaagtttaaggcttgcagacaattaggaactcacaaaacaaataggaaaccattgacttattttccacttagaaattgaagtcactgatgtcttggcccaggaagatggcctcacatctgagattgatatcattacatactgttgaatatgagaatttggaaatgacttttttttttttttttttggagacaaaatcttgctctgtcatccaggctggcgtgcagttgcgcgatcttggcttactgcaacctctgcctcccaagttcaagggattctcctgcctcagcctcctgagtagctgggactacaggcgcacgccaccacacccagctaatttttgtattttcagtagagatggggtttcgccatgttggccaggctgatctcaaactcctagcctcagtgagccacccgccccagcctcccagagtgttgggattacaggcatgagccactgcgcctggccgacttttgaatgatattttaaatatccttagcacttaccactgtcttttagtgtgcactaatcttggctattcttttaactataaataggaagaaagctacctttaggagttttttagtctatagtgggatcctaacattagctcacgctgttgtccagctgggtttgttaagatgcacttcctatttatttggcaggattactcaacagtagtgtgtttcattttcttttgggctaaagactttcctcccaaagtaaaaatgcagtaatatgtgtgaaagtagtttgtaagtggtgaattgctagtcaagtgtaagttatttttatcatcctctccttctggaaagaatcaggccggcagtttgtcccacagtgttaggtatcagctccccacttcttgcaattgaagagctacagtgtcttctcaagtttttaaagggagtctgaaagcttaggtggcgggtgtaattctctgtgacaggtttatgaatttttccacggagatgtgcaggcttcaaaataaattgccctttcagcatgaagggatgaggctgcgtcacctcgaaaggcgagcatgctcatgcagcccagtggagcgtcgtgttttcatattctgtaacttttgtggctgacttagtgcacctgttatcagaactgtgatataaatatcctgtaacatttgaggaattccaaatcccggaggtccaaacattttgagttccatttcttaaaatgggaataagacatgaaggagctgcctgaaaagcacagcaggagctgcgtgagcagcaggaggggagggaaggccctgctgctcctgtgccctggttgcctgtgcgcatgcggtgagccctgtgggttctgtcaggcctgggagtggaaggaagcagagcctgaggccctgagctgtgtgtctgccatggctcgtgctgctggcacttttgagccatcccttcatcgggagagaagaggaagcagctgggttgacggcacccccgtcccaaggaggctgagccgagaggaagccgtctcagaggaaggaaaagcaagatcagcctcgaggacagctgctccccatggagggcggccctgtgtgccctgtggtctcagtgtgcgtcgtggatgttggggtcggggaggactaggccacagcttttaccagaattgaaaaagtgcttagggctgggcgcagtggctcaagcctgtaatcccagcactttgggaggccgaggcgggcggatcacaaggtcaggagatcgagaccatcctggctaacatggtgaaaccctgtctctactaaaaatataaaaaattagctaggcgtggtggcgggtgcctgtagtcccagctacttgggaggctgaggcaggagaatggtgtgaacccgggaggtggagcttgcggtgatccgagatcgcaccactgcattccagcctgggcgacagagcgagactccgtctcaaaaaaaaaaagagaaaaagaaaaagggctgaaactcaaaaaaaggtttaggaaccattgctcccaagataatcacccaacgtgtagatttgctgatgtcttcagaggagtcagccagtgcatggcaactgactgatttttttattgtttcaaatttaagtgctaaattgaatagttgtaggttgaaagggcgagatgatgtagctgtgctgttttccaggggaaggcaggatgctggcagtctggtaagagatcctgctgggcctgtggtctggcctcctccccctgtgagagcgccacagtggtcttggtcatgaaaggctgcctcgggccctgctcactcacagaggctcatggagcagaagcccgtcgatggcttggcctcgaggctgtcttcactagtgactgggatgctcttgtcccatgcagacaagatgacttcttcctagtttccaacgacttagcaaacgaaactactcatcacgaggttgccccgaaaggttgggaatcgagcaaagtggaaggaagtggggagctggatgcagatgagccccgagatgcccaggtgtcaccctcccccagcacagtgccagctctactgatgaccccttcctgtgctgtcctccacaccctcccccagactgccaggtgccccttcatttcacagggccttccccccaggacgccaccagcacagtttgtctgtcccctgtgagggagaaggcagagaccaagtcctggtcattgccctgtgctcagttgtgacccagagctggggaagcagcagtgtttgatctgcatttatcacatgaacgaaggtgttttggtctggccttctgaagattacagcagggtcattttgattagagttttgggtaattcaggactcttcatatgttactggttggatttctaatttattttccaagatttctaattatgtacattctaagtctgtgggttttcctagtttcactctgagatggtagcattgttgacagttctcaaggggagccttgggctcctctaggctgtccctgtagctctgtgaatggaacaccccgccatgggcccaccacacagctggctcggcagtacagctgcaatgggaagtgggcagcgtcagccccccgtcacactgggcagcagcattagaaaggtggctcttctgtggtcaaagagctagtagacaggggagccaggatcaaaccctgctttttctgattccagagcaccatgcttggcttacccatgcagagccgtggcagcggacagctggggacacacacgttctttcattcactcactcatgggctcattcatgtattcaccaaacacttagagcctcgtaaggaccaggtgcaccgctagtgttgtagaacaagggaaacttctcactctcacagatttaatgactgttcattgctatactccaatcttagtgtgttttgtcattgtttagcattgtgaaagtagaattgatttgggtgtaatccaaaagttttatagcatagagaagaaaagtcaaagataccaagaacatctaagccccaaagattggaactttttcactttgctaaactgtcaaatacaggaaaatgtgtgtgtgtttcagagggctctgactctgaagacagctcgttggaaaaggcagcatctgcagctgtcatttttgccagacatcattggttagttttccaacagagaggagagagctcagcagcactcgtccttgtcctctcggacacctgagtgccagggagcagctggagaggaggcgttgctgctgaagccctagggagttctgtccactggctttgtagtgggccttccctgtgtgcgcttgtgctggatgtaggaaatgtgggcaacttcacatgctccctctctgctgcacttcacacctctgtttctccctcacctgctttcctgagggtgcgtcttgccccagggtcctgtccacagcaggccacttctccaagcttacatgttctccgggcagtcacgtctacacctatgactgtcactgctttctttattacagtggcactgaagtatctaactcaagcccaagtctttctcccaagcgctgggctagcacatccagtgcctgtgcctttccttcacatggacctcccacagccacctcgtgactcccagagctggacatgtcgtgtttcccctggggctcgccctgtgttctctcttgcacatcctggctgatggtatcccctctcctcccccaagcctggcctttcccttcactcccactgtggaggtccagtcaggccatgcgtcctcttgctcctggctgttgtaacttccagaatgtctgctgtgtcctgcagactctgattgggtccagactgtgagcatttcttgttgggtcaccaggggatctgttggtggttccctcggctttggacctagtcgctctgattcagccctctctctccccgctgttttgttagactgatctttcacagtcggattacaccactgacatccccactgaaaaccggaaggggctctggtcagggtccatgatctgacctcctctggcctcaaccctgggcatcctcatcaccgtgtccctctgttcacactcctcacattgccttgttgggtttggactcagaaaggtgagagcttttcaggagagaaacagactcaaaatgtgaatctgagagagctctattttgagctatgatatgaagcagaattgattccatcttcagggtagagcatgagggtggcagtgaatagaggggctgagccgccgcacactccccctggcctatagaaagggaaggcagagttgctgaggggttcggagttgcttggtgaagggagagcctggaaaaggagcagaaaacaagaccaagaggctgaggactgagtagaggccccgagagccagtgtccagatgtctgggctccttgaagaaagcagaaccagtagcattgtggtgctagaagccatattgaaggaaggctagggatgacaagcacggagggagggccccacgaggtatgcagtggcagcaggtaggagtgaaatgacacagtgtcagggcaaagctgcgtggacagagggcggaggggctgtccaggagtgagtcaaagcagaggggcttccacagagtgctgtggaggggagaggcttcgtggactttgtggggacagcatttgtatctgggtacctctggaggatttctgatctaatttgcgatgaagagaatgcttatatgtctttgttttaaatatacacaaataattcagtatacatgactaatggcatatgtacatatatttaaagtaagggacgtaagtattgctttgtcccacattgtgttatcacaataaacaaaaacatatttgctgacacaaactctaatatttaaaacgtattctccataaactgaacttcccagaaaaccaaaccaaaaggtaattcttgaaaaggtaattctttcaggccataagtatgtgataatctgcatggccaaaggaagcagagtagccaatgagagccctaatagttattattacatttgtacttgttttacatgtattatacaatgtgctgtataaaactctttgagatggatgtactttgtattatattgacaaggaaacaggctcagagaatgtgaaagatttacttgccaaggccagtcagttaggcagtaccccatttggcattcatatcctggcccctgactataaaccctctacctcagcttgtgtgttttctcctgtgccatgccgaatttataaattaaacctacgtttaatttgaaacgtaaaaattatgtgttgccttcattttaatagatgaggaattctgagaattctgtttgccagtggtatttctgttatggttactgacatctgcttattttaatgtattttgacatgtgtggaagtgggactaatctggttgtgattcaggctctgcatatgtatcagagctgacccatctgccatgcaagtatattttagaaaaggagcaaattcctggctgggccaagtaacaccttttccacttctcctctgtgtgtgatctgttgtctacagtatcatgttgaaaaagttgagaagcgattttggaaagagagaagtgaggaatctgttgccagagtgtaattgagaaacagatgagctaatggaagaagccaagatgttacattccattataagggagttgtaatttactgtgaaggttgagggaatagcatctttttggaaagaaaaaagtcagaaatataaaatagcctactatataaagttttatgactccatctcataatcatttaaatgggtagatactttatgttcctataccttcaaaatccagcttgaaaccaccttccagagggcctttccagatttcacgtcctcaagtctgatcattccttcttctgtatcccatggtgaatattacaaatagagtcatagttgtaccttctgaaactgtttcattgtaaaatcccttgctgggtgtggtagctcatgcttgtaatcccagcactttgagagggcgatgcaggtggatcacctgaggtcaggagttcgagaccagcctggccaacatggtgaaaccctgtctctactaaaaatacaaaaattagctgggtgtggtggcgagcgcctgtagtcccagctactcaggaggctgaggcaggagaatcgcttgaacctgggatgtggaggttgcagtgagccaagatcacaccactgcactccagcctggggacagagggagacttggtctcaaaaaaaaaaaaaaaaaaaagaaaaaaaaagaaaaatccctaactaggtaagaaagtaaggacttggtaagagagcagttgtgtttcttttttgtcttccacagaatacagtgagggagctttgtgtcccctcttcagacaatgctgccgagccagcgtgctgaacctgccctggctggggatggtgccgtgggagggtgcgcttcagcttggagtacactcatgagagttagtctgcagggagtgggccggcctgtttattaccattgttgttgagctcccagcactcgggtgggtcagaatgcagggagtggaccagccccatttgttatagttgtcaggctcaggagtgagcaagacagagttctttccctatggaacttatattcaggtgaggagacttgatagtaaacaaatataatggcatatatcatatagtaatgcaaataaaaatggagtggcatgaggagcaggctagagagtgttgggcggagctgctcttttgggtatttgagtggatacctgaaggaagcgaaggacagcctgtgctgagatctttgagcagagcatcacaggccaagggtggcaggggaagggtctgaggcagctatgggcaaaggagtattgtaggagtgactaaaggccagtgtcgctggagaggataagaagggaatgttaggagtcggggccagaggaacagctggtgctgggaatcatcatagtgtagaaggtatttgtagccatggtaggggactgcattgctgagggagtgatatagggctgaggatgaagctgtggggccagcattttcagtgcagatgaagatgatgagggagcacagaacagccaggtgaggtcggaggaaagccgggaagatgcagtgtcctccagggctaaatggaaacagtgtttccacatgcagctggggactgtcctgtgctactgagctgggcaggtaagcctacaggcgggcgggtgagagggcccagctgtgtgagtggggcttgggggagccacttggtctcttcaccatcattagtggctcataaatgaagctcacagtagccagcatgacttttattttttattttatttatttttttgagacggagtctcactctgttgcccaggctggagtgcagtggtgcgatctcggctcactgcaacctccacctcctgggttgaagtgattctgctgcctcagcctcctgagtagttaggactataggcatgtgtcaccatgcccagcaaatttttttgtatttttagtagagacagggtttcagcatgttggccaggctggtctcgaactcctgacctcctggcctcccaaagcgctgggattacaggcatgagtcaccacacctggccaccaacgtgacttttaagacactctcagtcttagaatcctgattgggaggtggcgtcagaatctcagatggtaacactgatgtttgtgtgtggctcacagattgaaggtaattctaggaggagttccaaaaatgttctgaacaatgacagtattttgaggatgaagacataacacctcatcacacacacagctgagtgccttgaaggggagagcaaactttgggtttctgtgagttctggtactctggtgaaagggtagtgccctggagacctcctgggctgtttccatttcagatgttggtcatagggcaggactctgtggaagggataggcagttttcacagcaagggaggaacagctgccagcccacactctcttctgccatattgaattattgagggagagaccagttttcttctggatggtttttttttgtttagcagattcttgatgaatatttgattttggtggagagaagttttcttctgtggaggacttttcagtttattattacttgttctcttcattctccttagttccacacaatggcagctacctattcttttttttttttttttttttttgagaagtttggctggaattctttttgtaatctctaaattgttttttaagaattagctagataatttttctccagggaagggattcttttgttttacataagcatatcttaatagatatgattttaacaatcaaattatgttctaattgtaacttaacggatcttatggtcagtacttttgtcgatttgccttgaaattgatctgtttttatcaaaggccctttttatagtttaaatgttctccaagaacaggctgaaagcacacctgccctcccatttcccatgcttgtgtgtcaaggattgttgtcaatttccacaggcatgttgcctttttgtgttagtttcactgtttgtcagcccttttagataagacagggcaaggcattgaaccctccagaactcgttcccctcattgcagatggcagcagtaagaccactgcacttgggtgagggtcactcataaaaagggcagaagtaaacatcacctatgaaagtattgttcttatatgatagcactaaatgtactcaaattgctactttaatacaaaggttcctatggcaatattaaatgtgaatctgatctgttttaatgtttaaagctcaataactctccttggttagagaatcagataattagttttggttggtgatatggtttggccctgtgtcccccccccctccccatatctcatcttgtagctcccataattcccatgtgttgtgggagggaaccggtgggagattattgaatcatggggatgaatctttcctgtgctgttctcatgatagtgaataagtctcacgaggtctgacggttttaaaaatgggagtttccctgcacaagatctctctttgcctgctgccattcatgtaagatgtgacttgctcctccttacctcctgccatgattgtgaggccttcccacccatgtggaactgtaagtctattaaacctctttttcttcccagtcttggatatgtctttatcagcagcgtgaaaatggactaatacagtaaattggtaccaggagtgggttgtgcggaaaagatacccaaaaatgtggaagtgactttggaactgggttacaggcagatgttggaacagtttggagggctcagaagaagagaggaaaatgagggaaagtgtggaacttcctagagacttggtgaatggctttgaccaaaatgctgataatgatatggacaataaagtccaggctgaggtggtctcagacagagatgaagaacttgttgggaactggagcaaaggtgactcttgtcatgttatgttttagtaaagagactggtggcattttgcccctgccttagaggtctgtggaactttgaacttgagagagatgatttagggtaactggtggaagaaatttctaagcagcaaagaattcaagagataacctgggtgctgttaaaggcattcagttttgtttttttttttttttgtcagtaaatactttattcatttctctgttgattttttttcctcattacaaaacagcactgtatacagctgtgcattttctggttacatggaagtggaattatttggtaaatgtgcatattcaacatgaataaaaatgaacaatttgctttccagggtagtattttaaatttatactcccatattccaccagcagtgcttgagagttattgtttatcagcatttcctaatgtgaaatcggagtttttctaaatgagatttttggctatttggagattttcccactttccttggaatggtctattcagattctctacagtttttattttatgagatttgatttgtaaatattctttatatatttgagttttaactttttgtcagtatgtgacaaatatattctgtcaccttgtgggtttgtttttaactgttcgtgatatctttggatgtgcaaaattttaataatgttggatttatattttttatagtttttgaatgctgccttttcataaaggagttatctgacttccactttccccaggagctgcaggcatcaatttggcaagtttacttagcgctggtgtacttggtgacggccttggtgccctcggacacggcgtgcttggccaactccccgggcagcagcaggcgcacggccgtctggatctccctggaggtgatggtcgagcgcttgttgtaatgcggcaggcgggaagcctcacctgcgatgcgttcgaagatgtcgttgacgaaggagttcatgattcccatggccttagaggagatgccggtgtcggggtggacctgcttcagcaccttgtacacgtatacggagtagctctccttgcggctgcgcttgcgcttcctgccgtccttcttctgcgccttagtcacggctttcttcgagcccttcttgggcgcgggagcggacttcgctggctccggcatgttgaaggcgaactacgagcctgagacgagcagcagatcgtgaaaacgggaagtaatgcaaggcattcagttttataagggaagtggtttggaaaatttgcagcctgacaatgcgattgaaaagaaaatcctgttttctgaggagaaattcagactggctaaagaaatttgcataagtaacaaggagctgaatgttaagccctaagacagtggagaaaatgtctccagccatgtcacagacttttgtggcagcccatcccatcataggcctagaggcctaggaggaaaaagtggtttcatgggccaggcccagggtccctgtgctttgtgcagcctagggacttggtgccctgtgtccctgtcactccaaccatggctgaaaggggccaacatagtgctcaggtcctgcttcagaaggtgcaagcctcaagccttgggagcttccatgtggtattgagcctgtcagtgcacagaagtcaaaaattgggttttgggaacctctgccaagagtttagaggatgtatggaaatgcctggttgtctaggcagaagtttactgcagggatggggctctcatggagaacctctgctagggcagtgcagaaaggaaatgtggggttggagcccccacacagagtccctactggggcaccacctaggggagctgtgagaagagggccaccgtcctccagaccccagaatggtagatccgctgacagcttgcaccgtgcacctggaaaagccgaagaccctcaatgccagcccatgaaagcagccaggagaggggctataccttgcaaagccacaggggtggagctacccaaggccatgggagcccacctcttacatcagcgtgacctggatgtgagacatggaatcaaaggagattgttttggaactttaagatttgactgccctgctggattttggactcgcatggggcctgtagcccctctgttttggccaatttctcccattcagaatggctatatttacccaattcctgtatccccattgtatctaggaagtaactaccttacttttgattttataggctcataggcagaagggacttgccttgtctcagatgagagtttggattgtgacttttgagttaatgctgaatgagttaagactttaggggactgttgggaaggtattattggttttgaaatgtgaagacatgagatttgggaggggccaggggctgaatgatatggtttggctctgtgtccccactcaaatctcatcttgtagttcccacagttcccatgtgttctgggagggacctggtgggagataattgaatcatgggggtgaatctttcctgtgctgttctcgtgatagtgaataagtcttatgagatctgatggttttaaaaatggaaacttccatgcacaagctctctctttgcctgccgccatccatgtaagatgtgacttgttcctccttaccttccaccatgattgtgaggcctccctagccatgtgaaactgtaagtccattaaacctctttttcttcccagtcttagatatgtctttatcagcaacgtgaaaatggactaatacagttggtttataaaactagttttaaaaaattcaatgggatgtttttcttggcccatttaattttttcttctttactgcagagaagtaattgtagagatgtccttcatgttgtttccagagtaacacacattgacatttatatgtaagagctggtgggtactgtaatcatctgagagaaatgatcagatgtcggtgtagggcaagggcagctgccgtcagaagaaacaacaccatgaaaggccaaaaagatttatgaagaacttgacagaaataagagatttttaaaaatgctcgctggtcacttggaacaaatagcagtgtacaaggcatgatttgaatgactacttagattgtagttgagaacatctgtggctttcaggatattttaaaattacagtttgatgctcaaggcacctatttctttagcttaaaggaaaaggatctgcaaagagcagaggaaaaccaagtagattttattgcttggctgagtgtgctgcggcagatgacatgtagcttatttcgaagatatgtttggcattatttatttttagaatttacctgatatcagatcttagtctactagacagtgtgggagcacgcattgacagacagcctgggctggcacaccccatgaacatagtccctgatgcagggtatggacagcaactcctacttgactgggaaactccaggcatttcacgtgcattaggcctcactgtgatgcaggcacatctcaatgggtccagccaaccctgctcaccacagtggtatgtgttcaggtgcaatgtcagctgggagtgtacacagcactggtttggatctgtgagggttaccaccttgcatactgtgtgacagaacttgaaatttgccgagaaggcaagacttaaatgaactagattcagacagtacaaagtacttgatgaggtgatggtggtgatcgtgagcagttctcagtgcttcctctgtgttgagccctattgtgagcactttccatgcattaacttgccagccctgccaggtcagtgctgattcacccagggagcaagtggcagagcaggatgtgagcccaggccatgaggatcctggtagagccaggaatcggagtggatgtgtcagtaagggttagggtgggtaggcagaagttgctgaaccctattgccgagttcatgggtctgggagaacacgagttcagttgaccaggagatatgggaaggactttggcaaatgtttctttttctttctcttttcttctctctgtcctccccttccatcatccttctcttcctttattcttcccttcattctgttctcaggcttttttatatataatattttatatatttatggggtgatatgtgatattttattgcacacatagaatatatactgatcaggctgatcaagtcagggtatttggagtatccatcaccttgagtattatttatatgtattgagaacatttcacatacttctagctactttgaaatacagtatacattgttgttaactatcatcaccctactctactctcaaacattagtacttacaccttctatctgactgtgtttgtattgaccaacctctctcatccccacttcaacccacagacccttcccagcctctgctatcagtcactctactctcaaccttcatgagatccactttttagtttccacatatgagtgagaacatgcaaaatttgtctttctgtgtctggcttatttcgcttaatgacctgcagttctatccatgttgctgcaaatgacataatttcattcttttctaagcctgaacagtattccactgtgtatatataccacattttctttatccattcacctgttgacagacatttgtaggttgattttgtctcttgtctattaggaacagtgctgcaataaacatgggggtatccctttgatatattgattacttttcctttggataaatatccagaagtggaattgctagatcacgtggtagttctatttctagtttcttgagaaatctccatactgttttctgtagtggctattctaatttacatgcctatcaacaatgtgtaaaagttcccttttctccacatcctcgccagcatctgttttttgtctttttagtgatagccattctaactgggtaagatgatatctcattgtgatttcagtttgcatttccctgatgattagtggtttttttttgtatacttattgaccatttgtatggcttattttgaggaatatctgttcaaatcttttgctcactttttaatgggattatttgttcttttatttgagttgtttgagttccttttagatagatccccttgtcagaggaatagtttgcaaatagtttctcccattcagcacattgtctcttcattctgttgtttcttttgctgtgcagaaggtttttagttcaatatagtctcatttgtctatttttgtttgttgtctgtgctttcaaggtcttagctataaaatatttgcctgtaccaaatgtcctgaagtgtattccctatattttcttctagtagtttttagttttgggtctaacatttaagcttcaatccatcttgagttgctttttaaatatttggtgagagatagggatcgaatttcattcttctgcatatggatatccaattttcccagcaccatttatcaaagagactgtccttcccccaaggtatattcttgcacctctgttgtaaatacgtggatttatttctagattctggattctgttccattggtgtgtgtgtctgtttttataccagtaccatgctgtttcggttactaaagctttgtaatctgttttgaagtcaggtaatatgatgcctcttgcttttttctttttcttttcttttttctttttttttgctcacaattgcattggctatttggattcttttggttccatgcaaattttaagattttttttcaatttctgtgaaaaatgacattggtattttgatagagattgcgttgaatctgtagatggctttgggcagtatgattattttgaggctattaattcttccagtctttgaacatgggatgtctttttgtttatgtcctgtttaatttctttcttctgtgttttgtcattttccttgtagagatctttcgcctcctaggataaatttattcctaggtattttaattttttggtagctgttgtaaatgcgacttcattctttatttctttctcagcttgttcattgttggtgtatagaaacactgttgatttttgtatattgattttgtatcctgcagcttcactggatttatcagttctaacagttttttggtggactctagatttttctaggtagaagatcatatctttagcaaagaaggacagtttgacttcttcttttccaattttgctgccttttatttatttatcttgtctgattgctctggctaggtcttccagtactatgttggataggagtggtgaaagtgggcatcttgtcttgttgcagttcttggctgaaaggatttcagcatttctcatttagtatgatgttagctgtggatttgtcacacgtggcctttattttgttgaggtatattccttctatccttagtttttttaaggtttttatcataaaaggatgttgaattttaccaaatgcttttttagcatctgttgaatgatcatatggttttgtcgtttgttctgttgatgtaatgtatcatgtttattgatttgcatatgttgaaccatccttgaatccctgggataagttaagttccatttgataatgatgtgttatttttctgatgtgccgttggatttagtttgctagtattttgctgagaatttctaagtctatattcattaggaatgttagcctataattgtcttttcttttctttttttttttgtgttgttgttgtttgagatggagtcttgctctgtcacccaggctggagtgtagtggcgtgatctcggctcactgcaacctctgcctcccaggttcaagcaattcttctgcctcagccttccaagtagctgggattacagatgcatgccaccatgcctggctaatttttgtatttttagtagagacggggtttcaccatgttggccaggctggtcttgaattcctgacctcatgatccacccacctcggcctcccaaagtgttgggattacaggtgtgagccactgcacctggcctagcatatacttttctttttttgttgcatccgtgtctggttttactatcaggataatgctgacttcatagagtgatttagggagaatccctttctcttcaattttttggaatagttttaggagaattggtgttaattctttgaaagtttggtagaagtttggtagtgaagccatccagtcttggacttcactgggagactttttattactgattcaatttcatttcttgttattgctctgttcaggtattctatttcttcctgattcaatctagtagattgtatgtgtgtaggaatttatccatttcctctaggttttctaggtagttagtgtatagttgttcataatagtctctggtgatcttttgtatttccatggtatcagttgtaatgtctcctttttaatttctgattttgtttgtgtcttctcttggttagtctaggaagtgctttatcaattttatcttgtcaaaaaaacaactttttatttcgttgatcctttgtggttttttttttctctgatctttattacttgtttctttctactaattttgggtttggttggtttttgtttttccagtacctcgaggtgcactgctagattatttatttgaaatcattctactttttctgatgtaggcatttgttactataaacttccatcttagcattgcttttgctgtatcccatttggttttggtatgtttttcagttttcatttgttttcaagactttttaaaaatttcctccttaatttctttcttggctcagtggtcagtcaggagcatattgtttaattttcatgcattcgtagtttccaaagttcctcttgttattgattttgagttacattccactgtggcctgaaaagatacttgaatgattttgatttttaaaaatttgttgttgcttgttttgtgtcctaacatgtggtctatcttggagaatgttctgtgtgctaatgagaagaatgtgtgttctgtaactgttgtatgaaatagttctgtaacgtctgctaggcttatttggtctaatgtgcagtttcaatccaatatttctttgttaattttttgtctgagtgatccaatgccgagagtggggtgttgaagtcttcaactattattgtattgcattctgtctctccctttagatctaatagtacttgctttatctagtgctctggtgttgggtgctctggcgttgggtgcatatatgtttggaattgttatatccttttgctgaattgatacttttatcattatataatgaccttcttttgtctctttttacagtttttgacttaaaatctgttttatctgacataaataaagctacccctgcttgctttttgtttccatttgcatgggatatcttttcttgtccctttattttagtctatatgtgtctttacaggtgagatgaattttgtgtaggcagcatgtagttgggtcatgttttttttttttttttttttaattcattgagccagtctgtatcttttgagtggaaaatttaatccatttacattcaaggctattattgatatgtgaggtttacctctgtcattttattacttgatttctgattgttttgtatatcctttgtttcattctttctctcttgttgtttattattgtggtttggtggtgatctgtagtggtaacatttaagttttttctttttttctgtgtttgctctaccagtggtttttatattttcatatgttttcatgattatagttactgttctttcacttctgggtgtaggacttccttaagcattttttacaggactggtctagtggtgatgaattccctcagcttttgcttgtccaagaaatacttcatctgtcctttatttataaaggatacttttgctgcaaatagtatccttgaatggcagttttttttctctttcagcactttgaatgtatcatcacattctctcctggcttgtaaggtttctgctgagaaatccgttagtctgatgagggttcctttgtgggtgactagatgcttttcttttgctgtttctaaatttttctctttgtatttgacttttgacagtttgactgtaatgtactgtggagaggatctttttgaattttatctatttggggatcattgagactcttgtatctagatgtctaaatctctttctagacttgggaagttttcatctattgttaaataagtttctgtttgctttttctttaccttctgggacaccaaaaatttgaatatttgatttatgatgtcctatatgttacaaagcctttgctgattctttttaattctttttttttttttttttaatctttgtctctctgggttatttcaaatggtctgccttcaagttttgagatttttttcctttggcttctctagttattattgaagcttttgaatttgttttgtatttcattcaatgaatttttcagttacagaatttctgtttggctcttctttatgatacctggtaaggttcggctatgtctgcacccaaatctcatcttcaattgtagttcccataatccttacatgtcttgggcgggacctggtgggaggtaattgaatcgtgggggcagtgacccccatgctgttctcgtgatagtgagtgagtcctcacaagatctgatgtttttatgaggggcttttccccctttgctgagcacttcttcctgcctctgtgtgaagaagaatgtgtttgcttcaccttctgccatgattgtaagtttcttgaggcctcctcagccatgctgaactatgagtcaattaaacctctttcagttaaacctctttcctttataaatcacccagtcttgggtatgtctttattagcagcgtgagaaaggaccaatacaatatccatctcttggatcaaatttctcattcttatcctgaattgctttttaaattcctttgtatttttcagcattctcctgtatgctattgaacttccttactatcaatattttgaattattttcctggtattccataaatttctttttgattggaatctgttgctggagaattgttttctttaggagatgtcatattttcttgctttttcatgtttcctgtacccttgcattagtatctctgtggtataatggtcatttcttctaagttttttgaatttactttcgtaggagaggacattttcccgaagatgtatctgtggtattggtaggtagggcactttggttttgaatctgggtgtgtgcagtagtgtagtctctgtatgatttctttggctgtaaacagcattaatgatatctatgattttcttaatggcttagggtatggttgttagtggaggctgtggtgaaattttgctgttgacctgggtgccaggtaggccagtcttttggccccagtggtggcagtggtggactgagcatgcctgtcctcaggccccagggtggtgtacactggcaccagtgttagtaggtccaggcaggccagttcttgggcctccaggtggcttctttgggtactaggaatggcagtggtgggttgggtgggtgggtgggttcctgagcccctgagcagcaggtgtggtgtggttgatggcaacagcagttgtggtgtgggtgatggcaacagcagtggtgggacagccctttggggtcttcatctctggtagcttatgctgggctgttttccaaagtgctgatgtttgtgacggctgtgacaggttgggtgggctggtccttggacctgcaggtggcacatatgggtgggtcgcagcggtggtggtagcagcaagctgagtgggcctgacccactctgggagactctgctgagatgctactggtgatccccaggcccctggacagtgtgatctggttctagggagggatggtggaggcaggctggctggacctgccctcaggtcccttggtggggagtgtagttattggctgtggtaagtagcatcgaggtgattcctaggcctcccgtggaatgctcaggtaggggtggccagagtttcattgtgtccctgctactggggagggcagggtttctttccctgggagcagctgtagtcaggcacctagggggcatgggctttgattgcacctcacctcaggcctgcagcagctcatagtggtagcagttgcaggtagtcgactttgaccttggagctcatgaaaatacatggctacccatctgcagggatggtgtgggggatcactccctgtggctcccacctccaccctggtggcggggcaggctgcagttcattgggggttgtactctccaagtggtgccatgccacagcagcttaggatttggggggttgtggcacccagcgtgggctctctgtggagcagtgcctttgtacagtcttcaggcagctctccgcagtagtcttggggtcctctagaattgaaggactctcccagggctgtggattgtagaagtccacagcagcaatgtgaactgctgggaagggtctttcacttaccctttcccccaattagggagccactgctgactcccagttgatcccagcctagcaagctgccttggttttctttccttccttgcttttggtgtttctgaatgtttctttgttgaattccaaagttctctcttaggttatctatttgaagtgtgattacttgctattttggttcttctctgtggaagaggtgagcaccagatctgtctagtcagccatcttgaagcctcaaaacccttttttttttttttttggacacagagtatcactctgttgctcaggctagagtgcagtggtgcaatctcagctcactgcaaccccctcctctcaggttcaagcgattcttctgcctcagcctccccagtagctgggattacaggcgtgtgccaccacgcccaactaatttttgtgtttttactagagacaaggttttgccatggtggccaggctggtctcgaactcctgacttcaagtgaaacacctgcctcggcctcccaaagtcctgggattacagacataagccaccatgcctggtctcaaaacatttttaatgagaagcacagcatacctagagaaaagtacagaaacataaaagtgaagctcagagaataattacaaaggaacatttgttcaccaccacccagggtgagaaatggcatgttgcctgcacccaggaaatgcgtgtgcttcttcctcatcactacccactcccattttcccatttttgaacattatataaatgaaaccatactttgatgttggctttttcattgagcactttgctagtgaggtccatcgtgctgttgcatgtagctgtggttcattttcactgccacctcgtagggtttctcagcactgctgacgtttcaggcttaatgatgctctgctgtggggctgccctgttcactgtagggattttagcagtcttcctggtctttacccaccagataccaatagtgtctcccacttgtgacaatcaaaaatgtttccagatgttcagattgccctctgggatggcaaaatgcccctcgccctggttgagaaccactgctctatagtacaggttgaatatcccttatttgaaatgcttgggacaggaagtgtttcagatttcagattgttttggattttggaatatttgcatatccataatgagataccttggggataggacccaagtctaaacatgttcatatgtatttcatatacctgtgatagacatagcccgaaggtaattttatatagtacttttagtaattttgtacatgaaacaaaatttgtgtatgttgaaccatcagaaagtaaaggtgtcactctctgagccgcccatgtagacattctgtggttgtttgcatcaccatcattcctgactctgaatttataagtggctgacaagcagtcattttctctcacttatgcacacctaagtatttaacagtatttactggccctccatggggcaatgtggggaacctgcccttggtgcactggcctgcacacacaccattttattacctttgtgggtgtgcttgcattggggaatccgggcctgcatggaaaagacatcgcagccaaagggacctgaacggtctcttttcccttggtgactctgaataaactgtgtgttgtgtgcctgccttttgattgtaacctgtcgtgtgaagtcaggtgtggaatttttcacttgtgtcatcatgttggcactcaaaaagtttccaactttggagcactttgggttttggattttcagattgatgatgctcaacctgtattctattgtatgaatttaccagtttagttatccattttactattgatgcacatttggattatttctagttattggcctttacaaatagtacttctctaacattcttgtacttgtcgtttggtaaaggacatgtgcatgttttcctgttgcgtttatctttaggaatggaagtttgggatctatagaagtgcatgtcttcacctctagtagtttatgctgggctgttttgcaaagtggttatatcaggtgtgaacatttaccaacagcaaaggagcgttctggttgcttttctttcttggaaacacctggtattgtcagagatcttcattgtagccattctgtggggatggagggctggctcattgtggttttaatttgcattgtttttatgagttctgaagtggagcaccttttcctgtgtttactggccatttggatatccatttttgtcacaacctattcagagctcttgcctttttttcttttaggttgtctgaatttgtatattctggatacagaatcttttttgattttattaaagttgcgcatttattttaccactccatgtcttgctttatttctcttaatggtatgttttgatgaacagaagttcctgatttgaatgtactctgagtgcttaatgtatcctgttaagaaaatgtctgcttacctcaaggtcatgaatatatctgcctatattttctcctcggtttctctttttgccttttgcatttatctttgggcatgctctgtgataggggtcaagttaagcgttccccagggttctcacagacccagcactgactgcggagggcactgtgctttccccactctcctcggtgcccacacgtgtgtggggtctgtgtctgtgctctccattgcactcggccagtctcccatcctgcagtgctacattgcctcttgtcaagatggataagtttttgatacctagaacgaacattgtttttcttcaaaaaatgccttcactattattgtctcctttccatataaattttagaatctgcctgtcaaattccacaaaggacaccgtgttgattttgatggaaatttcatggaatctgtagatcagtttggaagaattgacgtttttagagtgttgagacctccagtacatgacatgatacatttcttcactgcttagggccgtctttctctcaacagggtattgtagttttctgaatggaggtcttcaatatctttaatcagatttacacttagtagtagtcctccttctttctaattacataattagaaacagtgtctatcactaaacatcactaattcactcaccactacgtgccaggtcctgttctaggcactgaggccacagcagcaagccagacagccccaagtccttgccttcatggagctagccagtgaggagagacagcagcgccagtaaagcagcgcagggcactgtggactctgtgatatttaatgccatggagggtaaagggcgggagacctgagaggggtagcttttgtgttttaattttagagtggtcatggaagaccactgagcggttgacatccacacgaagatctgaaagaagagggaagtgagctcttttttttaaggcaattttataactttatttgatgtatttgatgatcagctgttagttctcatccacattgactgtctatagatttttgaaagcagtaacgggtacataagtaatcaaagtatagagtttatttggtgaatcttcattctctttacattttctggacaaccgcacacggatgcggtatgggatattccttattcctttggtccagacagctttgttgagcctggtatcaatgcacatatctggagttcccatctccttcatggcaaatttccaaatctctttgagtgcctgaggggcacgcttcttgaaggccactctgtggatgtgctgtgaatgttgatggcgtatctcaggtcaccaccttgttgatggtagaacggccctttttcttctcgccaccctttgtaggagccattctgccaggcccaagttggaaaggaagcgaagcaagctcttagggtgtctgggaaggcacgttccagccagagggatcaacatgtacaagcgcccgaggtggggtgtgttagcagagccagaggcccatgtggcaggcatggggtgttggaggagagcatgggggtggggtgaggctttagtttgtgtaatttggaaattactgtttatggaatgcctactatctaccaagtgtgatagacagttttgctggtatctcctcctttatttagtctttataatagtggtgtagagaatttaaaaccagtttatagatgagaaaacaaaggcctagcaaggtgacatggctttgccgaggggctgctggtgagtgactccagagtctgtgtttgcgcctccacatggtgctgcacactcagtgtgcctcatgtgttattatagtttatgcatttaatgtgtgagttttagaaaaacagacaattagcagataagtaaagatagatttgtttattgtcatttgaaggtgtggttgacaatagggccctgtgagcatgtgcctgaggagcccaccagcaagtaccaaggagccagcatagctgtcagggtgtcctccaggccgagtttggtgagttttctttgtgttagcatgagtgcccatgtctgagaaatgtggcactgggaaatcaatgcctgcgacaagagctatcacaagggcatgtggagctagggtgtctcagtgccatctccttgttctcagttagctgtgacttaactctgagtgccattttgtttttccctcccttccccttcccactgggtgtgagcgtgggacatatgaaaaccctcttaccattgtggggaactagtgtcctgagggacccagtttgggaaacattgagctaccttgatgttgacagtgagtgtgacatggagaataggaaggggcggtgaagagaagtatgggcaaggagggagtttgtagaccttgcttcctatcagacagatgcccgtgcctggtggagccttctttctaaggaacctaagtcagcgtgcaccagctttaggataagatgtttcagtttggctgtgtgtataaagaaatgggattttaaagttcctcatcattttattgaagcatggttacatctttacctctcattctgagttttctccccaaatccctgcagagagtagggaagaatgttgcctgccagtaatgataaccagtcattgcccagcagtacatcctctgtccagtggctgggcctgcagtggatgcctgtgaattgaactggcacagctggtagactcagttgcttctcagctgttcagcgtggattggtgcagttatttaagcctagccacaggcacagttcctgccagatgctgctgctgctgatagatgtgactgagtggccgtatgcttaccagaagcatttgtccatggcagagacctgtgacttgagaccttccagctggaggccatcagccaggggagctttccgagtgcctggttgagattgtttcagtgttcagagttgttggtggccctcttgttacgctggctgctccaggtcaccagcgtagattctctgccccatactccttcccactcacaaatggtttaatgagcgagcacattaacaaaaaaaatctgtctactgttgggaggaaacgtggtgagatacaggcagggttttcatgtccatccaagctcttgatagaactttgtgaggagaaaatagccccagaatgtcaagaggggactaaactgagaaactgtagaagaaaccaagcagaatgtaattttatttattttcatttgccagagctttaatagtgaaatagtgctttattggggtttgttttctgtgtggctccattcctgtgattttcaagaataagcagaactaatctagggtggtagaaaccagagcatcagtcacttatgggttgggctgcctagaagggacaggagggcatgagggagcttcatggcagggggagagacacactgtatcttgacagagcgatgttttttgtggtgcatgcatttctgttagaccttaattttactcataagatttatgcagtttaccctatgtaaattttaaccttattttgacatccagattttttttttttgagacagccttgctctgtcacccaggctggagtgcagtggcatgatctcagctcactgcaacctccacctcccaggttccagcaattctcccacctcagcctccagagtagctgggactacaggtgcccagctaatttttgtatttttggtagagatgggtttcaccatgttggccaggctggtctcaaactcctgacctcaggtgatctgcccacctcagcctcccaaagtgctgtgattacaggagtgagctaccatgcctggccccactttatagaaaagttggaaaaatagtagcaagtaactctcacccagcttcccctaatgttagcatcttacataaccatagaacagttaccaaaaccacaaaattaacattggtatgatatttttagataatctttagctcttgttagaatttttctatttttctcacatcatttttctaaaaatggctttattgagatataatttgcatgctgtaaagttcattcataatacacaattcagtggtttttagtatgttcacagagttgtgcaagcattaccattgtctaattttagaatattttcattgccaccaatagaaacccccatacctattagcagtgactccatccctggcaatgactaatctgctttctgtcactatggatttgcctattatgaacattttataaaattagtgttgtacagtatgtggctttttgtgtctggcttagtgtgttttcagaattcatctatgttgtatcatgtgtcagtacaccattcatttttatgacctaatatcccattatgtgtatatacgacattttgttcgcccattcatcatttgatggacgttgggttatttccactttttggatgttatgaatcatgctgctagattaacattcctatacaagattttgtgtggtctagccattcttgtagagtagtgtgatagtctgtttttttttttgttgttgtttttttttgctcaggattgcttcagctatttggagtcttttgtacttccattatgaatttcaggattgttttttctgttttttttttttttttgtgaagaatgtcattggtattttggcaaggattgcattgattctgtagattgcttttggtagtatggtcatttttacaatatttattgttctagtttatgaacatgggatgtctttccatttgtttgtgtcttcagtttctttcatcggtgttttatagtttttctttttgagatcttttacttcatgtttaaatttggttaaatttattcctaaatattttttgtagctattgtaaatgggattgcctcactgatttatttttgagattgtgttattggtgtatagaaatgctgctgaattttgcatgttgatttttgtgttcagcaactttctttattgaattcatttattttaacaatttttggtggaccttttagagttttctgtgtatacaataatgttgtctgtaaacagggacaatttgacttcctcttttccaatttggatgccctttatttatttttttcttgcctaattgctctagctgggacttacagtactatcttgaataggagtggtgatggtgggaatctttgtcttattccagatcttagaagaaaagctttcagcttttccctgttcattatgatgttggctatgggtttgtcatatatggcctctattgtgttgcttctgtacctaagttattaagagtttttgtcataaagcgatgccagatggtattaaatgctttttctttatctgttgagatgaccatatggtttttgcacttaattctattaatatgttgtataatatctgttgatttgcatgtggtgaaccatgcttgcatctctggcataaatcttttttgatcatggtgaatgatctgtgtaatatgctgctgtatttggtttgctagtgttttgttgagaatttttgcatccgtgtttatcatggatgttggcctgttgtttttgttgttgtgtccttatctggttttggtatcaaggtaatgttggccttatagcataagtttggaagaagtccttcctcctcaattttctggaagagtttgagaagaattggtatcagttctttaaatgcatggtagaattctacagtgaagccatcccattctgggcttttctttaacagattgaatcttgttacttgtaactggtctcttcaggtttctgtgtcttctttgttcttcttggtcggttgtatgtgtctgggaagttatccatttcccctaggttttctaatttgttggaatagagttctttttaatagcctctcatgatcctttctatttatgtaatatcagttgttatgtctcctttttcatttctgattttattgatttgggtcttttctctttttcttggttcctctagctaatggtttttgatttttgtttaacttttcaaaaaaccaactttttgttttgttgatattttgtattgctttttactcttaattttgttttgtttttgagacatggtcttgttgtcactcaggctggagtgcagcggtacaatcactgcttacagcagccttgacctgctggggccaagcaatcctcccaccttagcctcctgagtagcttgcattataggcacacgctgccacacctgacaagtgggtgtttttgtttgtttggtagagacggggtctcgctttgttacccgggctcgtcttgaatacctgggctcaggtgagtctcccatcaccgctttccagagtgctgtgattacaggcatgagccatcacatctggccttaattttatttatttcttctctgatctttattatttctttccctgtactagtttggggtttggtttgttcttgcttttgtatttccttgaaatacattattagcttatttatttaaaatctttccacttttctgatgtagacatttattgctctaaatttccctcttagcactgcttttgctatatcctattggttttgatatattgtgttttgattttcatttgtttcaattaattttaaaattttcctcttgattttgttgttgactcattgattgttcaggagcaggttgtttaattcacacatacttgcccaattttgaaagttccttattgttgatttctagttttattccactgtggtcaaaaaagatacttgctataattttaattattttagatttgttgagacttgttttgtgtcctaacatggtccaccctggaaaaggttttgtgtgctgataagaagaaagtgtattctgtagctgttggatgaaatgttctgtaaacatctgttaggtccatttggtctaatgtgtggttaaagccaaagtttccttgttaattttatgtctaggtgatctgttccatgttgagagtggggtgtttaaatttttaactattatcatattggagtctatctctccctttagatctaataacatttgctttatatatctgggtgctgtagtgttgggtgcatatatgttcagaattgttatatcctcttgctgaattgatctttttaacattatataatgaccttctttatagtttttgacataaaatctattttaactgatataaataaagctacccctgcttgcttttggtgttcatttgtgtggaatatcttttctttatccctttgctttcagtctatatgtgtctttacaaatgacatgagttacatgtaggcaatatgtagtttgcttttcactggggtctgttactagagagttaatattttttcaaattaattcagctagtctatgtcttttaagtgggggaatctaatctgtttacatttaattttattagtgataggtaaggacttactcctgtcattttgttgttttgcagttgttttgtatagtctttgtttccttcttcctatcttgttttttatcattgaggtttagtgaggttttttaatgataaggcttgattcttttctctttctcccttgtgtatctgctgtaccagtatgttttatacttttgtgggtttttaagagagtgtttatcatcttttcacttccagatgtaggatttccttgagcatttcttgtaaggccagtctagtagtgacgaattcctttaagtttttgcttgtctgggaaagacgttatgtctccctcatttctgaaggataactttgctgggtataataatcttggctgccaattttattctgccatcattttgaatattacatcacattttcttctgggctgtaaggtttttgtggagaattttatgctagtctaatgaagattcctttgtatgtgacttgatgcttttatcttgctgcttttataattttatctttgtgtttgatttttgacaatttggctacagtgtgcctggggaataattttttttggttgaatctatttaaggacctttaaacttcctggacctggatgtccatatgtcttcccagacttttgaagtttttggctattatttaagtaggatttctatacctcttcccttatctctcttctccttctataattctcattatatgaaattcatttgcttaatagtgtcccataagtcttgcagactttcttcactctttttcattcttatttctttctttctcccctctgagtgggcagtttcaaatgacctgtcttcatattcagagattctttcttctgcttgatcaagtctgctgttgaagctctctattgtattttaaatgtaattcattgaattcttcagcttcaggatttgtttagttctttcttatgatttctgactttttgttgaatttcttgtttggatcatgaattccagattttgttgaattgtctatatgtattttcttgtgtctcattgagtttccttaagatcatttggaatttttctttttggcagttcactgattttctctttgatggggtcttctattcctagaaagttattatgttcctttggtggtgtcctatttccttgctttttgatgtttcttgtgtccctgcattgatgtctgtacatatggtggaataattgccttttccagattttctagcatggcttttgtagagagagacttttacctgaaattgggttttagtgtgccatttaggaaaggtgtagtgactgttgctggttaggtgcagtggtatagtctccatgaacctttttcagctgtgttcagtgttagcctcagtggcccaggctatagaagtttgttacagtggtggtgacagtgtaagttgttaatgtccttggtatcaagggcttttggggtcctcctggtctcattttccttgcaatggggagacttagctgaggggaattcctttgatgtctgctctgacatggcctacaagcagctgccatggtgctgggttccaggtgtaggtgcttgtaatggttgcagggctgggttgcgacccctattgtggcatgtgggtcttggggtacaggtttgctctcttatggcagggttggatttaggtggccctcagagccaggatctgtgactctgaggcaccctctagcagctcgggcccagggggccaggttgtaactgtgattctaccccagggggtggggcagggtacagcactggcggaactctgaggaagaaggggtgctctgggggcttgggcctggggagccagggtatggctgcagttccggaaccggagccaacagggctcagtggcagctccggtcccaggggatgtgacactgtgtaataatgactcaagaccctgggatggtggggcttgtaagtatcccagactctgtgaggccatgtgtggcaggagaacgtaccccagaatgacagagcacacctgtcactggggccctgaggagggtgggaagcagcgtatccatgactccactctgcagggagagaggtgtctcagcagctcagactggggtggggggctagttcagctctagggaagcaggcagttgagttgtttggcctgtaaggtgggatgtctgggctcagctactgctctgtttctctgggatgtagggcactgcatcagctcagccctgggatgtgcagctgctcagctcagccagggcactgattccccttgcggtggtgtgtcgcttccactcaggcctgagggacgggactgtcctgggtggcccaggcatttccctggatgcagagtgcttcttcaacttgggttccaggaggcatgactgctctgagcagccaaggtattgttttccctggaggccgtttatggctttagctccagcctgagggggcaagagcgggtagtggagtggccccacctttgcttggccccacagaggaggtgtaacagctgcctgcagcttggctgggggatgtggggccactgggctggggtggttgggcagcggcttagcttcaggggtgaaggggagctggggctgctaccccaggaacaagatacactccagcagtagttccagttccaagagggcaccgtgagggccacgggggcaggcacagtgtcgattccttctccggcgggagcacagtggtgtggcctccaggcagctcactccaccctgggcttcgtgcctgtgaggactgcaagggaccccaagggtgagggcggtgggtgtccacggtgttggtgggggctgctggggtcctcttgattacctcctcactgaagggaggtgttttcctgggttctagctgaccctggttaggggatggggtgccaggggcccggcatttccttctgttctttttgtgactatcatgaatttctgggctcgccagggtttctgttactcctctaatgcactttagcactctccctcagttgtttttgttaacatgtagttgtgtattcattgttctggctgtctctgtgagggggttgaatgctaggcacttctagctggctatcttgataatgttacccagaatgggtagtttctgtcgtcctatcttccaatttactgattttttttttttttttttgcctctgtcccctccattctgtcttcaccaagattttaatttcagttattttattttttctgttttaatttttccattttggttttctttatatgttgtttttttctcattggtttctagcacagttgctcactaaagaaattttttgatggccgatttaaaaccaccataaatcatatcagataatttgaacatctgtgtcatctttctgctgatgtcaggcaattttctttttcatttaagttgcctcatgtgtctttaaacccaaagttcagccatgactatcgtaaatgttctcagtctcaagtaatgaggcttttcatgattagacctgagctctgtgttattcttctacctatgttgtgagcagagttttggtgcgttatcagccattcacattcttttcgtctgtgttcccctcaaaggctgtcaccctgctgtagtgttttccttatgatgacgtcctcatgaagttgttccatgttttccttaggatgatgtcctcatgaggttgttccatttgggttgtgcccttgacagcatttgtctcatggataaagtggcctgttttattttaccctttcagggggctcacatagctatctcttcagcttgactagtgatgcaatttgtccagaaatttccttatcatttgtgtcccttgtatcccatcagccttagccacataaaataaatcctttccattcatttagcaaatatttactgagcccttactgtaaggtggtgaacaacacagccaatgttctgctttcatgaagctttcagactaaggaagaacacttattcctatttcatagaataactattattgagagaactaaaataggttaatgggcttgacaatgagtgggcgataagggatggcctctgtgaggagagaatatgtaagctgaaatgtgattcttttctggaatttccatttctgtttatattatacatctgttctttcatatttctactttgccattagaatttgttatatattgaattgtgttctccccctccccaccccccatttatatgttgaggttctaaccctcagtctctcagaatgttaatgtatttagagatagggacttttcattagagtaaaattgggccattagggtggaccctagtccagtgagactggtgtctttataagaagagaagatgaagatacatggagaaaccccaggggcctgtgtgcacagagggatgaccacatgaagaggcagcaagagggtggcgtctgcaagccaaggagggaggtctcagaggaaagcaggcctgctgagaacttgatctcagacttccagcctctagagactgtgagaaaataaattcatgttgttaagccacccagtttgtggtattttgttatggcaggctgggcaaactaatacaaagccattagcatattaatcatagatattctgaattccctatctgatacttctaaaatctgtcatctgtgcagctggttctgatgcttggtttgtctcgtcagactgtgatttttctttccttttagaatgccttgcaatttttggttgaaagctggacatgatttattgtgtaatggggactgaggaaaataggcctttagcgtgaggtgttttggtaatctggctaggagttgggctgtgtttactgtaggggacagaggctttatactcttctagcatccttgtttattctcccctcttccctttgggtttccctaagaattcctccttagatggaattgatgtctttcagctctctcagctataataccgttttaaaaatccctgttgcgtgttatgctctctcatctctgttggtatgatttaaggtgtgtgtggagaggagaagtatttatcatctcaatcttttagtgggcctgtgtctctgggctttggtcttcaaaagtgtttcttaaccccctcccctgcttaggtaagtcagggatggcagagaggcctggagtgggagaaaagcccttccctttaggtgagataaggctctggtgaggtctttccctggaaacagggtgtattcataatggctactcttcctgtccccctgccagagccacgagggagctttcttcgcactttgagaacctcatggggttcctagagacaaaatccacaaaaatatggggcccccctaagactgcgacccccaggagttcctgattctcatggttgtccaccctcagcttccaacaatttgtcatttaaatgttcccaccggtatggctacagcagcttttcctccagggaagcagatcttgttgtgactctccagatttcatggtggccttaattctttgatgggtccaagaaaagtcattgatttgtttgttctgcttttcttagtgaaggatggaagtgctgatttctaagctctttgcattgttgacaaaaagtgtcaaactctgtaaaatatttgaagggatttattctgagctaattatgagtgaccataatgagggcctgtgacacggccctcaggaagtcctgagaacattcagctcaaggtggttgaggtacagcttggtttaatgtattttaggaaggcatgagacatcaatcaaatatgtttaagaattacgttggtttagtttagaaaggtggacaacccaaagcaggggctttcaagtgataggtaaatttaaacattttctgggtgacaactggttgaggttgtctgaagacctaggatcaatggaaaggaatgttcaggttaaagataaaggattgcggagaccaagttttattgtgcagaggaagcccgtagatagcagacttcagagagagcaggttgtaaattgttttttatcagacctaaaagggtgcctggctcttaattgattatctcctggatctgcaaagaaaggaaggaaaataaaagaggaaggggattctctgtagaatgtggatttttcccacaaaagactttgcagggcaatttcagggcatggcaaggaaatatattttggagttaaatattttgtccttgtctcataatgttatgccagagtcagattgaaaagtaagtcacaatatatagggtcaaatacaactcatctgatgagaatccatggtttgtagggcatgactccccagaccccttaggtaggaatttgggcaagatttaaaaaatcggagcttagttctcagcatgttggagctggaattgctctactgagtgagatttgaaaggagcaagacatgtgaagattggggcaggaacattctggttaagaaaatgcagagcaggctggcgctcctggggcatggtgcagatggatgagtgatacgaggggaacgccgggaagcaggagggcttgatctggcggggcttcatcagccagaacgaggacttgggtctccatcatgagtgcagtgaggatctgtgggagagcagggaaggtgtgtattctgatttctgtttaaaaagtttaaaatacaaaaattagctgggcatggtggcatgtgcctgtagtctcagctactcgggaggctgaggcaggagaatcacttgaacctgggaggcggaggttgcggtgagctgagatcatgccactgcactccagcgtgggcaagagaaccagactctgtctcagacaaagaaagaaacaaacaaacaaacagtttaattctagctgcagcatggcagatggataggggtaggaagaggcaagaatgcaaaattaaataagcaagccaccaagaaggctattacagtagtctgggggaagcaggatagcttagactagggtggtggttatgggcttagggcgtgttgggaggtagagttgataagatgtgatgtgagagaagagacgaatcaataacaatacctgccatctttgggtgggtaaatggtaatgctgtttactgagaatacctgcatctttgggtgggtaaatggtaacgttgtttactgagatggggaagatgaggcaggagcacagagaatcaggagttgggtgttggccttgtgaaacctgagttggcagtaaattcccaaggggagttgtccaggcaagtttttgtggctatgaagtctggaattccagggaaaggctggggttggagaaatggatttagagtcactggtagatacatgggatttgaagtcatggagtagacgaagtcacctaaggagagtagaaagagaaggaagcctaggacagagccctgggctagcatctaaaggagaagtataaggagggactggtgaaggagtgctatggaagccaagaaaagccagaggagtcaagtgagacgaaagctgagcagtgacaacatggaggacattggtgaccttgagagaagctgtctcagcagtgagcagatggtagcgtgactgaagggtgaaggtgaggtggggcggtagcaacaacagaccactcttgtaatattcctgggaagggagtcaagaactgggcagaactggaggccagtttggggtcaaggaagattttttttttttttttgccttcttgttctttgaagcttgtaagaatgggcttatgttgctgctcgatgactccatgttcctaggtgctcaaggagcctggggcattgcctaagatgtggctgacatggtccagaatccatatgtgctttggaggtggccaggaagcccataggaggagggaatgctcagtgtgtgccctgagagctttgccactgtcagaaagcacctgacaggaacaagtttgattgtatttgacacatgccggcactaccacagaaagttttagcaacagataagaggggacatctgtactctcaacttcttttttcatacttcctattgaagttttcatctctactctcaggcatttaatttctaagactgctgtttatttttaattgtcttaaaaaatagcatcccattcttgtttaacagatgatatagcttcttttacctccttgaggaagatattaataatagttttttaaaacttttcttctcactgcacaatctcttttctttgtcctccttttgttcctgtttaaaatgatagccatttatctttttctcaggtgtctggtgatgtgtggttgtctggtcatgtttaacagtgggatttataatgccgattggaagctgtgagcatatgggtggagcttctgaacttttctgcagtgtgagctggtgcatcaattaattgggaacccataggtcagtatcttcgactgtgttgtcttgggttgttcagattgtctggagaagactcacccacccttatttctggagggatgaaggcctataaactccggaaacaaagtagagatagagggaatgtcttagagcttgtaggtatgtgtttatctaatccacatgttttccagacagaacctccatcctcaattgtgcctgatgtttcacctccagagattctttagaaaataaatgtccaggccaggtggggtggttcacacctctaatcccagcactttgggaggctgaggtgggcggatcacctgaggtcaggagttcgaaaccagactggccaacatgatgaaaccccgtctctactaaaaatataaaaattagctgggtgtggtggcaggtgcctgtgatcccagctactcaggatgctgaggcaggacaatcacttgaactgggaggcggaggttgcggtgagctgagattacgtcactacactccagcctgggtgacagagtgagactctgtctcacaaaaaaaaagaaaagaaaagaaatgtccagtctctactagggaagggcatttttccagaggcagggaataggggagagggtccagggatctaatttcttattattatttttatttttttttagttttgagatgcagtcttaactctgtcgcccaggttggagtgcaatggcgtgatttcagctcactgcaacctctgcctctggggttcaagtgattctcctgcctcagcctcccaggtagctgggattacaggtgcctgccatgacacctggctaatttttgtatttttagtagagacagggtttcaccatgtttttcaggctggtctcgaactcctgaccttaggtgatccacctaccttggcctcacaaagtgctgggattacaggcgtgagccaccaagcctggccttcttcttatttttaatataaagccagatttgttgagttataatttacatagaacaaaattcacttgttagtagacaattgtatgagttgtgacataaaactatctcagcatataactcatatgctgagttatgtggtaagtatgtgtttaaatgtataggaaattgccaaattgttgtctcaggtggttgtaccattttatttattttattttattttattttattttattttattattttattttattttattttattttattttattttattttattttattattttattttattttattttattttatttattttatttatttttgagacagagtctcgctctattgcccaggctggagtgcagtggcacgatctcggctcactgcaacctccacctcgtgggttcaagtgattctcctgcctcagcctcccaagtagctaggattacaggcgtgcaccaccacacccagctaatttttgtatttttagtagagatggggtttcaccatggaggccaggctggtctcaagttcctgacctcaggtgatctgcctgcctcagcctcccaaagtgttgggattacaggcgtaagccactgcgcctggcctggcagtaccattttaaattttcaccactaatctatgaacattccagttgttcctcattcttgtcaacacttggtattttcagatttttattttttaattttagccattctaataggtatggatttaatttccatttttctaatagccatgatgctgagcatctttttgtgtgcttgccatttgtgtatctcctttggtgaagtgtcttttcaaacactttccctatttttattgggctgttgtgttactgagttttcagagatgtatgtgtattctggatttaggtcctttatcagatacgtgttttgcaaatgttttgtcctcatctagtggcttgtcttttcattgtgactgtcttttgaagagcagatttttaaaattttggtgtggctaataaattatttagttgtatggattatgcttttggttttgtgtctaggaaattgttacctaattcaaggtcacaaagatttttctcctgttttcttccagaagttttaaaatttggggttttacatttaggtatgttattaatttttgtataatttttgtatgttaggcaaggtatagattgaagttctttgtttttgcatatggatgttcaatttttccagcaccatttgttgtaaaggttattctttcttgattgaattgaatgtatacctttgttgagagttcacaaagctgtggtctgtttttggatcctctaattttatttcacttatctctttgtctgtcgctctgtcacttgaccagtaccacactctttatggccataaatgttgaaatctagtactgcaattccccaacatttctctttctctaaattgttttgtctggtctagttcctttgtttttccaaataaatttgagaattacttgttgatttctgctaaaatttcaacttggattttggttggcattgcattgattatatagatgaatttgaggagatttgacattttaacaatattgagtcttctagtccataaatatggcatattctctccatctatatgtctgtggatccttatatctgtgttttgttgttttcagcatagaaatcttgcacatagtttcatgagatttatacttaagtgtttcatgttttggtgctattatataatatatggtaatttttaaaaaacattagatttttaattttttgttataagtatgtggatacaattgacctttgtatgttgaatttgtattctgtgactttgctaaactcaattagttctaataactttttttctagtttctttgggattttctgtatagacaatcatatcatctgcaaatagagacagtttcatttctgcctttctaatcaataaaccttttatttctttttcttgccttactgcacaggctaggatctctagtatgattttgaataggggtgataggatattcttgccttgtacgtcatcttaggaaagaagcattcagtcttctatcattaagtatgatgttagctgtgtgttttttgtagatgcccctaatctggttcaggatgttcctttttattcctgttttgttgagggtttattattattattactgttatgaacagatgttgaattttgtcaaaaggcttttctgcatttattgaagagataattttttttttcttctttagtctgttgttacggtaggtgatgttgactgatttgcaaataatgagccagccttccattcctagaataagtgtctattggctgtgaagtattatcctttttatatattgctgaatgcaatttgctatttttttgtttaggattttcgtgtctttgtttatgagggatattggtctgttcttttattttaacatctttatctagttttggtgtcagtgtaattctggcctcataaaaaaaagttgacttatttcctccttttctgttttctggaagacttgtttaaaatttctattatttctgttctaattttttgatagaatttgacaatgaagctctctgaaatgttatacattgcatgactgtttacctttaaataataatccgctgcttcaggtatagtgtaagtaccttaaaacagtgttttcccatctattgatcatatttatttcagattctttttctgaaattcctgtattattattccaggttatctgtgtgtctgcttctgttgattgtcacttgacaatgagccttttgtttcctttgccttcttttgtttgtttgtttgtttgtttgtttgtttgtttttgagacagagtctcactttgttgcccaggctggagtgcagtggcgcaatctcagctcactgcaacctctgcttcctgggttcaagggattctcctgcctcagcctcctgagtacctgggattacaggcgtgcgccaccacacccagctaattgttatatttttagtagagatggggtttcactatgttggccaggctgttctcaaactcctgacctcgtgatccgcccgccttggcctcccaaagtgctgggattacaggtgtgagccactgcgcctggcctccattgcctcttcattgtaatttttgatttcagtgttggacattgtgtggagggcagtaggcaaggtcaaaaaactttttctgtaatgggccaaataaatattttgagttttgagagccacgtgtagtccctgttgcatgttattcttctggtttttacttttaaaaaattacccttaaaaaatgtaaaacctggcaggctgcaatggttcatgcctctaattctggccctttgggagactgaggtggaaggattgcttgagcccaggggtttgataccagcctgggcagtgtggtgagacaccgtctctacaaaaaaatgtgaaaaattaactgggcgtggccacatgttctgtggtccctctttcttgggaggccgaggtgggaggatggcttgagcccaggagattgagactgcagtgagccatgattgtaccagagtactccagcctgggagacagagcaagaccctgtctccaaaaggaggaggaggaggggggggggaggaggaggtggtggaggaggagaggagggggggggaggaggaggaggaggaggaggaaagaagaagaagaagaagaaaaaaaaagtaaaaccattcttagcttgcaggctgtacagaaacgggtcatgggctacctttggcctctgggccatgcgtaccctctctgtagaggggaatgaggtgggtagatagtgttatattcaggaatggccactcctctttttccgctgggttttcattgttggggagttaaggtgggtctgggttttgttgttgtgtatgtaccttccatcccactggcttcaaattcctctaacctttccttgagcttaggatgagggctgagttgccaaagcgtcttcacccatggcttttggccttgcctctgtgtctgccttagctgccccttatctttggcaggtctctactagagaaagttcccctcccttcccccaaagtaggaggactctaacaggctggcttaagatggctcctggaccctccctgagggctagagcagattgccttttatcttccctggccacagcagtcttctgattctgtaggtgagaagcttcttgttagggcttagtgctgtggcagctcccactgagagactgttcagtctgctctttcagtctacatcttaaaaggtttttttttaatttttttatttgttaagtaaatgtgctaagaaagaggtgctgattttgagcctggttccagttgcagtacccagtcaaggagtgaatttacggcatcgtaaaggctgccagtagagaggaatggtaaggaaagttggctccactctggtgatggattgaagcttccagtgggtttgtctagctattttttagtggttgctacaatgtatgcaaggctaccagattctataagtcctggggccattcccatggaaaataaacaacgtgaattttatatacccagtgacattgtgtaaactcagtggccctgataagtgctgtatctgtatgtggtccctgagggatttgctgcaattggagtgaaaaagaagtaatactttttaaaacaatcttataagtggacagaatgctactgtcgacaaagagtcaaactctgcaaaatatttgaagagatttgttctgagccaaatatgagtgaggtcctgagaacatgtgcccaaggtagttgggtgcggcttggctttatacattttagagaggtgtgagacatcaatcaaaaacatttaagaaatacattggtttggtccagaaaagtgggacaaagctggggggcgtggggcttccaggctataggtgaatttaaacattttctgattgataaagacctgggattgatagaaagggaatgttcaggttaaggtaaagattgtggacatccaagttcttttgaagtcttatggtggctgccttagagacaatagatgacagatgtttcctattcagatcttagttaatctctttaggattaggagggtctcgaagaaaaagatctagctatgttagtagagattctttacaaatgcagattttcccccacaaagaacagctttgcagggccatttcaaaatatggcaaagaaacatattttggggtaaagtatttttattttctttcttgtctcataatgttatgccagagtcaggttggaaagtcatgatatatagggttaaataaaacccatctgatgagaatttgtgatttgtaggacatgactccccagaccccttagataggaatttgggcaagataaaaaaaatcagagtttagtcctcactagcaaacagagaaagccctcatctttctagtttaacactttaaaattgtatgactgtaatatttgaagatgatggttattagactattgagttttttgatgctgcttttatgagctaagcttttatatcaagcagtgactgtgtttctgggttatcctgtagttttctaaactgtcaaacgtgttattcagaaaggccaggaaccccttgaggggtagattgcagtagaacattttattctaggccaggcgcggtggctcacgcctgtaatcccagcactttgggaggccaaggtgggtggatcacttgaggttaggagttcgagaccaacctgaccaatatgatgaaactccatctctactaaaaatacaaaaaattagcgaggcatggtggcacacacctgttatctcagttacttgggaaactcctgcctcagttacagaggaaagctgaggcaggagagtctcttgagcctgggaggcggaggttgcagtgagcagagatcatgccaccgcactccagcctgggtgacagagcgagactctgtctcaaaaaaataaaacaaaaagaaaaaagaaaattttattctaaccagaagcattacctcttttccctagatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgtattacgacccttgctgtctaaaatctaaacttgatattaggaagttagatttctgcatattaccatgctactcttggttggtggaaaaaaaactcttccttaaactgttctgggccctttggctataaacttagaagtcctatttttcttataacaaatgctgtaaaaacaacttgtataatagattagaacacatgcagttagttgagattccataaatgaaatgatagttccagctccctttttgtgcatgggtgtgcctgtatgccagggccctgccatgtctgtgttatctacctactggttgccatccagcttgttttctaggccactggcagagagcaagggagaatacacttcatttctcatggacaccatgattggtgagagttgccttttgtattagtctgctttcacactgctgtaaagaaatgcctgggacttggtaatttatagaggaaagaggtttaattgactcacagttcactgtggctggggaggtctcaggaaacttacaatcatggttgaaggggaagcaaggcaccttcttctcaaggtggcaggaaggagaatgaatgcaggagaacctaccaaatatttataaaaccatcagctctcttgagaactcactatcacgagaacagcatgggggaaaccgcccccataatccagtcacctccacctggtctctcccttgacacatgggaattatggggattataattcaggatgcgatatgggtggggacgcaaagcgtaaccatgtcaccatttaaatcaatccttaaagtcacgtcacgtgaacacattcccttcttttcctgggctgcttccttcggtgtgatgctggagggctgctgggctctgggcatgctgtaagagcaaaacaaatgcaggtgcaccccaccagtggcagccccatctacaagaataagctgttttgttgcatatggcattttagagtaacttcatttttcttttaagtacatttttataggcagtgtgcaatttaaggctgaggctgagtgaagaagtgtagaggaaggcacagttgcttggatttcacgagccagcatattgtggaacactagctcatctgagccagaggaatgttgcaaaaggcaatttaaaattcatggaggcagaaatcgatccatctgtgctgtgtggttctgtaggtcctgattattggtgaataaaattaagaatgttgtgtttctatacttaatagcatggtgctatcttctttttgattgctatttatttaataaggtaatggggaatgctgcctctagaactacaggacctctttctgccagagatggggtcaacagtgtatagagaggagtgagcgttggccagactcttggatgttgtgtagtttagctaattagtggatggatgtgtttaagaaggatcatttcttttctcctgattttgaggtgctaagaatagcaagagttcttacgaaaactcttttaggaagaaacatgtgacaactccatattttgaatgtatatcctaggaaaagtacataaggccagttttaaggagtgatctgcctcctgctcttcatatgaaggtcaacaggaaaacacaggttctttaatttttctacaactagttatctaaagaaaacctactcagttttttaaaaggtattcataaaaagcatgtactttgcagatctcgtgaattttaaaatcagacaaagtaaaatagtgcatatattttgaaatgtttgtttgtttgtttgtttaaatggagtttcgcttttgttgcccaggctggaagcgcagtggtgcgatcttggctcactgcaacctccgcctcctgggttcaagcaattctcctgccttagcctcctgagtcactggaattacaggcacccgccaccaggcctagttaatttttgttacttttagtagagatggggtttggccatgttggccaagccggtgttgaactcctgatctcaggtgttccacccgcctcggcctc

SEQ ID NO: 12652 - DNA, 11858 bp, Human
agttaaagtacccactcttcaagaatcaataatcgaagaaaagtagattagaatgttacaggaaaaatcgagacacagatagtgattaccctgacagtggaaacaattctatgtttttagtctggaaacaatgatattaaaactcggcaagcattgtagatgatcatttttatttgtgtcatgtctcccaaagtccttaaaatgtgattattatcatatgcgcacagaatgagagagaagagttaagaatgatttccagatttgtggtttgggagactgaatgtgacaaaagtctcaaaagtataaaatgacaggagcagttagaagtaaaaggagacagagaatttcgttttacatatatgcccttgagacatgcaacaggagatgtctagaaagcagatatacacacacattggaaagcaggtcttctagaagctgggttgcagatacagactcaggagttaccatgatggaggagatggttggaaccacagaatcatgcaggaaatgtgtatagagcaagaagagcacaaagcagaggacagaatctcaaagggttccaaatgctagaaatgctcttaaataatgttataaagaggaaatagagctttgggatatagacagagagaagtcaccagaaaatgggaggaaaaactaggaaagagtaatgtcagaacaactaagacgaacatttaataaaagggggtgggtcagtattgtcaaaggccaagtatgcttaacactaaaagacttcaacagattagtaaatgtgaggatcattgctgattttctgtcagaaccattttagggaagcagaattagaagtcatattttggttggcagatcatgagtggaatggtgaagaggaaatagattggaggcagccagtatactactctaattttcctacaatgaacatgtagcaacatttgtataagaaaattataaaaagactaaaatcagtttggctaaaaaaatcaacagtaagacaatagctggaagagggccatgcagatttgaagatcatctgttgtttaaatcctgagggtttaggaaaaggagagggagaaatgcaacagagagaggagacaattgttgtgagaaagcaagtaacacttggttgtcttcttaaaatgtgatgtgagtacacctacatacctataggactagtaaaaaatcatgtcaaaataggatctcaatctataaaaaccctttaatataaatgcattttccagttgagagtgtagggctaattccaaataaggctattatttctgtaattgtttataacaaactagacctaactctgtgaagcaatccattactattttgtagatgacaaaactgaactttaatttaccctcctatggttaggagagaggaaagaggtggttcacaaaaggtcctctgaatccaatgcttaatcctcttcacggtgctctttgacaatactcatgtgagctgttaaatgagtcatataacattcactgaagctagaataagagagattttgaaaaacaaaacaacaatcaatccacataataacacctaaatgaaatattttttgtttgcatcttttctcaagaagcataattttttttcatcaagtatcagaagtggaggacacactactttagatatgtgttaaagaaaaaagtagcagtgtaacagaatgtctcataagggactatatgcaaaacatgtgttatattataatgaataaaaaattatcccaccttagcaggtacttggaataaattgttaaaagaaatataataggaaatagggatacaaaaattatttctctgaaaaaaagcataataccaagattagcaccaaaatcaggtagtgctttccagatatcacatttacattttttcaaatacatatatttatttatttttcccttagtcaaacacattacagcatctattttatatcaggaacagataaaatatgtccatataaacagaagacattggcttttaattatttgtattcaatttttaagaaatgatcatctagggaaaatgttttaaaatcttttaaaatatctttttgttatactttaaaactgccttcagctgcctattggtaaataaggtctggatatcagtacatgacaacatatactaatgaattgaactgtgaattaggaatgaaaattgcctagaaatttttttatgagttattaggattaaagtaagaatttcctttgctgggctgtgtaggcactaagattccgtggttgttggaggggttaaatttggatctactagtgcatatattttaccgaggattcataaaaacacgacagtggagcctgggtcaatccattaccatgtacaagcagtgaccaatagaaaaggaagaagaagatccaagaaggctgaggtaagcagtcttctgaagccctgtcaaagtggaaacaatagatcaaaggtgttcatggtgactgggacgagtaggtttcactgtttctcataggagacttgacagcttaaagtaaaaacaaattattttcgtcaaagtttttttttttctcttaactgatttttagcaaacctcagactgagacacaggactcaacggtgtattcctggaaggcaaggtaaactattttgcacttttaaaaactcttaaagttaagcatgcaaagtacttattcaacagacgcagggttacaacttcaataactaaaccaaaaccctattctgaaaaagaaaaaaaaaatgatgtttctttgttggaacatggccagagcagcgttctgcaatcctagaaaatttgacagcttgcagaagcagttctgcacttgttttctgcaatttaatggcaaaattgaatgatcagcatttcataaatgaagttgactttatcttttcctaaggaatcagtaaaatttatttcatcctattatcaatcagttcaataaatgtacattggtcagaatgttactgatatatatatatatataaatatatatgtaacatatgtatgctataaattattaaaatatatatgtatatttcctgttaaaataattatttgtaccaataatctttgatgatcagtggggagggtttatgtgttttaaatgtatcaaatattagtaaacgctaacctactttccattatccacactgataatatgaatataaagaaattctccacccgtatcctaaatatgtttttggttgtttttgtttcttatcaaccataataatggcatagttgaatacaatactcatgtacttgtgctatacatcacaatgtattcaactctatataataaactctatctctatatatacatatatatacatatatagagacagaatatacatattctctgagagagagagagagagagaaagggagagagagagagaattgataattcaatagcttggctgaacaacttaattgtgtgcttaaaattatagacatcttcccccaccctcaaaaaacttacttgagaggttgagctagagaataacagattaattacatttttattcagatcctagaaccttccttcaccataaagtgctaaaatgttctttgatcccttcattcctttggttcaagggccaaaaggcctaggaaatctcatccagatgttctgctcatttaagagtaaaagtaaaagcatatgctttcctctcaggaacaacacagattcccagtttgagtttttaaaagatcacttttttgtactctcatattcaactactggtttcagttcagttctttaaattaaatagcttgaaatggaaaaacacttagagctgctaaaattttctttccatttctcggcttttattgtgtttgggttacaaccagaaagctacaagtcggtgaattattctcaatgtttgcaaaatgctttgcatatggtgcctactaactaatgtatattaattaagatctgtgtatgaaatgttgacatattttcacctcttccctgaagaagcaatgtttactgatcattttgatgtataaaattatctaaaggtcaagatcttcaaatatctaacagttgtgttcctttttctgtaggtgctataatggcaggcacaatctgtttcatcatgtgggtgttattcataacagacactgtgtggtctagaagtgtaaggcaggtctatgaagtacatgattcagatgattggactattcatgacttcgagtgtcccatggaatgtttctgcccacccagttttcctactgctttatattgtgaaaatagaggtctcaaagaaattcctgctattccttcaagaatttggtatctttatcttcaaaacaacctgatagaaaccattcctgaaaagccatttgagaatgccacccagctaagatggataaatctaaacaagaacaaaataaccaactacggaattgaaaaaggagccctaagccagctgaagaagttgctcttcttatttctggaagataatgagctagaggaggtaccttctccattgccaagaagtttagaacaattacaattagctagaaataaggtgtccagaattcctcaagggacctttagcaatctggagaacctgacccttcttgacctacagaacaacaaattagtggacaatgcctttcaaagagacacttttaaaggactcaagaatctcatgcagctaaacatggccaagaatgccctgaggaatatgcctccaagattaccagccaatacaatgcagttgtttttagacaacaattccattgaaggaataccagaaaattattttaatgtgattcctaaagtggcctttttgagactaaatcacaacaaactgtcagatgagggtctcccatcaagaggatttgatgtatcatcaattctagatcttcaactgtcgcacaatcaactcacaaaggttccccgaatcagtgctcatctgcagcaccttcaccttgatcataacaaaattaaaagtaagtaacctgcagagtatgtctttgactaaagggctcatggtcattaaatgtatctttattttcattaagaagagcaaatgtgttgccccctcccccgctaatgttcctttagatttttagtgtgttttcaattttcagtattaaattttgtctatacgcagacagtcttaatgaaccaagaagtccaaatcttcaaactgaagactaaaaagtggacttgagtcatctacagaggactattatccattagagaaactgaatgcctctatcttcttttactccaggagattccaatatttctgccccattgggtaggcttatttaagaaaccataccaggcacaaacaacctcatgactagtaataaagaaaatatgatttaagaggcattaggaaggcatctttgtcctaaacactatatgacagctgatgcctgaaaccctcctaattggagtctctaattaaactccgctaattacagtgggagtctcaaacaagtgtgtaaaggctggtgactccacccccagaatttctgattcagtagatgtggagtgagacttgagaattttcatctctaacagccgtccagttgatgttctgggaactacacattgagaaccactactatagtttaaggctttattaattaaaatggaaagaaatttccctggtagctggcaactccttgggacttacaggcaatcgtcaggtagaatactctctcctttcctgaaaagagcttttcataagggagtgagagatgaattcaaagtttttggaggcagaggcatcatcaagagaagaagtgattatagaaagcagatgttggacacattagagacaaacttggcttcttcacaattatgcatgagactaggctggacttggtgtaaaaataggtccagccacaggggtacgatacctagcctggcatttatctatgcatcttcaaactcagagtagaccctttaaaaataactctggggagatttctccaggacaacctaagaaaatgcattccaaaagtaatattcagtcaggatagtttgtaagagaataacaaagataatttgtcaaaaggttgtgctgcctgggtattactcactaaagctttttaagcaaataatcacataaacatatcatttataggaacagactatttttccactgggaactgctcagttatttaagaatttttgtttttttggtggggggagttaaataacagtgtacttgagtctacaatccaggaattaaatggcagcctgccatcatagcggttatgtttccatggtgatgaaatgtattgtttaatcctgtagtcaaaaacaaaagatgcaacagaaaaaaaatgttaagagatgaatctgtttagctgaatcaaatagaacaacaacaatattgacctaaatacataatttttcctgacgagtgttctgtgcttctacaggtatattacaggtacattccttaaaagccccacggacaattgatgtgggaagtaaacttcaagtgactccacatagagcccttgcttacaaattatgcatttcatcctgagcatttgtgaattagggtgtttaggagtgaggtagcagtatttaaaacacagttgagaagtataagactttagcttatggagtattatgtgtgtagtatagacccacattttagagttttatcaaagtgttttctcataggtttctaattttctatcgttctcaaatctgagtgtgcatcagaatcacctggagatcttataaacccaggttgctgtttcctacccccagaatttctgacttgctgggtcagaggttgggcctcacagtttactccccaggtattaatagtattgatgttgctggctcacgatttgagaactactatttaatccttgcgagaaacttgtgtgatattattaggaatttctgaaagagagaaactgaagatcagctaggggaggatatttgcccaaggacaaagggtaaatgcaatagccagaacctgagtctgaagtgtttttttcactcatacagtataataacaatactttccttcattgtcatgaatacaaatttttaaaaaattctatcagtagaaaagcaacaaagagaaatctagttatttactttttaatgtagatatcaaattttgtcatttcaatatttaagaaaataaatataagagtttccctggagagaatattgatataataatatcacactgtgtcaaaactgtttaagtacttgcttcttctagccacatcatctactctagttgtaacaaagtggtctctaagaaacatatctcctctatgaaaagacatcaaaatttatgagacagtgaacttgtcttaagcaatatgatggaaatatttatttttctgaaaactttcagggatttaagattaggtaaaaatgttatttactcaactacattactttctggtgttccctgagaaacactgtaatttatgaaaatgtaattaaatttagaatacttcttttttatattcatttattcagacatacattgattatgggacatgagcttgatgaggataaggggattgcacatcgaaagggacatattcttttgggcaagagacacattgtagaattagaaagaatcggccaggtctcagctctgccacttactttctgaaataagttgtgtgcatttccttatttctctgaaccagaattcccacaaaatgcccaggtatgtagaataataatattggctgataaagcctgtgagatgatcaggtgatacttggatgtatgtaaaaaaagagaacctgattttataacaactaaactgctattcaaatgagtcattatttttattaaattcagtttacaaaatggcataaattcaaagcaaagcaaccttgctggaaacataaaattattcactacaatatgaatctatataaaacaataggccacagaggaggggcattgcccaagttcagtgggtctaatcagggaagatctcttgtttggaatggttttgaaaaggaatttaaaggtaatatatggattcatggttgaaatcagctgttacagagttccctgaattttgctagtttaactggccttctctcctgtatgttcctaaatctcagcatagtcattggtgccaagggctttgatccaaggcaggtgcacaattactcccatcctaaccatatgaaaaggctgctgggatattttctggcttgagttctttgtcattcaattcttagcaaaattttagtttccaattaaataaatttgaagatgaagattcaagattgttttctgtattgcttatgtaaagttatgttaattgtacttttaaaatcatgttatgcacactattttgcatcttttaaggtaattttcaagcattttcttttatattagattgattttctacttacccatccaggatccatccatccatccatccatctactcttgtacttacccattctttcagtcccaaatctgaactgttgtctccacctctgatgccctaaatcctacctacagcaatctaaatgtgctttatcttacctgcaaatttagaaaacaagtgacgtcttatacacatttgtttctatcacagatcttaacagtatttccttactagtgctctatactaagtagcagaacatggactgagatgactgttatgtttgctgaacttttgtttgggggaaacagataggcacaatttctcactgacacaaatgttttgtataaccactattttcatatattaggccactaagccctccataggaccatggcattagttttttggtcttcccactgttagtttctcttgtgttccaattcattcatctattctctttgtcactgtaggtgtgaatgtctctgtaatatgtcccagcccatccatgctgcctgcagaacgagattccttcagttatggacctcatcttcgctacctccgtctggatggaaatgaaatcaaaccaccaattccaatggctttaatgacctgcttcagacttctgcaggctgtcattatttaaacacattctcaccaaatctaaaattagtttaatgagctgtttctgacatgaaatgtggttaccattaataggtttaggacacaagtcatattccccattgctctcggccaccattttcatttgtgcagtgtattttttctattcaaagatgcttttgccagttacatgcatcacagcctgcattaatttgcttttcttttaattaataaaacagacacagagttaagatagtttatcaactcaaagatagttttattttggtctcttccatagcttattaacactaaagaaaacaattacattcttatacaataaaaaggacacatttgtgtatgtttaaaattacttatgcagataccgtaatttacagtataaatgtaataatcaaacaggaggataacgacctgaagaaaatgagaaaataaaatatttcttaattgtaatcataataaaacaattgcagattgctaagtagctgttggtggtacaagtttgatatttagcttgagaatgggtatggaatgaatcaaatacttcatcactaaagaattcttgttatttaatatcaaataatgaaacagcagtcacttctagttcattaccatttcttgtagctgttgtttttagatatagtccactgcattcttataagttctaaattttatgtttattataatgcatttcttgtggaatcttagtgttttaacatttgaaatccacttaaactgcaaattgttctttatatttgattgtgttttttggattttctaaataaaaatattgaatgctttctaacaaaacagaatatttcaaagaaattagcaagcttcattaaagaacatgttttaataaaaatgtgttatagtaaaaattattttcatttttctggcataaatatattcaaatatgtttactcctaccttcattttccttttcttccagaaaacataaaaaagtttttattctaatcacttgacatatttctgatttttgtgaattaagaaaaacagaatttcattaagtaacaaagtaccgtgtactttacattagccttatgactttacaaacatatgttataagcaatctgtattccataaagatcaatggatgcctttatatacattttcccaacagtattctttaaaatcctacaaatctggcatatttccacagaaaaatgattatatatatttgtaaaacactaggttaaaaatgtccaattgtttacttcaaagcctctcagaaacgtaatatgctattttataatgtaaatttccaagaaaataatataatgtgcaactacgtttttacaccaaatttatttgagggtgaagaagaaccaatccttactataaccttatacaaaacttactacttatttttacaccaaaacttatttgagattgagaaaggagaaccgatcaacaaactttgaacatagtttttaaaatgctggctgaaagtaataaatcaaatcaattgacattaacaaaaagaaaagtgttttaaatgacctcaaagcacataaataaaattataaaaattatgtcataaaaatagaagtaatcagatatcattagactgagaaaaaatatgtgaaggggaacataactttaaatatttgaaaacatgccatttgaaaagggcacaaaacatatgccaggaagccccaaaatgaagagtagaacatatggttaaaattgataagaagtcatattttggctctagttaagaaagaattttctgatattgttccaagtcacccagcaatggaagtaacttttcttgaggtagagttacccacctctggacttcaaacagtgaataagtggtaattcaagaggcagagtataaaatggagtcctatgtggaaataacattgtcatggtatgtttctccaagaacttttcaactctaagaattttctaccttccctccttctttaaatatttcttgagtaccatatatatgactgtattacacacagatgaaataatattgtttatggtttattctacagtgagacacaaattaactgaaaatcacaaaaaatatgtacaatttcatatgtgataaatattaacagacagctgcatgctgcgaaggaattaataatagtgatttgagagaaggattccctaaagaaataatgattaaggaaacatataaaagactaaaagtacttagcagcacaaggtagaagggaagaatattccacgccgaatttaaagattctagtccttaggaataatttgaaagtcactgaagagttttaaatcataagggattattttcattgtagagtaacatcatgcagtggtaaagaacactaacattgaagctaaagttgctgagttcaaatcccagctttgccacttactggcttcatatcctgggcagaacctttaaattatgtatgcctcagtgttctcttatctgtaaaatggagacaggtaatggcatctaccataccgtgaggattaaatgagttgaaatatgtaaagtcccttgaagagcacctgacccatggtaaatactaagtaagtgttatttattattattactgtgtgcatgtgtatgtttctccttggcactgtgaataaaacagtttgcagggaaccaaaagtaaatgttcagagattggttagaacttcagtcttacagtactagctagaaaaaaaaaaaaaggaagtttggattataaggttgtggtggaattagaggtaagtggacaaatatgaaagtattagaaggtaaaattgtcaagacttggtggcagattgtataaaggggagtgagaggaacgagggtattaaagtttctggcttgcatgacagaatagacggcagtat

SEQ ID NO: 12653 - DNA, 11716 bp, Human
cataaactgcttagcatggcatctggcacacagtcagatctctgtaaaggttagatattattattaaccactattccagttaactactcctcagaaagtggtgttcagtaacaagggacattttctagggtcagcctaaattgcgacctaggccattggaactattggccatgaaagcacaattatgtattgtaataggcaatagaatatgtggctctgacattagactaacatccatcccttcaatatagggaccttaggcaaattaacctctttcttactcagtttcttcttttaaaaaataagcatgataatagcagccacttcataatattgtgatgaggtgcaaatgagttaatgcatgtaaagtgtttaagctattaactcaacaaatattacccattactgaaaacatcagagtgtgccacctgctaagtaagtgcttctggggagatagagtatttcaaattggattgtcatgaaaaatttggaaaatttgaaagctaaaactcttgctttcatttcctactgcctcaattctctgtattctgaatttactccctgtgtccccctaaaattgcatttgcaaaagccgatcttcaagttacatccaatgcccgctctgcctcatcttctatgggaaacaagaattttagaggtcaggtagcctaacaccatcaattctcaaaagaggaagctgaggccaagagaagtcctgtgaatttcttacagctcatttgtgacagaccaagaattacccactttactgggttgttatttactaagtgacagtgagtctatatctcttttgacaagtgaggtgggggcatggaattcggcatgtggttggtgtaagaactcccctctctcctctttaaccttacttaataagaccctggcacagttgatattttaagagggctactctgttttcccagagggacctaggcacggtaaccctcttagcatgcagaccttgtttcctgaggggtaatgtttcccttccctgtgacttgtttcttgggggctgtgttctgattttcctgctgagccacttgttgccttgggctggctgccgcgcttggcagtttttagtgagggctctgatagatgccaggaggtgaggggaagggctctgggtggactccgtcattggacaagcagacttagtgatggatgagccttcccctgaggaagttttggatcagaagtccaactgataagtttttccagaattgagtaacccagaagcagtgccgaaaggatcttacctctcttgtggctttttgtattgattttaaaagaaattctcagaggcagttccacattgtactggaagcacagctatatccacaataggcttagatatatgtaacatgaattgctttagaaataacatttgaggagaggggtgagaggaaggaagagagggtcttaaaaaatagccctatcaaaatattttctttcttctaagtattgaaaagacacaatataaccctttcttctttcaaatgatctcatagctatttgttgaggggaaataccaaatgtttattattttttttgaagaagcttcttcggtcctgatgattcatgttgatatcattttcctcctgactacagaggctctgagacaaagctacacctcaagtgatatgccagggtcagaacaattcccgtcctgaaggagggtgtgcaaccttctttatccctccttcacagacgtccttgagcccttgagacggatgtgagtgagtttttcagtcctcatgcaaaacaaccatctaaacataacagatgacatcagcttgggcttttcaattcctggatggcagcagcgtgttaatccagccttcatcctggatttcataaaccaaaacaagagagcctggcaggaggacagcgctgctgctgggttgaggaaattgatgacgggaaagcatgcgggcaacccagtgtataaaactcataaacgtgtaggcagaggctcagctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaaggtaaagagtgaccccttacctctcccctcccggggcatgctgagagcttttagccagcttgggaggtgaggtggctttgctcctcaagagtaagagggaaaaggcaggtggattcttgacaaggcaccacacaggtattgtcatgggtagagactgaaggatagctccaagtagcaactgaaaccagtgtgcaggaaggcacagaaagaagtgtggcattttactcgttgccttaggagatcgcaaaaagaaagctgcaatggaagattgtgttggctccttttctggaaaactttagaaacttgacaggtaatctgttaaggatggcttaggtgctctctcctctgcgaggcagcgattacaaaggtctgcactagataacctcttggaatggtttctagcccccagatttagtgattctttgatcttgaaagggtccacaggatggagggccactctcaagatcaaatatttctgataaacacaaatgcactttatggaatagagtgagcttaagtcatctaacaaaataactcactcttcaaagagggtcccctgaagcataaaacaaacctcatctgactttataaaggttttggtcatctggaaaaatagcagatggtgttaagacaaggaaaaataacaatagagaaaaataaaaactggaagtctgtaaagaatgaggttgaccacttgtacacttaaagaaaaacttcgtcggttgaaattttagctaaataatgtagttaagcatttgtagaatttattttaaacatagtaactagtttaaaatatttaacattttaaaaatgtttagaataaaaagaatgatgatttaaaaatactctacgtatagatatctcatgatcttattatgaagagctattattaagaagcaacacatgctataaccccatccatcagttgtgtaataccaggaagctttcaaaattataaaaaggactgagaaatttctaaataattattatgttttatgtatttaatacattttttatgaataatatttatccagtattgtgctaatctcattaattctcctacttcttagacatataatgtataaattaatcatcttttaatttgcaagacatacaaaattaaaaaaacaaattcttaaagtattaggagagttttattttttgcttagtttatttttgtttatatacaataagaaatagaatattgagaaaatattttgtttggtgaacacatatgcatgtttctttcaactgaataggatctgtatattttgtaaattatggggcttattgaccaagaaaacagtacttcacataaggaaattagggaggaagtggttaacacaatcatacttatgatatagcatgtatatgcagtggattgctttttctcttggcataatatgcctttgtacatgtgattgtaaatgtacattacatatgggcaaagaaacaagctgtgtggcatctggagtctttagcactgtagtattctactgaatgatcaagatactaaaaagatctttaagattgcttcttttggctttcttcaggttgctgatgaatctagttttaagcatttttctctctgctggaaataggagactttgtgagccttagcaactcgagatagagataatacatttggcaatcatctcccttcttcagctttttaaaagaacatccacgtgaaaactgtaaacttcagctgcgtatccaaatgtcttctaaatattcagatgtctgtgaacatcttgcccagattaacaatcagcagccaacacatatttaatgaacacttactatctgcccagcactgttcagtacatcaggggatacactagaagtatctctgggaatttggctaaagttttagttttcaatatcgctgcaggcacagtcaaatcctaatcctgtgtgcttttctggaacaggcctttgcaggatccctttttaagatctcttcttcccagcaaagagaacagtgttcaaaaccaggttcctctgtgatctgaaccatattgaaaagagcactcatagatctctttaaaaaaagatagctcattgatgatctacttggtcagttagtggagtattagactgctagagactcagatggctcacaatttgttctttacccacctgtgattgtacatttacaaggtattttcacaacaagagaatattctatatctattctgctggcttttaaaggttggttagtctactgagatgctgtttatcctaaaaacagcattttaaataattttatgcattttaaataaacgactttgtcctctttatttcaatgtaggatgttttggcataagtgtaagcactggaggtctaaaagcttctagttcttggtaggtgtacaaaccctcagggtgtataagccctgagctttcttgctcatttagcatcttgcatgttagccttgcagaggattttactagggagccctcttaactactgagggagtcaggcaagttgtatgacatgccgtttcgacaaataaggaacttgataagggttggagcagatggaagattgattgcttcatggtgagctaggatgatagctctctccctggttagtttgaagccctttcctatacacttaaaatagtaaattatctgtgaatacagtagattcaaagatagcatcacattttaaaaactctttgaggagctgatgcatatatgtctgttcaatttcccacctttgctgagctgttacagaggtcatctgtgagaatttattggtatctaagcagaacatcaccagaatgaagactggtccaaggagactggctgtgtgtagctgtcttcaacttaactttacatcacaacactaagcccgaggcatccattatctgttcttaatgtgtgatttcatatttatgactcaaagtttcaactttcaaatcctgggtttggagaattggattttactttacagtcaaggttcatgaggttggttcaaatcgcaaggctatgcacccagggctgttaggatggagacgtatttacaacaagcagcgtcctctccaacctttcctttgtccccagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacgggtaagcactgattctggtataagcattggaagaatagtctcatttcagtgtgaataacttagaaaatatctgtgagtagaataagatgtggattggaatgattttatttcctttgctttactcaggggaacggtgggtggtagctgagtttggttgctgttgctgttttctaaaaagagcccatcaataattttgaggtttacatataatttctcataaagtttacctggtttaaatatgatttataggaggataaatatgattgattaccaaaaatctgtaataaaaaataaccaactgagatacacaaagttctttaaattcttcagtgatctgttttatatatttactagacaaaactatttatctcccaacttcacatagaaaaagtactgtgaggaatttattggataagctttaagagtcaagatagaaaatatagaacgtttcttttttttaaccaaatgaaagcatttaagtgtaataattccaagtgtgtgtttttatggattttggagaggataagaaatagtatgtgattgaaattttggaaatgaatgaaactgtagtaatacgtgctgcttgttagtccgtgtgtatttcttatacaggtgttagaatgtgaggaatacacaacctatgagatggtgctatgtacatatttgtttattttgttgaatagctggccagtacaggagagttccattaaactgaaagtagctcatttaaagcaacatacatcactaaagcttaggcctccattgcacagaatggcgattgtagttaataattcttatatatttcaaaattggtaaaataataaattttaaatgttcccatcacaaaaaataagtatatgaggtgatggatatgctacctagtttgagttcatcattccacagtggagatatatatcaaagtatcatattgtaccctaaatgtatacaattattatttgtcaattaaaaactgtatttaaaattataaaaaataaataaataataagcccaacatatagtcacagagatggctagtatcaacaaatgatatactttttcccaccacaactataaataacaattcaagtccattttatttagtttttgcttttggtcttttgcatttcaagttaataaaatataaactatttggcaaaggtgcttgttttctaattttacctccttcttatgtatgggtcaactaaacacattaaaatgaagcggaaatatcgtgcttttaagtgaattattagttttaagtatggtgatgcccataacaatacttacattataggttacacaaaaatatttccacatcaaagttaggcattgagattcttatcagaaatatttgaaaaaagcagtcagtttctctcttttctgacctagggtatttcctttcattagctaaaggtgcaaccagcaaaagatgatttttagtgtgatcttggtaaaccttagtcaggttcaggatggagagcagaaaaccctaaggacctcttggggaggctgcctagggttctttgtagtctacatgtgtctttgagactacatgagacttccaggttcatgcactggagtttacaggagaaggcttgggcttcactcctgacacaggcttcacatcacctctgcacaaacctgtttgggcccagcctttgagagcaggctaaatggctgcaagcttcaccagcactaggacccccagagcacgagcttgtcttctccaactttccacctgctggctacagcactcttgtcaaatgtgcttcctgtccacagtgttccacttggtgttcttttttttggcagtgagcttcccaagttgggaattcacaagtaagtttttgtgtacgagggtcttgggggagtaagatctggaatgtttcatggacttacacacattcgtctgctgggccacgctaatcttcttaaagcattccacatcagaatgtgcactgccaaagcaagcacacctcactactccttgaagtagaaaatttcattttagcaaatttcaaatattacaaacttttctcatatgtagagtgagaagtgtctttatgaacgttctacccattggtctgccttttgccttctggatgcagcaaaagttaatctgtctttcataccagttagtgtaagaatctaacttgagacctgtttgtacaacatttgcctattccataagtatttattaagtgcctactatgtggcaagcactgtcctaagtgctggagatatagcagtgagcaaaataaagtccctacctttgtgaaactggaattctagtggtggagtgaaataatacacaggaaaaaaagacaaatacatgtagaagataatgtcaggtgacgataggtatacaaagataagtaattcaaggggtgctattgtatatagaggtgctcactgatatagagcagtgaatacagttagcatggaatcttaaattgattaaagatttcattgtaaattccatgtaaaacaaaaataaagcaaaactgtgttgtctttgagctatagatgtttggacatgatttgtattccgtctactttcagagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacgtggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgcttttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataagaaaaacagagtcactctggatttcaaaaatgtcaaaaaatgagcaacagagggtccttatttaaacataagtgctgtgacttaggtgaattttcaatttaaggtagaaaataagtttttaggaggtttgtaaaagaagaatcaattttcagcagaaaacatgtcaactttaaaatatagtttattttcatatttttttcttttaaacttggttgataagtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtgggaaggcctttgaatgtaaagctgcataagctgttaggttttgttttaaaaggacatgtttattattgttcaataaaaaagaacaagatacagcttctctgtgttgatttgtgattttgttaaattgctaaatgttattttaacaattcattcaataaataagaactctcattcatattaaaggacaagctcttcaacagaattttctgctctggataagcctcttctatcaaaacagggggtcaggatatttgcttctctgcctcacatttttggtctactcattttttagagtttcctaaaagtaggtcccaatatattaactcattctgcaaaacaacaacacaaggtaaacacttctgttgacatcattagttagatgcagagctcaggcttgaaataaccatttctattttgctacctgtatggctcttgaggtcctagacttagagcattttttcttctttgttttgtgttctcttcctggattttgtcattttcaatggtagaaactttgctattaaacagctactgagtactcctttgcactcttccatgttctatggggaaaccccttataattaactctcaatcagttgttagctgttttactgaagattacagctctaaaaatgtcgaacaatttttacttttatcagtttaagtttctcattcataattaatactagcattttattttcatttattttctaatatttttgaagggggttgcttttagaaaacatagccaaagacaaacctttcagtacctatgaaagaagagagtattttacagctttgaagcttgagtatcatattcaagaacagtctatgttcattctgccttgtgggcaaattatggaaacattttaggtgaatcgataaaaatgctaaaaaaagtctatataagaaaaaatcctgtttgctcgaattgatatattttgtaagatgatagaaattgggtgtgaatgagatacaaagttacatgaatgtcagatatttacattttcattaactgaaaatctctattttcacctatgggcaagaaagtttgaggctactctggtagggagtgaggttatttaaagatctgccctcttggtttgaagcccgggccacagtccaaatgcttctttgaggaagtgtggaaaaagagctagactggagcaggactggcctctgtttctggtgctgcagtaaccacctgtgcaatcatgggcaataaaatcagatgaaagtgggcccatttgctctgagtggcaggcatgttttctagctgcccagctttatggtgctgggggctcttcatggttttcaccccaaaagctagtacctgtctatcccaaattgctctgtagtcttaccactaatcttcatagccgtggtctccaaaatctttggatctgtacacccctgactgcacactttgctagtgcaaaatttttttgagcatgtaatttcaaactatatacacactatcgtattaatatattgcgttcattataaaacatacactccaactagacattattaaaatgaagagataagagatataaatagaagttttgaaattttcttcccacacttcaatgtaccattccagaaaacacttgggaaacaagaaaattccatagatcaatgggcctaatctcatttgatattggagagaaactaagctgaggcataataaatatttctggaatgaatggatgattggatgaatgaatgggtggataggtagatagatgaaggtaggaaagatggatgggaagagggatggatggctattggatgaatggatgactgaagggatggttggtggaaggatggatgaatgaatgaagggatggatggatgagtgaatgaataaaaggatggatgggtgaaggaattaataaataaagcttgtaacaggccctgtgtcttcaccagagcagcagctgctcaagaagaagacaggctttccttccctttcacctgtcagatccccatctgcccagctacttatccatcctgttgggttgtgaggtgattgaaaatgttgggggcctacacagttagtgaatctgacaaatagggctgttcaagaca

SEQ ID NO: 12654 - DNA, 18836 bp, Human
ctttcactcacaaacagtgttaggccatggagtggagagggtgctccggggaatgaggatctgcattccggccctcaggagcccgagcccacaacggccccaggccacaactgccaggtgggggtcacttcagcagctcattcctgggaatgcctgtgcccagatggcttcaggcctggagcaatttccacctgcctctgtgcatcggtgtcaggcagatgggggcagccacctgcttctcaggaaggaccacccttaccctgggagggcatctcttctactttgacagaggatagaaaacattctgtcttcatgaaatcacggggatattcagtggtagttttctttttcaggttcttattgaaaaaataaaatcttggcagtgtaaattcagcccttgaaaattgttctggaaatttccctggcccatgaatcacctgggtctggcacctgttggctgtgttctccctcagttttcccatctccacgatgggtagcagttgttgctgtctcatttgagatgacacgtgtgaagcctttagcacgctgcctgactcccaggaggccctcagaggtgactggggcactgccttcctcctggtcagtggtgatgttggctcttatagtttgggttgggatgctgttgctcatgtcctctttcacagggctgcacgcagagctcggtggaggagcctcctcccccaacgcctccgcttcttcctccctggacttctgccccgtcagagggcagcctgcaggcacctctctctgtcctggaagcctggccagcaagtcggggccaagggctggtgggggcctgcagagagggccagcctgagccagaggaagagtcttggggttggctcaggtatgtccaggccatgagggcagaggaacaagtctaccacagtccccactggagcggtggcggggaggctggggagggcagtgaacctggaggcagcccctcactcctgaatgtagagtcaactgtgactttgatttgcaccacagttttcttcagagtgcactaaacatagagtcatactcattttacgagaccagcattaccctgataccaaagccagataacattacaagaaagaaaattatagaccgatatccttgatgaacatagatgcaacaatcctctcaaaatattagcaaaccagctgggcgcggtggctcacacctgtaatcctaacgctttgggaggacgaggtggggggatcacttaaggtcaggagttcgaaaccagcttggccattcatggtcaaaccccgtctctactaaaaatacaaaaaattagctgggcacggtggtgcgtgcctgtaatcccagctacttgggaggctgagggaggagaatcgcttgaaccgggaaggcggaggttgcagtgagccgagatcgtgccaccgcactccagcatgggcgacagagcaagactccgtctaaaaaaaaaaaaaattagcaaaccaaattcaacagcacattaaaaagatcatgcaccgtgatcaagtagattttatccctggtggggtgacttctttgaggtggcagcccctctgttggtgtgatctagagcaggactgaaggaaatttactcagggaaatttacaaggcttctgtgaaactgacatggcagggcttccagcctcctgttccaagatgggaaaactaagtctcagcaaagggagaggtgataagaccagcccgagatcgtacaggaccctgtcttggcctccttgtccggagcctggcctctccagagctgtgactactagtccctggggggagacagcctttccacctctcccagaccggagctgggtgctaacaggccctgccggatgaaaatcctacgatactaacagacagctaacaggccgggaccggcccccagccaccaccccttgtccaaagtgcaggttcattgtgctgccctcttggcttgtaacagttttgcaacagttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccaggtaagcctcaaactggcggggccagctttccactgggcagccaggggcctaagccagtgggccctttgcctttgaggcagggactgagaatggtgtcagcacgtggtcaggcccagagcccaggccccctcctctaagaggtcctcctggattccctgctggaaggaagccagccttgtggtgtcgtgtctctccctggatctgtctgcttcgtggaccctgagcccctcgagggcaggggctgggtcttagatgtcactataggtttcccagcagtgctttgtacacattgggcattcagtaaatgtagaggatagacaagctggcaacaagacagtcggacatcctcggtgtgaataagaacacaatgatttgattggtattaattacagcagtttactatacgatcgcttccggtattggcagctggcatcattacaatattaacagactgccattgaaatgccccgtctttgatccagcgcgaggaggagatgtgactttccatcagcacctgttctgattctttgggcatccagaggtgtattctttctgggtttcctccacacccctcctctgggtgtctacttctgtctgggaaggggtaacttgccccagcccagagtcaggctgcagcatccggtctgcctcctccaccagcttgctgtgtggccccctccctgggcactgctgtccccaacagtcaatggaggctggaatccctgccctgggggctacgtgctgtgcagtagccagtggcttgggggcatctccccaaacaccagaggggtctgggagctcgggaaagcaggacgcagacagaccaggagaccctgtccctgggaagctgacccaggccttctcactcgcctctgaaggcagtgagcatcctgtccctgggggtgagcaaactggggcatgtgctgagatgacctcaccaaaggagcctccctgcagtggacgggcccctggcccaagctgctgctgaccccacctttcctgcccaccctgcctgtgcatagctccttctgggcgcggggagctcgggcggctccagcaggcaggtggtgcctgggtctactgcagcaaccctgaggcgcctgtttcagagacgaggaaatgagggttggagcggaagggtgactgccaggtcgcctacgggtaatggggcatggggttcacaaccctgctctgccgccctcagagggagctgcccacagggctggcctagaagccccaactaagctggcctagaagccgcagtggtgggcggtacgctccgcccagatcctgggcggagacatggggctggcagcgagggtggggggcgggggaggcctggagttccggccaggccactgcttgggaagcaagaaggtgaaggcacctctgctgggccaagcactcttagggccgaggggcactgcagctgacaagaggtacttggaggtacacccccagggagggacgaggctggggcctcccctatgtgggcggggctgggcctggtcagatctggctgggatctccctctgcctctggctgcagggaccatccagctgcatgagcaggaccagggttcaccatatgggcagctgcctccccgccccctgccgctcctccccacaagtctgcctaccctcaccaggcgaaggtgccaggcgctctcctcgcttgacccccaccaccccctgagcctgggaggaggagggcgttcctgggtcctctgctttgcagtgaggttaagttgttgctcgaggccccagtcctgtgacaaaacccccacccatctgtctgatcccaagcccagggctgtcctcagccctcactcctgggaagctgactcaggtacgagacagagttggagggggcaagagagtgggttaatgtggaggcagctgtttccagggaggtggcaggcaggaggggctctgggctgtccccgctggggccgctgccagcccccagtctgacagtcagaagagccctgactgaccaggcaggtggtgaaggggcacgtggcagcctccggcgccagcagctgtcgctttttgggcacagtcggaaggaggagggaggcttttgcccacagctgaccaggtgtgctgtgccatgcggcaccgtggtgggtggtgggtggtggggtgggggtgttcagccttggagggccttcctcggtgccactcaagctggctttcccctggtggggcaccacttttgggggctcctggaagactgtggaccttcaaggactgaaggtatgtacagacacatgcaggaggcatgcctccttgtccggggccacctctgcaggcaggagccaggcgggctgacacactgagggctgagaggctgaggacaagctccaacacctcctcactcccctacgccgctgcaatcagactccctgctccctcccttgggatggggcactggggcaggagatggggggcagccctgaccagcctgagagctgggatccccctcacatcccccactgtgcctaggacagggttctgggcttcgtcagggcttgggcagtgcccacagttcaggtgggacagagtgtggcagtgggtcctgagtccccctgggatggtcagaagagggggcaggagagagtccctggcactgccacatggaggccctatgaccctggtcacctcagggagcctctccgtgtgtcagactcccccgctgtgaagtagagacattatcatgtgtctataggtgttcaatgagagtgaacgaacgtgcatagctatggtccactcttgaaaaaggatgctgactttcttagataattatatcagtcattcatactgacgtaggtggcacagcacttcacatcttggatcacagccacatccctttcacttttcctgcagatcccagaaaagggcagtggaggtccacactgggcaggacaccaccccacccttccattgagggctgttgtgagacctccgttcttaacttcttagtttaaagaatttaggctgggcacagtggctcatgcctgtaatcccagcactttgggaggccgaggcaggcggatcacctgaggtcaggagttcgagaccagcctggccaacatggtgaaaccctgtctctactaaagatacaaaaattagccaggcatggtggcatgcacctataatcccagctactcgagaggctgaggtgggagaatcgcttgaacccaggaggcagaggttgcagtgagccaagatcatgccactgcactccagcctggaagacagagtgggactctttctcaaaacaaacaaacaaacaaacaacaacaacaacaacaaaacagaatttaaacatgagacacacagcaaaagagctgcaacatagagcaatttattgcaaaagaaaaagaacattttgaaagttaggtgcggatgcaccctgggagagagaggattccaggcggggggctgctcctgagtgtgaggcagcattgatgattgttggagaaaccccctttcagggagtcttccacaattattcataagtgggtggaaagagaggaagaggttactaggcagcatgtgatggctggtcctctgggtgcacatgcggtagctgtacatgtttgttcatacgtcacatgtctcattcgcatctttttttttttttttttgagacggagtttcactcttgttgcccaggctggagtgcaatggcacaatctcggcttactgcagcctccacctcccgggtttaagcaagtctcctgtctcagcctccagagtagctgggattacaggcatgcaccaccacccccggctaatgttgtatttttagtagagatggggtttctccatgttggtcaggctggtctcaaactcctgacctcaggtgatccgcctgcctcggcctccccaagtgctgggattacaggcatgagccacagagcccggcctcattagcatcttaaaatctccaccgaggggtgtgtttttttactattagaatgagcaaagggtcagtttgaggacaggtaaaatcaatgtgcacatgccctctccaggggaaaggccctactgcagacagctttgcttgaacgagctcagttaacacgagctcagttacagtgcaaacgtggaggctgattgtgtggattgcagtcaccacggttgctgcgtccccaggacatggtgactcctttgactgcctgtcctgcctcgcctgcacccaaggagacatccgtcttcatcagcgccttctctcctgagaaggagggctccctcttgcattctcattgttattggatttttctggctgggcagatctgggagggtttcctgaaggaggagggagtcggggtgggtcagctgggaaggagcagaggggaggaaggcctgttaacccggcttctgagcccctactctgcaatcccaggtggccccaagggagcagagccgggacaccacatccttcatcagcttccgccttagtcccaccgagctttggggctgatgagggggcaacccctcttgtctgggtttgggaggggcctgcccaggaggaggtgctggctccaggcttgggggttgggtgccccgtctcgaggctgcctgccgataccctgcggccactgctgtagcatccacgatgcctctccctcctcctggctctctgtctgggagcgcaagtgtctccatccctcaacacaaccccctccctgccctgctgtgccactaccaccgccttctctgggcactcctgcctcccaggtcccatccccaccccgcaggacctggggtctgccccagcacagacctgtggggcagcagggctgcttggcccctcaggagcatcttgagctccgaaagggctctcaaggctggcgggacggcccccgcccagccccagcctctcgctgtctgtgatctgggggtgagtgtccctgagaccggagcccctcctttccagctgttggtcctctgtcctcagtcccctccccatcctccctgcccggcctcacggggcagcccactttcctcaggtctcactttggatctctgccagccacgtcaccccctcttctctacctccccttgtggccccgacccccacttctacccagagcttggcgctccctgtcttttctgtgggctggcagagacctatcctcaccaaggttgcccccgggcactgacagagcctgctgcataccaggcccttaatacatacacacagaatgaatgaatgaatgaatgagtgaatgaatgaatgaatgagtgaatgaatgaatgagtgaatgaatgagtgaatgaatgaatgagtgaatgaatgaatgagtgaatgaatgaatgagtgaatgaatgaatgaatgagtgaatgaatgaatgccatggggaagtggcaagaggaaggccctgggaggtaacaccatagggcccttatttccctgggtactcagcacagcccccagcgtgtcccctctgcaccccacccagctctgattctctccccagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggtagggaccgggggccaggtaggggcagggaaggataggacatagcgaggggccacagcccattgctagctgggacagttcttggttcacaacaaccagcctggggaagagaccctggggaagggtgcatggccagtttgcaggtgggcggagctgggggcactgcttgccctcccagtcgctgaagagctgtggtgggaggagggagcagatgctgcttgtgtggcctggagagtgaagctggggccagagctggaaactccaggcagctgtccagagggcagaagcccctttcctggacagagccaccaggactgagggcattccagggagtggagaaggacggacggggaccattgagggtgaagcagacctgtgtcctccatgagcaccagaggcttctacagttctcattctcctaactaaccagggggcatatattaagcacctatggtgtgcatgtcccaggacagccaaccttctgccttcaccatttcagccatggatgtcctggcaaactggatctcctgacctgcagtgttggccagttcctgtggtgtgaacactcccaccctggccaatagcaaaagccaccagtgtgaggtcactgactgtggagttgggaagaggtttatccctgggctcctgagagctgatgcgagccggctcccacaagccactgctccaactcttgctcttgccttctcactggccccctagctgggctgtcatagcctcttccctgacgtttcgccagccacacccctggcctgccacctctcacattcagctgctggagggcatcctttgttggggagagtgcagatttaagcttcattcagtagtgggttggtgtctcggcgccccctccactcacctgctctgtgatcttggccacagaactgttggtgccacttgaacttgatctataagagaatcacgccctcctcatagggcatgacaggcttagcacggggcttggcacacagtaggtgctccaaaaatgggggcctttgctatgtcactctctgagctgcccaagggcgggacctccctcacattcatcttggtccagttatttcctgctcaacaacctctccaggccccccaggtcctgcagagaaagaccttgcagagaaagacacccatggttgaatatcagggtatcccctgatattcgtctgggggaaggaggtgcagtccactccctggggagtgatggcacccaccctcccgggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcggtgtgtgctcccctgcggggggcaaggaggggggcttgggtgggtgggtgcactccctggggggtcatattggtgggtgcaccccctgtgggggggtagggtgggctccctgtgagggtggaggtacgctgggggttcatgtccgtgtgcgcatcccctgcggggggctggggtggggggctcgtgtggatgagtctgcttcctgtggggtcgggagtggggctcatgtcggtgggcacccttctgccgcgagagaaggggacacgccacagggaaggagccccggcaggtgacagatctgggttccagcccttgcgctgccccttgctggctgtgccacctggagaaagcgactttgccaggcttcattcagaattcccagacagagaatctgattggcccagcttctccctgtcccagtggtccacgcctgaggacactgattggctgttcttgggccaatcaaatgtgggggcgtggtctatctgacagtctgaaacaggatcttggcctctcttgacagctggtctgactgggaaacctctcaggcccaaagtattagacctgtggggttatttatcttatataatagacactttgtgccaggcactggtctaagttctttgtcaatgacatacactattctcacccccacttcacctgagtgagcctgaagcgactttgccccaggttggtcacacagctggcgagggtcggattggcacaggcggcctggccccggagcctgcctcagtgccctgctccttaactcttatgctgaagcggattcaaggaacaggctccgggggcgtggggaccggctaaggcttctgggagaaagtgaggctggggtttgcggtggatgcccagttggggaggggagtggcccaggggtctgctccccacggactcagttaacctcccctgggtccccctagctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtactgatggccgcctggctctgggtcccttgttcccagcccactcctcctgccttagaaccctgagagcagaagggaagagaacaagagccattctctgactgctgtgtgactttgggccagtgaggacctctctgagccttctggtccactcctgccaaggggaggctatgccttcgttctgttcacagacatcaggtcgtgccgtgggtgcacccattcctctgctgcacaagcaaatcgtatcaaaagcccttcttataatttgtatctgtgtttgtctcaactccgcacatcattgtagaacaatttttttgtttgtttgtttgagacagtatctcgctctgtcgcccaggctgtagtgcagtggcatgatctctgctcactgcaagctctgcctcccgggttcatgccattctcctgcctcagcctcctgagtagctgggactacaggcacccgccaccactcccgtctaattttttgtatttttagtagagacagggtttcactgtgttagccaggatggtcttgatctcctgacctcgtgatccaccggcctcggcctcccaaagtcctgggattacaggcgtaaaccaccacccccggcctgtagaacaattttaagaagacaaataagcaaaaaagaagtcaagatcacccagcagtaatagtattgacattttagtatgttttactccaaatatttttctatgaaaatatatatgtatgcaaaatagaaccaagctgttgttattttgtgattttttttttttaccaagcagtagactgcaaacatctttctgttaatcaaatatcttgcttttttttaaaaaaaaaaaagtcagctactttttcacgttatgaaaagagggttccccccacaagtcaagtgaaagaacttgcccaactttcaagttctccaagtcaaggcatgggtgggtctagttttctggcgctgtggtcatccggtttccctgacagtgtcgcaggggacctgctgctggcagaaatagtgtccccagctcccctctgggaggaggggttggttggagtggggtgggaagcacccccggggagtcccgtgggattttagaagcagttcctctcaattccaggtcattgagaactgcccagtgaccggcattcgtgtgtggacggatgattttggggtgcggcgggtcgcgggtgtggagactcagcatggttccatccagacaccctgcgtggtcaactgtgcaggtgcgagtggcatttctcctgactcctgtgtggccatgctggctgctccctaaacctgctcccacctctgcagggcttctttctggggtggggagcccctgctagggcagacaggtctgcagaggcagcctgtgcacacctgagaggcagctcccaccaggtgtcagcagagctgagctgtctgtgctctgcccgcaggagtgtgggcaagtgctgtgggccggatggctggagtcaaggtcccgctggtggccatgcaccatgcctatgtcgtcaccgagcgcatcgaggggattcaggtaggtggacagccccgggttccgtgtcagtctgtggggggcacagagacctggctctgaatcccagcttgaacccaggtggtgtgacccttgtgggtcccctcactgccccaagcctcagtcacctcatctgtgaaatggggattgtaacatggggtatttccgggtggtatgaggattaaactaggtagcacaggcgtatccctgttggggctgacccccttgttcctcaggacctggcctctctttgatgcccagaacacagtccagcctgtcctgcgtggtgcaggcagcctagctttttgccatgttctgtgcccaggagtttcggggaagacccgaatgtttgcatgctctcagtgtgcctggggtgcctgtctcagagggtgctggttcctggcatgaataacctccctgagagccttctgccaagggaggttgggggcctgggttcacctcctggcacctggggctgggtgcctcctgccctctcttctctcctgtcctcaactcctccctccagggatggtggctgggagcttcctgccactttgttactgacccccctctttccatccattcatcatgcaaccctcccttactcattcctctctctgtccagccctccatctctccatccgtctctccatccatctactcccgtatctatccatgccttctcccatttattccttcatccctccacccatcccccttcccttcatccattcctccctccactctttccctccctctattcatcttgccatctcgccatccattcttccgtcctccatctctccatctatctattcatctatttatccacatgttcatctgtccatcccttctttcatatatccttccatccacccacccacctaaacttctacccatcaatccctccctccctccctctagccactcatctctccctctgcccttccttcagcatccacccacatattaatccaaccattcacattccattgaaccctctctgcatcagacattgatgggtgagcttggtgtttcaggccctattctagaagctgtggccataacacagacagacacctagttcttgctgggtagagctggggggaggtacagacaagtacatgtgcaattccagaacatgctgataagggctctgatggggtctcaggggctataggaattcccagccctagtggaccaggggaggctccctggaggaggcagctgcatctaggtgaggctcttgagggtggcatggtggacaaggagcgtgcacagagcatggccgttcagagagccagggccagaggctgtggggcagggtcagtgtgagaacagactgcccttgtttagggtcagggccagtgagagggaagcctgggcccctgagctgggagcctcgtccctgggggctgcccattgccaccctgtgccagcctggcttccctatggtcaccggggaggtaccaggcttggctgcttcgtagaccagggtagtgaagcgggtggcgaaatggggccggaacctgggtcccagtgcgctgctgcctctgactcctgtgcgctgggcaagccacgccccactggacacaagacctcttgttcatagaatgagcctctcactgcaggtggctggtgccatgtgccgggttagggactaagagtagtcacacggtgggtgtcggagctgagtgctgaggcctcctccctggctccgggtccctggggagagcctcctcccctaggtggccgccaggggtcacgctcaggtctcagtgggttctgggagggcgggcagagctgtgtcctggggcgtcagggagggtggccacagaatgtccaccgagcccaggactgtggctccatcctccatccctaattcctcccaaggcctgcctttgaggtgcctttccagggaagaagcaaggcagagttggcctaggtccctgcagctgccccctcctgtgtatgtcaagattcaagcgaagctagggggtgttacttacaaagccagtccagatcccagcgtgcctctggtaccggaggcacaggaaaagggccatcagccccagcagctctgagacctggtaggagaaaagtggagatctggggcttcgcacaaagcccctcatgttcctctgacacctggccatgtgcaggtgtctggaagttgtcccttccagaggctgcagctaggcagttggtgtgaatctgaggaaggagccaggccgctggccctgacctgcccacctgctgtggtctgacccttggatgggccacagaacaagccagggggccctctcctgggcgcatggcacctgtgcagcccatttctgtctgctcaggaagctccctgggcgtggcagcctcgtgcagcaggacgctgtccaccctgatcagacacagccacacacattggggcctgggggctccagctggcaggtgagggctcaggtctcacgtgtggttcatctttcttcttgggtggctggagggctgtgtggccccaaggacctcccttttctgaggatctgtcccaggcctgggtcctagagagctctgcccacagcttcctttgtggctagggctcatctcttccctctctgagctatcattaaagcaggtggctcgggcgctgttagggggtttcacagtcgtgctctggcgtacttttgcagtggcaaggagcggctgctccatccgtgggcagagctgtgggtaagagcctgggtgctgggtttaaacactgactcctccattacccaggctggccaagtctgtcaccgctctggttccctttcctgcaaaatgggtcataaccatccctactgcctcaggctgtgctgcaggaaggacagagtgatgcagctgggcgtggtgcccggcatacagcaggtgctcatgaggtggtagctgtgtgatgacaaggacaaggacagagggttgtgaagtcgtcaccagctggcgcttcggaggaagagaacacggagggcaggagcaatcaggcagggatcagatggaagaaagaggcagatggaaggcatgggctgaggtcaggaggcagggagtcagtggcaccagggccagactggggacagccagagcaggaggctgctgcctggagagaaaggccagggctccactggacgctgatgctgaactgggcactccgctgggtgctcagaggcagcaggatctgtgcaaggggcaggtaagtccagacatggatcctgctgggacaaacatcaggggcttccctggccaccaggtgtccccactgtcctgctctatggaactctggggctggctttgtttttagagtagtagtgctagcagaggtaaggatataactactactactactactactactattattattattattattattattattattattattattattattattatttgagacagggtctcactctgtttcccaggctggagtgcagtggcatgatcatagctcactgcagccttgacctcctgggctcaagcgatcctcccacctccacctcccgagtagctgggactacaggcatgtgccaccactcctggctaatttttgtatttttatagagatggggttttgctatgctgcccaggctggtctcaaactgctcaagcgatcctcctgcctcagactcctaaagtcctgggattacaggtgtgagccaccttgcccggctgtgattatttttaaacagtgctcagttactaggaacttctatgtgccacctgacaacgatcccctggtgcagatattctcattccaatgaacaggactcctgggatcctggcggagagggagggagcatctgccagaatgtcccttctggtctctgcacatcccctttcctgctcccagagacaggacaggggtcgtatctccctgtgctcatctccagttctggggcaggtgacagagggattgagagaaggctgttcctcgggtacagaggagtccacacgccatgcctgcttgctttctaaacggtcttgtttggtttggcttgtttattggttaaatcagtggttcctctctgcaatattatgatgatgtaaacactgcttttttgtttgtttgtttgtttgttttgttttttttgagacagagtttcactttgttgcccacactggagtacagtggcacagtgtcagctcactgcaacctccgcctcccgggttcaagcaattctcgtgcctcagcctcccatgtagctgggattaaatgtgcccgtcaccacacccggctgatttttttttgtattttagtagagacggagtttcaccatgttgccaaggctggtctcgaactcctgagctcaggcaatccacccatctcggacttccaaagtgctaggattacaggcgtgagccaccatgcttagctgattatgtaaacattgttaatacctgagcaagtagtgtccaactttttgtgtttcttggagttattaacagtttttgtcccagctgctcagtttcttttgtaactgttatgtgtgtgtgtgtaacattatcttcgtgccccaagacccatacccgttatcaatcactccccatttcccaccctgtccccagacttaggcaatcccaaatctgatttctgcctcgatggagtttcctattctggacgtttagtataaatggaatcacatgatgtctggcttctttttacggttttgtccgtgtagtacatgtatcagtatttcattcttttttgcagctgaataatactccattgtatggatacaatgcactttatccgttcacccactggtggacatttggtgtttctcatttctggttattttgaatagtgctgctgtgaacatccatatgcatgtttttgtggggacctatgttgttatttctcttgagtttaaacaagttgagcaccccaaatccgaaaatccaaaatgctccaaaatccaacactttttgagcactaacatgatgctcaaatgaaatgctcactggagtattctggattttgatttttggtttggggatgctcaacaggtaagtataatgcaaacatccaaaatcaaaaaaaaaattaaaaatgtgaaacactgctggtcccaagcatttcagataaggaatactcagtctatacactggagtggaattactgagtcatatggtaactctatttaacatttcaacgaactgtcggactattttccaaagaagctgcaccattttacattcccaccagtgaggtatacggaggggttccagctcccctccatcctcaccaagtcttgttattttttgtctttttttatgccggtcatcctagaaggtgtgaggtggtgtctcaccgtgggtttgatttgcatctccctgatgacatgatgtggggcatctcttcatgtgcttactgactatttgtgtatcttctttggagaaatggttactcagacactttgcccatttaaaaatagggttgcttatctttttattgagttgtaggagttccttaaatattctggatacaggtcctttgttacatatatgatttatgaacattttcttccattcagtgattgaaacttctattcagtggttgtcttttccctttctttttttcccccagaatccagaagtctttacatagccttttcgcttttttatggtatggtttgtagcacaagttttaaattttaataacgtccaattcatctctttttttcctcttttgtcatttgtgctcttggtgtcatatttaagaagacatttcccaacccaagactataaagatttacttctaatattttcttctgaggcttttatagttttagctcttatacttatgcctgtaatccatctcaagttaaattttgtgcatggtgtgaggtaggggtccaactgcattcttttgcatgtggctatccagttggcccagcaacattttttacaaagtctgcttcccccaaggaattgtcttagcacccttgctgaaaatcaattgactctgaagaagaaggtttatttattttattttatttttttgagacagcgtctcgctcttttgcccaggctggagtgcagtggtgtgatctctgctcactgcaagctctgcctcctgggttcatgccattctcctgcctcagcctcccgagtagctgggactacaggttcctgctaccacgcctggctaattttttgtattttttagtagagacagggtttcaccacgttagcaaggatggtctcgatctcctgaccttgtgatccacccgccttggcctcccaaagtgctgggattacaggcgtgagccaccatgcctggcagaagaaggtttatttctcgactctcaattctaatccattgatctgtaggtctatccttacttagtacctcactgtcttgattatgtagctttgcagtaagtttggaatcaagaagtgtgaatcctccaactttgtttttccttttcaaaattgttttgggtattcttggtcccttgcatctctgtatgaactttagggtcagctatttaatttcttcaaagaaactagctgagattctgacaggcattgtgttgaagctatggatcaatttggggtgtgttgtcagcttaacaaaaataagtctttcatttcatgaacgtgagatgtccttctatttatttaggtcttctttaatttct

SEQ ID NO: 12655 - DNA, 89220 bp, Human
gaccattttacagatgaggtcacacagctgtaggttggagaggtggctttcagactctaaattcattggcatttatatataggcatcatattgagactgccctttctaaagtactctgtcaaaggactaagagatatgaatagggattcagatgttgacctcagatttaggaacaaaatgcagaaatcacaaatgtccatctgaatggtgtctcaacaatggcattattttctcctatttgctaatcactgcaaggcatataggttttcaattacattatgagttacatagaatagaatttagggtccagatgggtaaactggtgaatccccatgaagtttgtagtagctatttcctgatacagatttgatataataacactgttgtatgtaatacagttttggtaatttcagttaagtagattgtagctttattgccctgggtcttcaaggaaacacatgttcaaatattctcactgcttaatgagatccttgttcctgttgaacttatgtgaccttattggaaatcaatgattgcttttgttcttcaaaatgtaatgttgaggagacctagatgaaatcactctacaaaatgcattgagattgcaggatgtggagaatgtgctgtaattaaaatgaatgattctgcttggaggtacagcatattttagctctgtgtgcatatcgtgcataagggaatttctctatgcagaattattttctcccaacaattctcatgatcacagcactcctggtagcaggtatcacttaactcctgggcagcagcttgtccaaagcaagggaaagggagctttcctttcctcgcaactgttgctatggggggcgtggcttcggagctgggtgaggaggcgttcggcggctccctcccccccccaccctcgtagactacacttcccgtgatgctcgagggaatggtctccgtggtgacgcacttggtgtccgcggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaggaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatggtaagtgacggataagttatgacactgatttaattgtggtttccaatcttatttaatcggaaagacggcaggcgtggggcgaagatttgctggggactgtcgaaaagccactgtgctgagcgatttggagaagttggagcttctggtttcccccttttaggaagtactgcttttaatatgggttctctcatttggtcgtgttttctaaagcattgaagatagtggagaagtagggaaatgtatcatggtagcttgaggggacaaaacatctccctcttcgctagaagcctccgaacactagtattttaacgtttctgaaaacgtcagggacagtgggcagagctgaggacgggtgtccctacgagagaataggtagggaaacgggaatcttgctttatgacacagacgagatcgtcattgcagtagggacgaacttgatatttttcaagaacagggatgcacatctcttcaagaaaaagtatgttagaatttgctgtgaggtttttgaaatgtctgaatacggatggcaacagaaatataaagatattttgggattttcagaaacgtaggctgaccctgtattggtacttacaatgaatattccagggctttttaatgccagatatttattaatagtagattccatattagacataaagctaaggaaacatagtattgagcctcgatcactgagtgttgagaacttgaaacaaaaagtactgttgtttattgacgcctttctttgttttgtttataaagggtaaggttgtgagtcggttgactaacagtaaccgtgtaaccttacagtgctggggctgggcttgtgtgagtgtgaagttacattttgcagtcctaaggacaaacataatgcatttaattaccaggaagaggaataatcctgtttatgaaagaattgaagttaacgtagttgtgctcacatatgttaacatttgagtgtttgtgtattcagtggaaacaaattgaactttgctgatgattaaattttattttattttttaattttaatttaattttaatttaatttttattttttgagacggagttttgctcttgttgcccaggctggagtgcaatggcgcgatctcggctcactgcaacctctgcctcctgggttcaagcgattctcctgcctcagcctcccaagtaactgggattacaggtgcccaccaccacacccggctaatttttttttttttttttttttttttggggagacagggtttcaccatgttggccaggctggtctcaaactcctgacctcagatgatccacccatcttggcctcccaaagtgctgggattacaggcgtgagccactgcgcccagcctgctgatgattaaattttaaaacgccagatgtttctagaggagcaaacctcatatacagattttataacaaaaattaaatgattctaaatggcttattttgaccttggtttaaaggaattttgctcttgtttaatttcccattgaatgcaaaggaaacacagtgttctgtctctgggggtggccacataacagctttacagtctccttcctgagtcctaaaactcgtgcgttgtccttttagttttcgcttctcttctggtgtgcacacatgaaatagcctcctgcctggttaagtacggctggacaagctttcctccatactgctcttgaagttgccgggagcggtctctagacagagctgggaaatgctatttcccttgtttgatgagtgatctgtgggttcatcgcctcgagcaaagatttgctctctcgaaagcctccattttatatcatcaagcacagtgcaaaataggttaaccttaagtaccgtctattctctcacagacgttggaatgaaatagatgtgttattaaaacagtgccgctacttcctttaggtccagtgaagaaaagctggaatgtgcgtggcatcagtcacagattgagatgatttgggaaatactgtttccaagtcagagagagggtttggaggctgatgttaggatcagaggactgggaagtaggagcagggttttattaatatctgcaattataaaatataacagtttatctgtttgagactggatgttaaggccttgattctgtggtgctttgagatcctttgattaaaggtgatatgcaagggcaaagcaatattatgtaataaacatataatgccctgatgatgctatttcagagtgggtactaacgtacagcacaggtttgattgttctgagtatttttttatgtcttgttttctactgttcaactggttagaggttaagattttctctttgtgaaagtcttttaaacgttcgtttattacttaactttgcatttttgcttaagaagtctatcatttgctatgtgcctagaattctcaactttttgaaatataacatgacaaatactggttagaagttgtcgattaaatgcttcatgattattaaactcttaataccatgaattgacaattgattttagtttacattcatgacaacaatttaccgctccaaaccttgaagagctcctctcaccactcccacagcaaagctaatgacatatatcccttgcagcataactctaaattgatcaggatatgtactgttaaatacatttttgctagatgcagtaaaatgttaagctttctcctagttgacagtatgtgctgtcaactgtgctgaaacaaatgttacacttttttactttttggtggtggtgtcatttctattgaagtcaatcttttatatgttaatggtgcttgtcagttgtataggaaaatcctgttggggagatgggatggagtggtgaagttaacccctatcatgtttccaatagagataatttattctcgagctacaataattgctaaatcaattgatgtttttggtaaagtctttttatggccgtgattatgactcactttaaaatagattttttagctttggtttttgttttgtaggtagaactcccatttaaaatttatttttgaacatccagtaaatttttgtgtttagcataaggagtctcatttttaatgatccaaatgtcaattttttggatgagggagtggcacccgtagtgaatggatttgctgtaccctttaaaacataatttgtagttggtacttttactacattctgcaatatatatgtcctataaatattacaagtgtatttacttgaaatgttggtttttctttgctaagagtgattgagtttgaactagatttaataacatcttagtgtagtaacttatttgtgaaaaaatctgaaaatatctcaacagaatatcattataatatattgtatttaaatgatgtatttatttatttatgttgcagccaagatcatagttcatgatgcggctatattcattgtttatagttgcagtgtgacttatgttaaccactgtaggttttttgcaagaaaatatttactgcctgtgttagtaataaggcctaagactgggcaagcaatggtaattttgttttctggattggtaaagttatcaagaaatacattcttgtttttataagagtattgtatacaacatttaggctactatttagagctttggactaaaattatactttatctattacattgaaaactttaagagagaaattgacagtgtgagaataatggcaaagcaattttgtgattcaaaacattttagttgataaaacggtcaaagaaaagccccgtatctttaacaactgtaatgtaaaaattgtagcagatcaatttgtaataggagttgaatcagataatgacaattcaagttttttccagtatattttatgtgcttaatgaatatttttattgtaacttttgttatatcacttccattcatgtaagaattattggagccctcttgtggacaggaaattactaaaatacatttcctttcaaagtgaacttttatcacttttccaagttaaagtaaaatgacatatgttgaatataccaggagaaaatgccatgaaaggaaaaggtccagaaaatagaaaagtatactgagatttaatgcccagggactttttcctctttagttacagctcctttttatttttctttctcttcctgatgattcttatttcaggtttaagttggagggttttataaagccaaaaggtagataagtactgtttacatatatgtgtgacttgaatagcttaataaataatatattaagaattgaatgtttctctgaatttttacttgaatgtctcctatttggtattttgaattagacatttttattaagaaaacagatgacattgtttcccacagctttgaattccttctttctagctctgaatcctaccccagcttgtgtctaaaatggtctttagttcattttaggccacagtgatctttccttcttgtaaaccatttttctttagtgcttttgacattcctcttacacaggtatcaaatttctatggatatagtatcacttttatttcacctctgatattttttagacattcagaaattgttgagtgactttcttgactcacaaactattactgtcttcgttacttacagaaaaaataaatattgttccgtagtaatagtggtgttaaatatgaagtctataatgtctgcttctgttatcacttggaatatgaaaaatatatatttatagtattaaaacttgaagttattttaaattagtggataaaatactgatggtgctaatagttttcacaatatagaacattaaatatgttttaggagactgaagcatatacttagtaaatgtgctctttgattttctaagtcatcttattctgggagggaaaaatgaagagtgactgtagaattcatggtaacctggaaaccttgggtaataagtcattccgaaccagtaaattttctgaatacttggaggttgagtgttaagatagcccaatctaacaatgttggattaccattgcatttgcttaaatgaaatatactatgcataatttaacttatttttgatgacttagagctatgatttgaataatattgcttgcattcaatcagtgtttattgggtacctgtctgtgtaatatggtagtagtattaacaggcataagctacaactataataccctcggcacctaatatagattgtgaagctttatgccccttcactagatcagtaatttacaaaatgaggtgaagcaagtcaattttgagaagtaaatatgagaacttctgtttgtttattttgtcccccaaaagggaaaagaattgagcttttctattcatactatgtgaattggctgtgaggttctcctaggtccacctgcattcaggtggtcactgagagtgtggtttgctgagggaagatgtgtgaattctagaatgtagatgccagcaacagcaccatgagtttctcagagtttttccagtttttctgttatatagtccctttaaaaatactttttaaaagaagaatctatgatacttcttattgagatggggaacagaggtttgctgtcaaagcatttaagagttgtagaactcaaagattaatcacacatttttattacaaaagatgagtattctatatgctgttcttatccgtgatgacaagaggctaccaaaaataaaaatctagcggatgtgtttgggaaaacaatccccaagttgtcacttcaaggcaaaatcgacattttaaacagtaagtgagaaagtacctgcttttcaaaagaaacatgttatggagaacattttgaaagcatgttgaagtatttacagtctgttgaaaatcttccttacaatgaattttaattgactttggaccatttattggaaagccaaacattttaatttgtaaacattcttattgcagtcaggaaaaagaaaattttaataacattgacatcaggtagctgactttgaataaaaatgtttgcgtatttggtgatagaatgaaaaagtaatatgatttagtaagttagtaagtgacatgttcttctatatagatctcatctttgtaagataagtttttcaggtatgacttatgacagctcttaaaaccaagtgcaaaatacattgaacttcacaaaagaagaaactaagatttaaaaaaatggagatatatttaataataatgctcacctaatatgttaatagtaatagcatttttagtgattgaaagattaaaacaagttaatatttaaaatagttgatagttaaaatagtaaagtaaaaacaaaattttaatcttttaatttctgtttttagtatatgttttatactatgtgtatgtttataaatgaaaacacatatactataggtatgtgcctcaagtattttatatttgggatcttcagtcaaaaaaatgtaggagccactgcactagatgactaaagatttctgagcattttaacttcttgtgtttgatagttagaagttttctgtctcctgccttgttgagcagctgttttttcctgtgatcagtgtgcctacttattcctaaccatttacagttgctggttttaatttgctatgggtgtggaaaccatatttccaaagtttattaaaaataatatgtgtttaaaatgagcaaatggtgtctgagtaggattttaggagttacctcacagtaaagtgagtatcttttgtttcatggacttgatcatatctgttttggttgcttagaattctctttttaggggggctaattttctggctgttagttatgttttgcagagatgcagtttcttgatagtgaagaactgcttaggtgataaaaaaattacacataactttactttgagctcgtagaggagagagaactaatatttgttgtgtactttctagtaccaggcagatgcttggcattttacattatagcatttaatttaatccttacagtcaccctggataaatatggttggtatatagataaagaaactcttaatacccaccaggtgaagaccaccaggaatgcatctgtggtgaaacaagttaggttgactgttttgcagctaggaagagcgtatgccagatcctgccaagtgtcagtaaaagagaatgggagggctgggcacggtggctcacacctgtaatcccaacattttgggaggccgaggtgggtggatcacttgaggtcaggagttcgagaccaccctgaccaacatggtgaaacccccatctctactaaaaatacaaaaattagctgggcattgtggcaggcgtctgtaatcgcagctactccggaggctgaggcaggagaatcacttgaacccaggaggtggaggttgcagtgagcagaggttgcagtgagctgagattgcgccactgcactccagcctgggcgacagagtaagactctgtctctaaaaaaaaaaaaaaaaaaaaaaaagaaagagaatgggaggagttttcagtagggtttgggctgtgctggaagcagggactcctggactgaatgctatcgtacatcaactggaggtgggttagtaattgggtctttcagcagtctttgtttaggagacaggataaatgaaggggatttggaaagtcattggtgagaaaacataatcacttacagaatgggagattgttggtcattttggagctgcagtgtggccataggaaaaactttttacctgttggtcttctatctttcagatatcacagtctgattatcaaccgagctcatttttactttctcacagcctaggttcagagagggtaaggaacttgtttgagatcacatagcgaggaagaagttgagctagaataggagtttgggtctggtggcaatagtgataaacatctacacccctccccacaacggtaactgagcaaacattactgaatccctcaggcacattatcctaagaatgccttagattccttcccaataccttgctccagggagtccctactgattggtctgagctagcatggtagaaatgaaacctacttcatatatctttgtaataaactatgtaacatctggattggaatgattttaattaaggttggttgtcttactaattggtaaaattaaagggagtttcctttaaacttgttggaactttgagtcttcttatgtatatatttgttacacagtggatttttcttaaaaagtactactttgaatgctttatatatatatgtaacaaatagattgacttgtaaaggatttagtgatttcggggcattttgtttttgtctccatacttttaactgcatatatatatgtagagagagagagagagagagattctctattggttggtcaaatctagtagcatttttggtcttaagtaaatatatatttgggtaattttctgactagattttgagaagaaaatgttctttctgctgaagaaaattgttgaagtttgacattaacatttttgtttatgtacttaagatggcaatttattgtgtctagacaaaatgttcttatgatatatgtttttctttactttcatataaaattagtgtttttctttgccttagaaatagtcttgcttttgtatcctgctattctcattgtcatgttaaatcaagtttagcctaaagctgcctccttacatatttaaagctcagcctatattatgaacatctatctatgcaaataagtatagaaccgtattataattttgaaccgattatgatagatgtatataaattatttagcgaattccatattcatgagcatttagaagctattacaaacaatgacataatggatattcttaaacatatctctgtgccttgtctgattattcccttaggacaaaactcttagtaatgtagttgctctgtcaaaaaatatgtgttaattttgggatgggtgggaaagagaaggatatatatttcctaattttaaagcatccttgaatttctggataaacctagcttttaattttacattactcaaatggtatatgctagataatacttcattgagatttttttttgttcatgaaaacaattggctagcaattttaatttcttgtaaagtatttgacagatttaggtatcaaggttatgctgacctcataaaatgagttgggaaatgctttttaatactctggaagaatttgtgaagattgattttattccatccacaaatgtttgaaagaattcactggtgaagccctctggagttttcttgtgaagattattgattgtatttcgtcagtacataaaaagctattcatattttctatttctttgtcaattttgacaagttttgcttttcaagagatttgtccattttgtctgaattttccagttcagcttaaggtttttgtgtgtgtgtgtgtatccttttataattgttttggtatttgtagtatctatgatctctccttttcaaaatctgcttattgtaatttgggtctctttgtacgcagtcttttcagagtccattttcagattaaatgttgtttttaactttttactgatttctgcctttacctttatttcttctatttaaaaaaatgataattttctgtacttttaaaagttttttgagatgagtacttaagtcattaattgtcagcttatttattttttaaaatcttctttttttttttttttcccccgagacggagtctcactctgtcgcccaggctagaatgcagtggctccatctctgctcactgcaagctccgcctcccgggttcacgccattctcctgcctcagcctcccgagtaactgggactacaggcacccgccaccacgcccagctaattttttgtatttttagtagagacggggtctcaccgtgttagccagggtggtctcaatctcctgacctcgtgatcctcccgcctcagcctcccaaagtgctgggattacaggcgtgagccactgcgcccggcctattttttaaaatctttttaagagatgggggtctcactgtgttggccaagctggtttctgaactcctgcgttcaactgctccttcctccttagcctcccaagtagctgagaatacagatgtgcagaccactgtgcctggctcctttgtggggtttttttggaatatttttggaatttaaaaaatgtatatgaaattccctctaaatgcaacttagatggatcttacaagtttgttgtatattatttttattatcattcaataaagcatattttaaaacttcccttgtgctctcagcatttggggattttctagctatatttttgttattgatttctagtttggtgtctgttgtggtctggaatcattctatgatttcacttgtgggtaatttgttgacacttgctttatggtcagttttagaaaattgacagtgtgccatatatagcaattaaatttattaatcatgttcaatctgttgtatcacacttgactttttttgtcttttttaaatcactcaattgagaaacttgtgttaacattgccaaatatgtgaggatttgtctgtatgtttttagttctctcaaattgtgcctcatatttggaggctaagttattagctacaaataaatttatgattgttctgtcttcctgtctagtaacattttttgctttaaagtttttttccagaggggatgttaatatagcattctttttttttctatccatttcctttaaatctctcttcgtccttatacgtaagatgaatctctttaagcatcatatagttgggtttttgcttttttactaagtttgataatctctggtttacctttaatgtaattactgtaccacattatttgggtttgaatttacaattttgcaatttgtattttacttccatcattaagtcctttataactttcccttccattttgttttcttttggattaatcaaacagtttcccatatacctttctctcagcttctctgttataaattcttttactatctttactggttagcatagagattacaatgttcatctttaacttttttgtctgtcataaatttttgcctttgccacttcagggtaatggaatggccttttaatttaattccatttacccctcttccagtctttgctttgttttcaaccccaaagatgtcattattattattgttaaagtaattataacagtggtaataagagtaatgttgttgttaaaataatcattgctcatttcactttgtcctcaaatttacctttctggaggtcttcatttctttctttttgattgtatgtgcatctgggtaattatcgttttatccaaggaacttttagtgcaggtcttctggtaatgaattccctgttttggtttgcctgaaaatgtgttcattttaccttcacttttaaagggtccctactttatgcaccttcaagatgttattttatcatcacctggctgccactgtttatgttaactcaggcttttgattttattgttactcctttgaagttaatgtgttttcctttggctgttttaaagattatatcttgtctttggttttcaccaattttactattgatgtgctcttgtgtagcttttttttttgtaatctacataaagcttgtagagtatcttgaggtcctgagtcaatctttggcttactatcttttgtcatttgggaattagctaaaattattattattattattattattattattattattattgagacagagtcttgctggtgtgcagtggtgcaatttcagttccctgcaacctccgcctcctgggttcaagtgattctagtgcctcagcctccctagtagctgggattacaggcgcatatcaccacgcccggctaatttttgtatttttcatagagacgtggttttgccgtattggccaggctgttctcaaactcctggcctcaagtgatccgcctgcctcagcctcccaaaatgttgggattacaagcatgattacaaagtgttgggattacaggcatgattacaggcatgattacaaagtgttgggattataggcacctggcccgggaattagctaatattctttaagtattatttctattcaattgtcttctttccttatgggactacaattacgtgtatgttaggtcatgtcactgtttccattcttttttccccttctcgtaagcctagagattttctagcaacctatcttcatgttcacttgtattttcactgtccagtatccagttatttctaattattgagtttttaattttagtttttgtattttttatcctaaaatttacatagattcaaattcttatgttttcatctgttttcttgagtatattaactactgttgcaaaattcctgtctgatgaccgtcatacctagattgtctgtgagcctgtttctgttgttttgtttttgattatttgatcctttttccttgggtgcctggcaatgttttattaacattgtgatgaaaaattatagagaatctgaattatggttatgtttctccgtataggatttaatatcctctggtgagtagttagaaaaacattgattactttgattcgtaagtgactgataagacatgagcctgaattcagggcagtcaggaaattctgatagcctcactattggtggactactggtgtatagcccttagctaaggtctcagttgaaagtttgccatgtttaccaagatacctcttccttggcaagtcctgaatttcaggtatcatgaggctgatgaaagctatttttaaaacctcttttcaacatctttttgttgggattttctgaatttcagtccatgctgtttacaattcagcacattcctggagaggaaaagttgaacagaatattgggcccctttctttgaggttcctttttattttcctgagatcctcaattcctggccctttggtggtacaacatccactttttgtgtcttcccagcccagtgagattcatacaagttctgggatgctgctttctgcttggccttttgctctgtactggtaattggcaaatacctcaagggggaattgaagggagatcttcaaagtgtttcccttctctaagggatcttggctcctcaagtcctgacccttggttgttctccggaaaccttcaaatagctggggatttaggggcattttatatcacttttatagttgttttccatgggaaatttggtctgatattgctgttctctcataggtagcctaattgccttttcttttcgtaccctggttttattttatttatttatttatttatttgtttgtttatttatttttgctgttttgtgctgtagaattggcagtcctctctctcttttatccttctagttgctaagaactgctaaaactaattactatgttacttaccatggcaccatcagccaagcagttgcttaagtcagacgtctcttggagccatccttgattcctctcttttcctcattctttatattcagtcactttcaaagtatatctagaatccatctacttctcttcatcatgctaccaacctagttcaagtaccctctctctcctggactattgtattaatcttggaactaatccttctactttgattcacattccctgtagtaccttttccaaaaataccttgagtgttttccattgaagaataaatttccatagaataaaattacaaatcctttccttgggccttcagggtcctgcatgatctagctcctgcctaacatgactatgtcatctcatttgatttgctatgctttaattgtattggctccctttcagttcctcaaacatgctacaagccctatcccacagcaaggctgagtctttgccttggatattcatcaatatactttttttttttttttttttttttttttgagacagcgtctagctctgtcgccaggctggagtgcagtggcgcgatctcaactcactgcaacctccgcctcccaggttcgagtgattctcctgcctcagcctcccgagtagatgggactacaggcacgcaccaccgcacccagctaattattgtgtttttagtagagatggggattcaccatgttggccaggatggtcttgatttcttgacctcatgatccagctgcctgggcctcccaaagtgggagccacccactgggagttactaggattacaggcgtgagccactgcacctggcctggatatttatcagcatacttctataccctctctgcatcacagagtctttgcttaggatgctcatcagtatacttctataccctctctgcatctgcatgggtagtttttctttcttcagagaagcttttcctgacatctaaagttgagagcctttactcccttggtttctgttgcaagaccatattgatttcttctggagcatgtatcacactttgtaattcagttatttgtcctccccagtaggccatagattccaggagggtggagatatatatatatatatatatatatatatatatatatatatatatatatatatatatatatttatatatatatatatatttatatatatatatatatttatatttatatattttatttgctgccatgaccagtacttagtatagtgccttttgtatagtagatttttcataaatgtttgtggattaaaggagtaagatgatcgcttacagacactgtgccaagcttattacttgaaacaaatttaatccatcggaaaactctcaaaacaatcctgtcaggtaggtaggtgctactattaacttcatttcattgatagagaaagtgaagcttagtaatgtttgattattttcctgaagccagctagctaagtagccttttttgtgttcttggagtttttacttttctaactttttgaccattcttcactttgtcatatcctctttactatattttaaagccagtggttacagttatactaatactctgatatttcaacctcagcttcttgcctttgcttaacatttaatttttaacattttaaattagcatgtaatttaataatttaaatgtgaattttaacatttgtttatcattaagccaaaatgtcagaaaataaatttgaaatttgaatggaagttttgagaaagcattaactgaagtttggtgtctttaataggacttaagtactttaagtggtggatttgctatgtggctatcaattattgtgagtgatttttccagctataaaatctttctcattattttgtgactgtaaagagaaagactgtattataattatatatatttgaatatattatgtcatatatgaagaaaacatttttgagccttttatatttaaagaactatttagttatccatattttttcatttgagcatccaaaaagatcaacagatttttcatgttaggtatcatttttatgattacatactagtctacatgtattcattctgttcttcttactcctttttttttttttttcttgagacagagtcttgctctgtcacccaggctggagtgcactgtggcgcgatctcagctcactggaagctcctgggttcaagtgattctcctgcctcagcctcctgagtagctgggattacaggcacgcgccacctgtgcctggctaatttttgtagtcttagtacagacggggtttcaccatgttggccaggctggtctcgaactcttgacctcgtgatctgcccgctgcggcctcccaaagtgctgagattacaggcgtgagccactgcgttatttattcagacagtcaataagtacttgttgagtacctcctatgtgtcagacgcttttttaggtgctggtgtatagtggtgaatgaagcaaacaaatccttctcctaatagagtttacatttaaatagtaaagatacagacattgaacaaaataagtgaaatatattgtatattagatggtggtaagtattacagagaaaaataaagcagtaaagggggttgggagtgctgagtatgtctgtgttcagttttaaatagtgggatcagggaagggctcacagagatgttgacatttatgcaggagtctaaaggaggtggggagcaagccatgcagctatcttagggaattatattgtaggcagagggaatattgcctcattggagtctttgttctttttaaatctcacagtgtgtcttctgccatgttctcaaatttttatgtttcttgtggtatttgttttctgtcctgtgtgatctaagtggtctcattattttcctcactaatttgggcagcaaacatttttgggtgccagtgtcctagatagatcccatcaataaagccaatcatttttctctaatatgtttcaaatcaatttcctcttttatctccactactttttaacccgatctccatccagacgtctttttagtttagtcatccactgcggtccgccttccaccgttttcccagatttgtctatggaaaatacagatctcagtgtctgactgtactacctactaatggctggctatcactcacatgctaatccaggccaaccttcttaccatgacagcattaatgctcttgtcttggcagttgggccgcattccagcctcatctcctgttggccccttgtatgtaccctgtgtttgagttgtaatgaacccctgcttgtccataatctttcttttaactcctgtgcttctctctcatcctttgcagagccttcactttctgcttaaagtggaccttgacttctctttatcttgctccatttgcacctgaaacttgtcctcaactgcagtgctaattccttggtaatgttttataactttgtcaggcagctagacactgtaagtatagaacatgctgggaaatccaaattaaaaatgacagttggcacaaagctgacttctgggagggaccaaggaaaagtagccagagtggcaggatagctgcttccatcacggattgccagcaatgtaaagcgtagactccagaggaacagtgctaacttaaattaactatgcaggcatcagtacttctggttctgatggcccggggatttctaagtagtagtgagtctcagcattatttgttatacagtctactgctagatgaacaaggctaagtctacagagaaggtaaattatagaaattaggccccgtctctactaaaaatacaaaaaattagccgggcgcggtggtggggtcctgtagtcccagctactcgggaggctgacgcaggagaatggcgtgaacccgggaggcggagcttgcagtgagccgagatagcgccactgcagtctggcctgggcgaaagagcgagactccgtcttaaaaaaaaaaaaaaaaagaaattaggtaaaaggattggaatcttagctaattggtctgaaattcagagctaggccacagaattagttgctctttcataaatttcattacctgtactctagcaattgtaagtgtttttatgtgtttctcccactaaacagactatgtacttactctgagggcagagaggcctcatctttctaaactgctgtgtctagcacagtgcctactaaataaggaaaactcaatgaatgttgaattagcactgcaggtgtctgatagaacttagcacaatcatggaaatgttctttattgtgtcgtctagtaaggtagccacgtgctgggctacttgtgtctattgggcactttcttcatggctagtgtttgaggaagcgaatttttacttatgtttaattttaatgaaaatatctatgtgtatctagtggctactattattggacagtgcacttgtatggtttatataatactttcagtggactaaaaagatctttgactttttttgtttttttgtttgtttgtttttgacttgtattccaagtggtcccagactgctaagctttttgttttactttttgtgattttttagtttttttcttctcttaatgtcagcgttctttttttttctatcattaagtaagctgtcatcagcctttcttttaacttttctgattttagtcaactatcatatagaaagacatataatcaagcttgtagaattatctttttttttttttttttcttttgagacggagttttgctcttgttgcccaggctggagtacaatgacgcgatcttggctcaccgcaacctccgtctccctggttcaagcgattctcctgcctcagcctcccgaatagctgggattacaggcatgcactaccaccccggctaattttgtatttttagtagagacgggttttctccatgttggtcaggctggtcttgaactcctgacctcaggtgatccacccacctcggcctcccaaagtgctgggattacaggcgtgagccaccgcgcccagcaagaattatcttttttaaaagagcaagtagtataggaatctgtgagtcattttacctctccttaacttctgtaagagtgtgaaattactcatcaggaaagaagagaagtctaaaaagtataaatttgtgtgagcattcagttgaaaaaatatcaatatgagattagatgagtcaccaagggagggagggaggataccctgaaggcacaacccctctatttgggaaaaagggaattatgaacgtgagaaaaggaacagagttataggaaaaaagaaaaaaaaaatgctggattgtcatttaaggcatatagggagaaactcaaggaggcagatttgtcaacaacagcagatacagcaaggaggtgaggaatattgtataatttggtgaaagctatatgggtctcaatatattatcaagtatttcaatgtggtcaagagtgtttttaatataattcttgtagttttcttccatactgatatgctaggcatagaaggattcagtatgtgcatttttttgaaagtcattttttccattcttgtgcctgtatctatattttccaaacactttctaattgtcaaaatacctttgctttgctactgcatataatcaggacaggcattaatagtacttgctttttgctctgaaattattcctttttaatcttacaaaggtgaatatttctattacagaatagtagggctgttggttcagtagcagtcatctagttcatgctttgatgcagagattgcaaagagatgttgtttcttgttaaattctttgtacccagagaaggagttttactaaaaaattgggaaattagattcccagctgtcataggagggaagcaaatggctttttcattccccaaagtactgtctaccttactcctttgggacttcgaacaggcagccaagaaaaatcaaaagctgggaaaactttttccctaaatacctttattctgggttcattgataagttgtatgtactgcagattgcagatgtaagcctgttattatatttttgcttttcaaattatggcaacacatgagtcatttctggaagaaatgcttacatatctcatttctcaattagaaccactagatggacagctgaagtctcccttgagtagttcaagtggctatcccaggatggacaaaagggatagcagtctactctgaaactgtaaaaccctttttttgttccccaggtgacttgaataacttatataacttataattacctgagaagcacaccaaaaataatcacaagtgcaaaagggaggttttccagaataggcacatcagattattacaaagaaaagagcaatggtatatccactttcgctctgtttgaaaacatagtatatgtgtggtcacatattagatgattaatttaagctagaagagtaactttcccaaattgaccattcttaacattttaagaaaataatttaattaaaaataatatgagtagggggtggttccaagatggccgaataggaacagcaccagtctacagctcccagcctgagcgacgcagaagatgggtgatttctgcatttccaactgaggtactgggttcatctcactggggcttgtcatatagtgggtgcaggacaatgggtgcagcccaccgagcgtgagccgaagcagggcgaggcatcacctcacccgggaagtgcaaggggtcaaggaattccctttcctagccaagggaagctgtgacagatggcacctgggaaattgggtcactcccaccctaatactgtgtttttccaacggtcttagcaaacggaacaccagaagattatatcccgcgcctggcttggagggtcccacgcccacggagccttgctcattgctagcacagcagtctgagattgaactgcaaggcagcagcgaggctgggggaggggcgcccgccattgctgaggcttgagtaggtaaacaaagcggcctagaagcttgaactggctggagcccaccacagctcagggaggcctgcctgcctctgtagactctacctctgggggcagggcacagccgaacaaaaggcagcagaaacctctgcagacttaaatgtccctgtctgacagctttgaagagagtagtggttctcccagcacggagtttcagatctgagaatggacagactgcctcctcaagtgggtccctgaccccctagtagcctactgggaggcaccctactgggaggcaccccctagtaggggcagactgacacctcacagggccaggtacccctctgagacgaagcttccagaggaacgatcaggcagcaacatttgcttttgagcaatattcgctgttctgcagcctctgctgctgatacccaggcaaacagggtctggagtggacctccagcaaactacaacagaccttccgctgagggtcctgactcttagaaggaaaactaacaaacagaaaggacatccacaccaaaaccccatctgtacgtcaccatcgtcaaagaccaaaggtagataaaaccacaaaaatggggaaaaaacagagcagaaaagccgaaaattctaaaaatcagagcgcctgttcccctccaaacaatgcagctcctcgccagcaagggaacaaagctggacggagaatgactttgacgagttgagagaagaaggcttcagatgatcagacttctccgagctaaaggaggaagtttgaacccattgcagagaagctaaaaaccttgaaaaaagattagacgaatggctaactagaataaccagtgtagagaagtccttaaatgacctgatggagctgaaaaccatggcatgagaactacgtgacaaatgcacaagcctcagtagccgattcgatcagctggaagaaagggtgtcagtgattgaagatcaaatgaatgaaatgaagggggaagagaagtttagagaaaaaagagtaaaaaacgaacaaagcctccaagaaatacgggactatgtgaatagaccaaatctacatctgattggtgtacctgaaagtgatggggagaatggaaccaagttggaaaacactctgcagaatattatccaggagaacttccccaacctagcaatgcaggccaacattcaaattcaggaaatacagaggatgccacaaagatactcctcgagaagggcaactccaagacacataattatcagattcaccaagttgaaatgaaggaaaaaatgttaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcgtaagtgaagaagaaataaaatcctttacaaacaagcaaatgctgagagattttgtcaccaccaggcctgccctaaaagagctcctgaaggaagcactaaacatggaaagcaacaacaggtaccagccactgcaaaaacatgccaaatagtaaagaccatcaatgctaggaagaaactgcatcaactaatgagcaaactaaccagctaacatcataatgacaggatcaaattcacacataacaatattaaccttaaatgtaaatggactaaatgctccaattaaaagacacagactggcaaattggataaagagtcaagacccatcagtgtgctgtattcaggaaacccatctcatgtgcagagacacacataggctcaaaataaagggatggaggaagatctgccaagcaaatagaaaacaaaaaaatgcaggggttgcaatcctagtctctgataaaacagagtttaaaccagcaaagatcaaaagagacaaggccgttacataatggtaaagggatcaattcaacaagaggagctaactatcctaaatatatatgtacccaatataggagcacccagattcataaagcaaatccttggagacctacaaagagaattagactcccacacaataacaatgggagactttaacaccccactgtcaacattagacagatcaacgagacaaagttaacaaggatatccaggaattgaactcagctctgcaccaagcggacctaatagacatctacagaactctccactgcaaatcagcagaatatacattcttctcagcaccacatcgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccacacaactgcatggaaactgaacagcaagctccggaatgactactgggtacataacgaaatgaaggcagaaataaagatgttctttgaaacccatgagaacaaagacacaacataccagaatctcagggacacatttaaagcagtgtgtagagggaaatatatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaatcaataatccaggagctggttttttgaaaggatcaacaaaattgagagattgctagcaagactaataaagaagaatcaaatagaagcaataaaaaataataaaggggatatcaccactgatcccacagaaatacaaactaccatcagagaatactataaacacctctacgcaaataaactagaaaatctagaagaaatggataaattcctggacacatacaccctcccgagactaaaccaggaagaagttgaatccctgaatagaccaataacaggctctgaaattcaggcaatgattaatagcttaccaaccaaaaacagtccaggactagccaaattcgcagccgaattctagcagaggtacaaggaggagctggtaccattccttctgaaactattccaatcaatagaaaaagagggaatcctccctaactcattttatgaggccagcatcatcctgacaccaaagtccggcagagtacacaacaaaaaaggagaattttagaccaatatccctgatgaacatcgatgcaaaaatcctcaataaaatactggcaaactgaatccagcagcacatcaaagagcttatccaccatgatcaagtgggcttcatccctgggatgcaaggctggttcagcatatgcaaatcaataaacataatccagcatataaacagaaccaaagacaaaaaccacatgattatctcaatagatgcagaaaaggcctttgacaaaattcaacagcccttcatgctaaacattctcaataaattagatattgatgggacgtatctcaaaataataagagctatctatgacaaacccacagccaatatcatactgaatgggcaaaaactggaagcattccctttgaaaactggcacaagacagggatgccctctctcaccacttctattcaacatagtgttggaatttctggccagagcaatcgggcaggagaaagaaagggtattcaattaggaaaagaagttaaattgtccctgtttgcagatgacatgattgtatatttagaaaaccccgtcgtctcagcccaaaatctccttaagctgataagcaacttcagcaaagtctcaggttacaaaatcaatgtgcaaaaatcacaagcattcttatacaccaataacagacaaacagagagccaaatcatgagtgaaatcccattcacaattgcttcaaagagaataaaatacctaggaatccaacttacaagggatgtgaaggacctcttcaaggagaactacaaaccactgctcaacgaaataaaagaggacacaagcaaatggaagaacattccatgctgatggataggaataatcaatatcgtgaaaatggccatactgcccaaggtaatttatagattcaatgccatccccatcaagctaccaatgactttcttcacagaattggaataaactaaagttcatatggaaccaaaaaagagcccacattgccaagacaatcctaagccaaaagaacaaagctggaggcatcacattacctgacttcaaactacattacaaggctacagtaaccaaaacagcatagtagtggttccaaaacagagatatagaccaatggaacagaacagagccctcagaaataataccacacatctacaaccatctgatctttgacaaacctgacaaaagcaagaaatggggaaaggattgcctatttaacaaatggtgctgggaagactggctagccatatgtagaaagctgaaactggatcccttccttacaccttatacaaaaattaattcaagatggattaaagatttaaatgttagacctaaaaccataaaaaccctagaagaaaacctaggcagtaccattcaggacataggcatgggcaaggacttcatgtctaaaacaccaaaagcaatggcaacaaaagccaaaattcacaaatgggatctaattaaactaaagagcttctgcacagcaaaagaaactaccaccagagtgaacaggcaacctacagaatgggagaaaatttttgcaatctactcatctgataaaaggctaatatccagaatctacaaagaactcaaacaaatttacaagaaaaaaaacaaccccagcaacaagtgggcgaaggatatgaacagacacttctcaaaagaagacatttatgcagccaatgggcacgtgaagaaatgctcatcatcactggccatcagagaaatgcaaatcaaaaccacaatgagataccatctcacaccagttagaatggtgatcattaaaaagccaggaaacaacaggtgctggagaggatgtggagaaataggaacacttttacagtgttggtgggactgtaaaactagttgaaccattgtggaagacagtgtggtgattcctcaaggatctagaactagaaataccatttgacccagccatcccattactgggtatatacccaaaggattataaatcatgctgctataaagacacatgcacatgtatgttcattgcagcactattcacaatagcaaagacttggaaccaacccatatgtccatcagtgatagtctggattaagaaagtgtggcacatatacaccatggaatactatgcagccataaacaaggatgagttcatgtcctttgtagggacatggatgaagctggaaaccatcattatcagcaaactatcgcaaggacagaaaaccaaacaccgcatgttctcactcataggtgggaattgaacaatgagaacacttgaacacaggaaggggaacatcacacactggggcctgtggttggatggggggaggggggagggatagcattaggagatacacctaatgtaaatgacgagttaatgggtgcagcacaccaacatggcacatgtatacatgtgtaacctgcacattgtgcgcatgtaccctagaacttaaagtataataaaaataaatagaaaaatgagtaatttcttataagtttaaaattgatgtgaatcttttagaaggaaaggtaattatcattatgcagtgtcaactaggttaatgtggttgccactcagttatcctccatagtaaaattaatgacatttattctttctgtgatttctcaatgtacttgaccagtggttcctaaagagaagtgtttatgtatcttgtcccaatttgtcctttcttggccatactgtatttatttttatctgtctacacttaaagatctaaatttgcagccgggcgcagtggctcacgcctgtaatcccagcagtttgggaggccgaaggcgggcggatcacctgaggtcgggagttggagaccagcctgacaaacatggagaaacccgtctcttctaaaaatacaaaattagccgggcgtggtggcgcatgcctgtaaccccacctacttgggaggctgaggcaggagaatcgcttgaacccgggagatggaggttgcagtgagttgagatcacaccattgcactccagcctgggcaacaggagcgaactccttctcaaagaaaaaaaagaaaacaaaactaaatttactatttggtttattattctttcattctaattttgtaattaattagaaaagcaataagattattgtaaaacttgtaaaatagaaaacattttaaggaaaataataccatttataaaattcttcttcttacatatgaatactattcatgttttttctctctacgctccacattttttatgtgtgatgtgatgtgtgtgtttgtgtttgtgtgtgtgtatacagttgataattcattttgaaatgttctaatttggggagatcttaaagatcaaatttaattatgtgcccttttgtgtgcccttttgtgtaggcaatttacactcactcaaaagaaaacctttagttctttgagtttttcacaggatagtacaggcttctttttaacacatcatagctgtaccgtatttcctttttaaaatgcagtctttggccaggtgtggtggttcgtgcctgtaatcccagctactggtgagtctgagatgggatgatcacttgagcccagtagtttgagactgcagtgagctgtgattacgccactgcactccacctcaggtgattctatggagtaatatggttgtgccagtgactagaaacacttttctaattttaatcctgtaatttcactaagatagaagcaaattagaactctcctaaactagactatttcagtagaatcaaaaggagcagaggtttgagtttatatttgagatttgtgggatgcttattttaaaatctttgagatctcacaaaaggactgttttgtttttaactgttccctcctccagtcagtactttatcctattgctaggtttgtaaatacatatatggtatgtgtatacatctctgtagtatacaacacctttgaaaagaatctttagatttcaattatattttacttactccccctttcaccagctaaaagtaaatgaagtaaaaacaaatctctaaatgtgtgattacaaaatttacacatacatttatcttttcagaaatcacatttgcataaagttcattgagttcaatgtctgctaatttataagatagtttccctaccatatatattcaaccaaggcagcatattccagtggtggtattgttaattatatcagaattaagaacatcaacactttctcaaaagtactgaatgagagcaagtttctggatcttctaattcaggtaatttaatttaacaaagagctttaggactagttgtaatcacctagcaattactcataaaattgtttttaatttcatctatgttccttgagagccactgtgttgatgattctgttttggggatttatgtgcagtcagataattcatattttgtatttctgtacgaaatcaatggaacaagacaaaagtaaacttacagaaaattagtaaaaaattttcatatggtctcgtactagagaatataaagcaaataaaagatttttattggctaaaaactaaactttgctacctgtggagtacgtatgtaatgaataaatgatacacatacaaagtgttagaaagctcaaccaaagaagttagcatgttcttttggaaatgagaatgtcttcatgttccagtgacatttagtatctggaatgcagtagtagcccgatcttactttagaggttttaaagttagatttaccaataaatgtctgcaaaaggtattacatctggcttcctgagcaatttgactagttacccaagagttgtgattactatgacatgacgcagtacagctgtaaaaaataaagacaaatttaagtttagtcctggtatgtatacacagctttgctatattacaagaagggtattttctttgtgatgagtttagtgtaataaatcaaacacatatataacctataagtaataggttaaaaaagtataaatatattgaaacactgctcagatttcatagtcttttttttaacaaagcttttttggtacttagtaagcttcttctttgtgttattttttaatagtgaaataccagttgctggcatctattgagtgcccaggtgggcactgttttatgcttcacacatgtttactcagtaaaatttccctacaatgctattaggtaggtattattattatccccattttacagataaggaagctgaaacatggagattttaaagcagttttctggtaactggtggagccaggattcaaaccctggcattctgtttccagagcctatcatgtgacagtctgttattcccagaattctgggaaggcatactctgctattaaatactatatatattagaaataaggcagttcattttatatatgcatgtggtaagattatagaacaaaaagacaacagtcatttaacaaataatagcaaataagctgaagggttgacttcagtaactttagaatgtagttatgtttactgtttttctcatggtcagaacctaatatgttgatttaagcaatgtctatagttaattcattagaatgaaaggacagaaatgtagtggatgataactcaagggagaaaaaagcttgatataatagtttttaaatgtttaatactatttcaaatataggaaccatgagtgaaaaataaactccaggatcgcaaggaatctggggagtatcctaaactcagagttcattctgagttactataaaaagtctgaggacttcaggccaggcatggtggctcactcctgtaatctcagcactttgggaggccgaggcaggcggatcacctgaggtcaggagttcaagaccagcctggccaacgtggtgaaaccccatctctacaaaaatgcaaaaattagctgggcatgatggcacatgcctgttgtcccagatacttgggaggctgaggcaagagaattgcttgaacctgggaggcagaggttgcagtgagccgagatcgagccactgagctctccagcctgggtgacagagcaagactccatctcaaaaaaaaaaaaaaaaaaaaaaaggaactctgagggcctctcagtgggattctaatttctgatacatctttcttttcagggtcactcgcatactactattaggacttcattagagaagcttctttccagaaaagaaagaaaaagccatatgttggaataagttaagaaacattgttaggcttatgggaacaccataaatcatcctataaagcttatttgtagaaccttttacgtttttgaaatggttgacattttatctttgcagttgtctatagaaaagttttgggggtagggattggggaaaaaggattattgtccttgaattatctcctgtgatagaggtctcaggtcttgaaatcagccctttgacgttaatgaatctttatcattaattcttgggggtgggggcggtggtgtggtccttggattctttctaaatcatttctctccaacttggaaatatggttctcttctaacttttaccttttttaaaaaaagtgatgtcttttctggtagaagaaattttatttttgaaaaatgctcataaaaagaaagctacatactttgcagtatcctagtattttaattcattatcataagtaagcagtaattatataggttctattacagaaagtataactgctttattgtattaaatcttctagtcctgtgattggtaggttaatttttttccagctttgtagaagtaccattgtaacaatctccttagtttatggacttggccaaatgttgtattcacaggtaactgtttcttttgaactctgagcatctttctttatcccaggatttctgatatggatagccttgatgtggttaagggtaaatgcaacaaaatcaccttacttggcctttgcctttcgttttacgcttcatagttctccttttctgtcccaaagctaaacatggggtttaactctctcagattatatttagagagtcacttaggtgggattttctaagcacttttattttaactttcatgaaaaatttcaaacatacagaagtagagagaatattataataaaacttccatgtatccatatctcagcttcaacagttgtcacctcatagacagtaatgttttatctgtatttgtacttgctctacttgctccttctaaattattttgaatcaaattccacatctttcataaatattcccagatatgtaatatatagtgattatttttaaaacaaccataatactcttatcacaccttaaaaattagcagcaattacctaatattatcaaacacacagatataaagcatgtaaagatgctgctatcttttagcaattgaaaaattaacatttcagaatgtgattagtgttaaagtggtttttgtcttgtgaacattgtgaaggggagaacgcatgggaaaggtctttttaaattctgtctgagacagtattcttagagttctgggttttttagtcttaaactaaaatgaattaagtctcaatttgctatcaaaatatacaagctgttatacattggccactaaggtgaagtgcaagcacacttgtgataggcgtattatgtgaagtcagaactttaaaaataaggaaacaaacacttttttgaaaggctggaaaaacttccttaacatttaaaaatagttcttaaacagagaaaaatttgtcaggtgattgattggccttaatttgagaaattattagttttcatcttccttttttattggaaggaaaaggaagaaaatagttatttgtgtacttctgatcaagtgacctaaacagttttctttttcctttgctctgtaaaagattagtagtcgtttaaataattgatgttaagtgtctctgaattcctgtgttttgaaggctttgcacatattaactttctcttcctgactgaaaaggatgtgtgtgatagtatctttttacttagttagtctaaatttagatttcttgatcatgaattagaaagcctgtgagtatatgtgaatgttagagtatgactgttttcttatttttagctacttttgctgctgaacttccttttttcactgcttggtgcagttaagggtaaatgcagagctgattctggtgtaatgcagcttctaggacagaacatttgcatataatatgttctataccaggaatttgaaatggggactaaatgcaatttgtgaatgaagcaccttaatttgctaaactaggagctatgtcagattttaaaaaataaagttttgctgtcagttcaggctagtataagttattttctgtaactcaaatgataaaagcaaaagtttaaaacattctctggatcaaatctaattttgaattcctggcttacagagaaagcacttgtttatgtctggttgccatttacccagctccctgctctcccatctgtcagaatgctgacccagtttgggattagaatagggatttaccacacgcacaagtttatacatgcatgcacacatgtacatgtgaatttgtacgtatttcacttaacaaattggattttagcattgatcttctgctaaatggaattttaaaaaaattatctatgattactttgcttttagagttggattacagattacattgaaaaaaatagaaaacctccagaaacgctttcctttctaatacatttcagctattttgcttctggtctctttcctgttcctcccctgacccattcttatttccatcacctcagccggctttatcatcataaccctgtacccctcccctaccaagtagagcagggactaagcagtgattaaaacattggagcaaacctgaatggcttaattcatttaaaaaattcgaaggttctgctgcccatttatccatcagataagaggcaaaacaaacagaaaaacttagctttagttattacagtttatgttttcatcttacgcgtgttgcataccaagctatggtaactgtagacttccccaaatgacattcagattctaaactagaaaatgcttttatttatttactccagaataaataaaatgtcgcagacaagaaggtaatgtattttcctcctaaagtgactttaaagattgaggtggtttagtatttagcactgaaacttggaatcaaacagttctcagtacaaaatgtccaggaataatgaggaaacggcatggcagcactgccatggtttttgtctttgggggattgttgtatgcaggcaggataacttttgcgtctcacatcttgaatccagaggtgatagataaccctaatttacctagcagttaggtatagcagcagtctgctacctagagtttatccaagaacaaggaaatagcaaatgtctccaagcaataaaaatattacacagattcttgtaaccaaatttataaactttactcctagaagattttcagagttcaacattgttccttttttttttttttttttttttttttttgagacagggtcttgctcagtcacccagcctggagtacagtggcacaaacacagtttactgcaaccatgaactcatgggctcaaacaatcctcccacctcagcctcctgagtagttgggaccacaggcatgtgccaccatgcccaacaatttttttttttgtagatacaaaatctcaccatgttgcccgggctggtctcaaactcttgggcttattcaatcctcctaccttgtcctcccaaagtgctgggattacaggcatgagccaatgtacctggctcatttacttttattttagacacatttgctattattttaggtaaacagtttaaaactgattacttcagcacatagcaagagatttgttttagatagtcaaaacagtcagcttatatggtaaaaattccttattgttacttggttctaaaagtaaattccctaaactctgtggttatattccataatttagtcaatttcttcaataccatattgctttaattgaggagaagggactctagacaaagtaatgtaataatattaatattattcaataataaaattgtaatatgtttacagagtgctttttgcttttcagttaaaatactttcattcatattgtcttatttaaaaatagattatttcttcttagtcagatcctggtgacagtggggaaaaaaatcctacaaagctaacagaattcgtagcatagcattctgaagtttagtggaaaatagccctgagcacctacctaatatgtcctaaaagcatcattgtgtgataaatgatatttatgatgactccatgcagaaactggttatttgatagatattgaaaggtgttaaacttacctacatcagaaatgtatagattattcagctgttctcaagttgaggtagctcccaaagataaagctaagatagacctgtatgagttcagttccttcattgcagtaggtaagttatccagacatctttcattgagtgcttttctatttgaattggcatcttgtttaatcactttgtgaatgacatggaaacccactcatctggtaacttttagatagatttttaggcaattcagaaagcacactgagaatttccctaaaatgtcagtaacattgcctgaagttttattttatggttctgggttggaaagacagtacatatttgggaataaagtggcattcagaagagcaacaataaaatggggttttgtttgtttagtttagctgtgggttatacatattccttggcttctagacctcacaaatttatttgttcaggaagttattaacacatttctaacttggataaaatacttttaatatctttgatctatggtaggtgggtaattcatggtcatttcccaaagtatgtatttatcatttttggtatccagactagaggatctcagaagtttgaagctgatttattatatgagatatttctcccccccacacacccatttcccactcatctaactcgttctatttgaaatctcagctgagtctttagaattctctgggatgctgtttcagacccttgtaaatctgtattggtgctcactctttgtgccccagtgacacaggatttctgttgtagtacacactggattgacatttcaattgctactgtgttttgcgcagagttaggacaattcataggggatgggaactaatagttggtgaactaacacagtaataataatcttaaatatttgcccaacatatatttaatagaagaggaataaactgattttataacatttctatatagaaacaaatacctactaattcgttttctactggccaatgcagggtcagttttctagaaataattagacaaaacatttctgaaggtttggtagttttaatcccttagatcttattgcatgatttttctgaaccaggcagctttctaaaggccatttaaaattacacaataaaatttaattaattctggtaaaaatatattgttcagttttggaacttctgctgactgcaaccacacatggccaatcatattccagtggtgtatttctggacagcagcccgcctaggtcattctttaataaaactctggtctatctcattagcttatgtgctgggacagcatggcacatgggcatcttattcaactttataataggcccttacatcttgggcctattacagtgcttggaaaagagtgggtgttaatatttatttgatgacttgttgaaagagtattaaagtttttctctttactcatgtacaaaatttggcttggcatcccaaataaaatttttattattttttattatatagttgttatatatctctatatattaaatgattatttatgataacagtagaagctcttaataggttttcatgtcattgccattaatttgttctagattttctgtttggtagaatataaatttgttttccttgagaacgtctgtaagctagcaggcaggctcagttttagttaaggactgatgagtaaaatttgtaactgctgaaagaccttgtatgatttttgatatttgaagtaattaaaacaacctgtatttattcttattggctgtgcaatataacttcacaaaatctacagcaaaataacattagatactctttaaaaaaaagaaagattctaaattagacctaaaactactgtttcttcttggattagacctaataactcagaatagaaagtaaccctcttgaataagctgaagaagcgtgatttgcatgcattccttcttttgtaactctgaacattatttcattagataaccagaacagtgtcactaatattcattaattacatctttttcttctgaggattttaattttatttcaaaagtggctctgagtcttcttccccaaagcatatgagaatattgtggtggtgtttaaaggttgctttatttcttgaaaataatgatgcaaagtgaatttaaaaagtagcagtttgaggaattgaatacagtcatctctcagtatgagggaaggatttgttcaggaccctaccatcacccaatgccaaaatccacagatgcttcaagtccgtgatataaaatggtgcagtatttgcatataacctatgcacgtcctttcctgtatgttaaattatctctagattacttacaactaatacaatttaatgttgttctatgtattgttttttatttgcattatttttaattgttgcattgttttcagtgttttccaaatattttcaatctgtggttggttgaacctgtgaatgcagagtctcgaggataaagccaactttacaacttttcatattttacttaaataaatatgcctttgccttaagttgttttggtatttcccaggctttggttcttactgaagataattacttttttcattgtaaaaaaagatttatgactttcaagaagaaaaataatttctgagcaaagagaaaatgaagaagaatactatgattgggctagctggagaagcgtttcctgacgttctatgcaattactgaagtttggctgtaatttggctctcagcaaggcaaagggagatatctgattgataataagattcatagtattcataaattaaaactatagcaattgcttaggaaaagaaatttttttcctgacactgaagtctgagagaaatgtcttacataggcccttataaaggagacattgactagttctctccaagtaaatgtaatgggtatttttaatgacgtaactcttagtcacaattgggtaaaaatgactctttagaaaatagcactgtccaatagaaatagaacacaacatatgtaattttaaattttctggtagccacattaaagttaaaagacaacaggtaaaattaattttaataacatttcacttgatatatccaaaatattataatttcaacatctaattgatacaaaattattgatagtgttttaccttttttcatactaagtcttcagaatctaaggtgcattatacttagagcacatctgaattcagatgtcagattttcattagaaatagtctatatttcataaaatttacagttgaaaaaataaattcatatatccaagttccaaacatgcttaaggttttctggtaactgaatctcatatatcaatttttaaatttaaattaatttcaagtgctcaatagctgtatatggccagtagctactgtatggaatagtgcaattctagagtatctagagttagaaaaatcttacctaggagtacacatcagaatcacctgataccttcaacatatatgaccttggaaatgattcagtatgtctggggtggtgccttggagtatgtattttggaaagttccacaaatatattctgatttatacacttggctaagagtgtattaatccagaagagaaaatgagctgcatatacttaaagtgatataaccatgagtagtggttcttgcaggtaggctttgtacaagagttcagcaataagagcccaaagtgcagatattcaacattcccagcctgaaaactcttagaattgaattttgaattggctaaaccctgtgctgatttgaaagggaaggtttacatggggaataaataatggtgagactgtcaatacattcagagaattgtggacttcaagacttaaaccgtgtggcttggagaggcttcttgaaggatacaggaattaagctaggccttttacaaattgataagatttagatgggggagcatttcaagtagaggaacattagtacgagttcaacctatattggagaagaaattttgaagtgagatggagccggagtaagggataaaattttgaattttgtttatttaaagggcagcatgaagatacttggatatttgagagaagatagagagtgtatcagttaggaatgcttttagctgcaaaaacaaccaaccaaaaaaacacaaaaaccccaaacaaccccaactaatagtgactttatcactaaagatatttaattatctcacataacaagaaattgggaaaaaggcattctggctagtctagcagcttagtgatgttatcaagcagccaggtatttttcattattggaggtagcctttttatccttgtgcttgttgctcagtactttcaagatagctgtgtgctctaggtatcacaaccagttgaaagacaagaagagcaactggtgaggaatggcatggagggcatggcagggacagtctatctaccagtttccttccgcagctctctcttctttgcagcataggattaaatttcctagaagcccccatcagtcttccatacacctctttgtccagaactaggtcacatggctagtactagttgcagtggagtttactgtagctctaatgtcctcttaactgtgttaaacattgcttcattttaaaatactcttaggaaggaatgaaacaaacatggcatgtatcaattaatattgagtttagcaattagtaactgcaaaatcacacttagtagattaaaataagtaaagagtttatattattctgcaacaagaaatttggaaagtggcagtccagggctagtacagtggcctgagaagtaccctcgagggaccagtatcctcctgtctacttgctctgctttccttagtttatggatttcctccccatggtccaaagattatcgtataataattccaaagatcacattgtgttctgggtggtgaaaaagtggatgggcaaaaggcttttccctagcagtgctttgagaaatgacccttcctccccaggtactttaacctgtaccaccattgacttgaacgatgtcaagggtctatacatagctagtaaaagttgagtacgttttccaggtctttattgtaaaggcccaaaattcataatttttaacagtgagcaaaagaacacattcccacattgtagccagcctttcaaactaagtcattttgtatccttctgttgtgtgcgcagctacttcttcctaagcagagtgctggtttccaatcatagcttgcattataaacaacatcagttcaaataaggcaaatcatgttccttaatttaaaatatctaattcacacgtagaaaactcactgttacactaaaaatacctgtattttcacttagtagaatattaactagttattaaatatttacaaaggctttgcacaaaatgtactatacaccactggtcttcagtttacaaatccaaaagatgccttgtcttcatcttacttggcctctcagcagcacttaaaacagtacagcatctggccttttaaacactttcttcttttggtttctgtgaccccatatacatgattttcttactgtctcattagctattccctctcagtttctttggccaactctttatttgctttttaaatattagccttcttcagagctcagtctgtgctctcttctatctctctcttttctagaattggatcagttcccaggctaaataccacttaaatgctgatgacccccaaatgtgtatttctagcccagacaatctcctctgaattccttaatcacgtggccagttatttttaacatctccactttttaaaaaacaaatttaggattgatcctattgataccatcatcattctcccagttgctcaatcaggtatgtggaataaccttaattcctcagtttctccattattcatatcacatacctcagcaagttgtattttttactcctaaaatatacagtgggcctttcatattcataggttctgtgtctgtggattaaccaactgtgaattgaaaatatccaggaaaaaaaaatttcacaaagtttcaaaaagcaaaacttgaattttctgcagtctgaacactatgttggatccacacaaatgaattaatatatagtcatttgtattaggtattaaaagtaatttagagtgatttaaagtatataggaggatgtgctaggttatatggaaatactgtgttattttagatcaggaaccagagcgtccttggtttttgttatctgtgggcgggggtcagaaggcagggtcctgaaacatagaccccactaatgcctagagatgactctatatttagtggaaacatatcttcttcactgcctccatccctgtccaggcttttgtcatctcaactaaactcttgcaaagtcttctaaggggtctgtcagcttctgttcctaaggaaagaatgctctatccgtacaacagccatgatgaccttcagtgtaaattggaccatgctccactgctgaaaactttttaatggtttcacagtccactttaatatttaaattccttcccaggctgtgtgagatctgactcttgcttgctcttcagccttattggtggctgtcttcctcagttaccattctgtgctgatttatttattttttcctcagatgtgccaaggctttttcttttctgctttggagtttttatgcatgaagttcccactgcctaaactgttctaccacctactctttgcatttctgactccttcttcaggtctcagtgcaagtatccctttctcaagctccctctccccaggttccctattctaggaccctgttgaccctgttacttctttatagcattttcccacaagttgtcttttgtttgtttgcttgtttacctgtcttcatcgctgtactgttagttccatgttttcagacatccatctatgttttacatcatgtgtacccagtaggtgtctagggtaggtgctcaaaatttttgaatgcatgattaataccttgtagagatgtttatattattttgaggaaaagaaagatttatattctattgagcatgatcatactgtgttaaaaatataaatagtctttagttaatccaattttttttcaattaaaagttaaaaactcttccaacttgcacttttatacctgggcacaacgggagatcattgaatgcaactactacttccctaagaagggaacatagaaaataatatgctactttatatttttacagaaagttacagagcttagaaaatacatacatattgtctcatttgagctttacaatagtgttctgagtagttaggatatttaactttgtgtaagcattggtcttgctactaggcatgtgactttgggaggtaagtcatttgcaaaatgagacaatgagggtggtgtgggtatccatagaattaatatatatgaaaatattttgtaaactacacaaaacaaaacagatgttggtgataatggtattaacactaagaaacttagcttccaggacagttaagtggcatgtctaggatgtcacagctattaagtagtatgattgataaccaaacccaggctgtacagtgaaatggaaaaatcaaaaggttgagtggtaacatattagaatgtcttcataaatcatatgtgtgaggtggggggagtgggagcttgggttttgaaattttgtaattaatttaaagtagtcatgtcatcctttattaaatggtcatatatgcactgtatgcattgagtatacactgagcaaataagaatactatgacacctttttataaatttgatacaaaattaacttgctagctatatattaaatatttagtttttcccatcttaagagttggaaggaaaatggaaggtgatttttaatggtctagaatagattgtaatgaaagctgcttaagcagcttctttttgttcatttttccctttagcaaacagaggctttgagaatttcctcatatatacctgatttctcttagaagcactatgaaagctgttttaatgcatgtttgttaatcattgtggtttttacccactacaaagaatttataaaatagactattataatacgtttaaccattaagtagcaatagacaattcttttaaaatttgaaaaatgaaggaaatattaaaaagtggcaaaaagtcatccatattgttacctcccaaagatagcctttgtaaatattttggtttctgtcttgccaatcttgcagttaactgttagagataagtcttgaatcaactttttccttctctttttcagaattcctttttttattttttcagaacagcaatcatagctgattgcttccttgagggctatatttgatctgaacagtgatgctattaagactacactagatactatacttacagttattagattaagtcatacttcattgaacagcaatgtaaacagttacttggataataataactactgaataaaaaggagctctaaaaattcatagaattaataggaaaaactggttgtagaattgtggttgaagtcaataatttggtggagagcagaaaacaaagagataaaaggcaatgagaattgaagtctgaggtacttaaatcacagaactcaggagcagtaaggcagctggactggcagtctcgattcttatgcagctcaccagtttgtgggctagggaattgagccttgagcagtgaagtgacttacccaagattatatagtcagctagtttaaaagccaggactaggagagtccaaggttcctgacttacagtttaaccttcgtttcccatacaagaagtagcaagaactgggcttgacattatagaaaatgaattatacaaatattaactttatacagtttgtggtacctaggttctctttaacaatagttgggtctctgtggaaaaggaaagaaaatatggtaaactttcagattcaaatgcccaaattcatattcttaccaattcctttttggtatcattactctttctttgtgatttcatcattctgaagtacactacatattagaataactgataattataattgaattgataaaatatggtatatattaaatattagtttggaaatacaatctcacagtaggaaagaacaagatagaggttattataaaacttaaaaattgcaccatagacacaaaagctactgaagaaagcattacagatcacaaaagacaataaagtgaattatgagtttgcacgtgtatcactgggtcaggagagatgacaaagccatggccattataatatcccttcaggcagtgatcacgtgaagccagttttggagtgaggaaaatgctttttaatatttctgaatttaagccaaagaacgcctcagtatttataatgaagcaaagatcttggtctaatttaagaaggtgttagactggggtcagtaaatatatggcactcttgcacctcagcactgcacccaccatactccctgccccccagccctaccctttacttatgacagacatggatgattaataacaactcattttccactaaacctagagatggtttaagatccttcttaggggagcatattttcagcagctcctgtaaattaatgattggcaagagtgataaaatttgttttccaggccggcattagatattttctggatatttttcttgctaaagtagactaatgtaaaagtaagtcaatcaataaccatacaagaagagctaactactcacttgctgagtaataaaggttttttctctatagcacagttttatgtaattggatgctagtgtgtaattttactaatatagaaatacaagatactactttgtggggttttttggttttgttttttggttttgagacagcgtgttgatctgtcacccaggctggagtgcagtggtgcaatcttgactcactgcaacctctgcctcgtgggctcaagctattctcctgcctcagcctcccaagcagctgggactacaggcacacgccaccatgcccagctaattttttgtattttaattagaaatggagttttactgtgttggccaggctggtctcaaactcctgacttcaggtgatctgcccaccttggcctccaaagtgctgggattacaggcatgagccaccatgtccggccacaaggtactactttggatgcataccactttattttagaatggcatttgtaatgccatagttttctggaaatccttagtagttttagaaaatggtagaatttttaagaatttatttaaaagtctagcctgtatataacttaatgttggataattgcatggaaaatgtatataatgaataggtgaaatcatgttctatcatctcagcttcttgaatgttgtgatgtttcaaccattcattcaattaaaaatatgggagggcaagttataattaagccaaaccagttgtactagggagtgattttccccccaagttaaaggagactattttttattaaaaagatagatagcatatatagtcatgtttctcaaagagaaggtagtattgggggtgtaagagccgttttctaagtggagatgcccatgctttcatcccagaggacagacatatcagactcttggaagagggggcccgggccaagaaatataatttgaaaaagctccctaggtgattttgaatctaccttgccctcaaggactgctgaaatctaggaactttaagaatttagattctaaaattgagtttgttttccagacagaattcccaagagagaattactgtggaaagctgctgtagaccatttaatccatccattgtgataaaatggcagacattcttagtttgatataggtgtatgttttacataaatcttagtatttcaaatattttaaatacctcttaattattgagtagtctctttagagagttgttttttatttaaatcattggctttgcttaattaaatggtcccaaatttctgaatcagatggctattttgatatttaataatctggctctttcaagttagtactgttacctgagatacagaattatatgtaaccaagttgtatatatatgtgcatgtgtatttcaggccacatgcacatgtgttgtgtatgttcagatcattagaaggtaggaatgatcgaatgcattataagctgtttctgtaatctctgttgtttatagcaataaatcatgttcattgtggaaatttggaaaaatgtgaaaagtttaaagtagaaatctgaaataactcattatgctatcacctggaaataacatctgttctgttattcagtttcttcctggttcgatctttggaggttctgtttccaggagtttatccatttgttctaggtttttttagactgtgtgcatagaagtattaatagtagtctcccaggattttttttgtattactgtggggtcagtggtgatgctccctttgtcatttcttatttggatcttctcccttttttctagctagtggtctaatttaatcttcaaataaccaactcctggatttgttgatcttttgtatggtttttcacatctcagtttccttcatttcagctctaattttggctatttcttgtcttcggctagttttgggcttaatttgctcttatttctctaattcttctaggtgtaatgttaggttgttaatttgagatctttcagactttttgatatggttatttagtggtataaacttctctctttataaacttccatctttagctgtgtcccagagattttggtatgttatatctttgttctcattagtttcaaagcatttcttgatgtctgccttaattttattgtttacccaaaggtcattcaggagtaggttgttcaatttacctgtaattgtatggttttgagtgattttcttagtattaagttctatttttaatgagctatggtccaagagtatggcagtataatttcaggtttttttttttttatttagctgaggattgtcttatggctgattgtgtgttctattttaaagtatgtgccatgtgcagatgagaagaatgtatattctgaagaatatacattctgaagaatgtatgttttttggtgaagagttctgtagatgtctgttaggtcttttttggtcaagtatcaagttcaggtcttgaaaatctttgctaattttctgccttgattatctgcttaatatagtcagtgggatgttgaagcctcaaactattattgtgtggagatctaagtctctttgtaggtctttaagaacttgttttatcagtctgagtgctcctgtgttgggtgcagatatgtttaggatagttagatcttgttgaattgatccctttactgttatataacgtccatctttgtgttttttgatctttgtgggtttacagtctgttttgtctgaaattaggattgaaaccccttctcccttttttttttctgttttccatttgcttggtagatttttctccatcccttactttgagcctctggatgtcattgcgtgtaagatgagtctcttagagacagcgtaccaatggatcttgcttctttatccggcctgccactctatgccttttaattggggcatttaacccatttacagtcaaggttaatattgatatgtgtggatttgatcctgtcattgtattgttagctggttatcatgtagacttgtttgcatcattcttttatagtgtcagtggtctgtgtacttttgtttttttagtatgtacttctgtgtgtttctgtagtggctagtaatggtcttctttcctttccatatttagcactcctttaaggacctctggtaagttaggtctggtggtgacaaattcacttagcatttgcctatctaaaaaggatcttatttatttctcctttgcttattaaacttagtttggctggatttgaaattcttggttggaaattcttttcttatagaatgctgaatatatttgtataagtgaatgatttgtataagtgacctgcctcttctctctagctgcttttaacattttttattccattttgaccttggagaatctgatgactgtgtgtcttggggatggtattcttatgtagtatctttcagggattctctgcatttcctgaatttgaatgttggcctctttagtgaagttggggaaattttcatggacaatatcctgaaatatgtttcccaagttgcttactttcttcccctttcaggaatgccagttagtcatagatttagtctctttatttcataaccctgtatttctcaggagtttcgttcattcttttttattctcttttttgttgtttttgtctgactgagttcagcaaaccagtcctcaggctttgagactcttgcctcaacttggcttattctgccattaatacttgcaattgcattatgaaattcttttagtgtgtttttcacctctatcagatcagtttggtcatttcttataatgaccacttcatctatcagctcctgcatcattttattgtactccttagattaggtttcatctttctcctgaaccttgatgatcttcatttgtatctctattctgaattatatttctgtgatttcaccccagttggaggacccctgctgggaactagcgtggtcatttggaagaaagaagacaggctggcattttgggttgccaaagttcatgcactggttctttcttctctgtgtgggctgatgttctttaactgtggtgtaactcgagtacagtcagttaacttcttttctggatgttttcagaaggccaaagctttgtgccttgtccttttatttgtgcagggtctttatttgtcactgagttcttgtccttggtttcacagcagggtgtattagcaaagtatttttggtgttgaagtttaagctgtgatccagtagatggtgcttaagcataatggctagtaggtaggctcttgctccactgcgtggcccctctgtatttcctcaccactgcagctgtgcttcctctccctgctctgaaagtgtgggctcctctcccacttaagtggtggctgcaaatctggccttcatactcccaggctgcacactgctgcccttggatgagctcaggcttcatgttcccttcccagtttggaggcaacaggggaagggaccttggcagtggctgtggcagagggcctttcacttgcctcttggggctccaccccagagaaatgcagaccctctatcaatcagtgtgttcggcctggggtggggtggctgcatagtgggctcaagccagggaaccctgcctggtgacgttgagcaatggggaaagaggactttgcggggagacagtctggcctcttcttagggtggctatgacttgctaaaggtatagttaaagcactcagggtcttcactccttccccggtccgagggcaacaagggcagtacaactgaagtggtagaggggctttcagttgtctctgagagcgaaatcagagaaatgctgagccgttgctagtgggaatgttcagccaaggattggggagactgcactgctggcccaagcttggggctctgcttgctgaaaaatgcgggggttgagggctcataatgagaagaagctgagctcctctgtacaatgactgtcatgctttaagtgtgaataaagctctcaggctcttcgtttcttctccagtccaagagcagcaggggcagaaccgctgctattggttgcctctgggagcccctccccagggaaacacagagttactagcagtgggaatgcttagctgggggtaggatggctattctgtggttctgagagcgggtgtgcctgttgaagagtggggagtggggtctcacagagaaaagagactgggctcctctccatagggtggctgtggcatgccagagttgccatcaggccctctgttccttcctcagcttgagggtagcaagggcagtacccctgcatctgcaatggcagaggggctgtgggttgtctctgggattttctcagagaaatgcagagctgccacccactggtgttcgggtaggggcagggtggatgtgctgggggtccaggttgagaggcaccctgtccctacccggaggtgaaaatccatatggaaaacagtctggccctttttccataaggctgctgcaccgtgggggggtccctgtcagtccccagccactaagctgccttctaagcctgagggcaacaggaaagaggtctgttgagcagcaaaaatggctgtctgctccctctgggagatccatcccagggaggttcagagctgctaccagcctgagtgtttgttacttagggcaatgttgctccaacgatttagcagaccggcaggtaactatcctgccgaaaggttgacttgacttattccatccatattttataaatttttatggctgcataatattctttcaagttagtctgccatattttttcttttatcttcttttttttagttgtattaaaacattcacactttatcattgttaggattttagaagacaacatttttatatgtcatagctttttttcttctgcctcttttgaattatttacattgaatcaatttctaggaatggaatctcagttaaaaagagggaatattttttacagcttatgatattaattgccaaatgacttttcaaacaggcttacactgttcaagtgctcctctctctcctcaaatctgcctactcattggccatcagaacttactaactcattcagtcagggttaggaggagaaataagaggctgaaatttaaatccatcagtcttgttactttgttgctgtctcgtcatattttcagcagagcaagatgtcaacactagcatttcaaaatatatcttaaaaattaaatgtgaaattcagtgatttattgatttgaattgaccgcagggtgtttgcggaagtaaaacttaaataatcatgaatataagctcgaaaaggaattactgttcagcaattggattttaaaataaacttttgaaacctttggatgttagtatagtcatccccctattccctgccctagtcatcctagaaaattttattctcagtccattggttctgccattgcataaaatactttgacttttttggcttttttttttcaatacccacaatgtgacaaattttgtcctttgatacttggacttattttgaaaataagcaaaaattattcaaaacaaagtctaaaataaaatggtgataaactgcatggtattattctaggcttaaaagaaaaagccaaatgtgatttgtaaaataataaggcaagttttgtaaataaatgccatgtagaagtgaggtgatggagaacaacagagggaaataacttctaaactaggtttcaaaatacttccaaaatacaggatttgactctttttttcccttcaatggcagcaattgtgcacatccagtccaaaggtaccgctttgaagaaccactcatatgcatgtaaaaagttctatttttgttacagactcataattttatagtcttagtgtatgggagcaaagaaaataatatgtgatcatgtaatttattgcatttaggtaccttttagacatttttacttaaccatataacatcttcagttagtcttattttcaaatgattttaaatatcctatttgctgagtagtttaaaatgtgtgaagttgttgtattgctctagatttctccaagaatgtgctcttgatggtttatcacagtaaaggtatgaattaagtaatacattacttagccgtgattctcaaccaaggcaattttgccccctaggagacatttggcaatgtctgcatacttttttttattgccacaactttgccgggggcagggggaaggggaaggcggcaagggtggaatgccactgatatctagtggatagaagcaagagatgatattatacctcctacaatgcacaaaacagctccccccactacccaaatgaagaatttatctggtctaaaatatcagttgtgctgaggttgagaaaccctatcttagcctaagatcttgggttcagaaacagagctgtattcagtttcccacttacctttggcaagatatttaacctcattcaagcttcagtttccttatctggaaaataaagagaataatatctaccttatataaatatcgttagcacaatttctgagaccgtggtaagcaggcaacacatactgttctcattgttatcactaccaataatatcaagcatgtgaaaaattactaaaattataacgtttgatgagtacttaaacgcatctatagttttttggggtttctcttaattttgctcatttaagaagaattcacatatcctttgtgaaatagctgtgctgttgcaagtatgactacttagaagtttttgttttccacatattttctaattacacttgattcagactactctattcatacttgtattatcaaaataataaggcttaaatgctgtgaaaaatttgtagaatgattgcacatatttagaggactcagtctttagaataaggactgttagtaagcttatggactgtggcctcttcttttttagagctgcatctacagtagtagctatggcttattagagatcttgtctgtgatcatggtaattatggtatttttctctttctttctaatggccccctgaggattttattgacatactttagggaggacaatcagctgatttagtacttgtaccatgccttcattaaagatgtttagggtcgggcgcggtggctcacacctgtaatcccaacactttgggaggctgaggtggtcggatcacctgaggtcaggagtttgagaccagcctgaccaacatggtgaaaccccgtctctactaaaaatacaaaaaattagctgagcatggggatgggtgcctgtaatctagctactccggaggctgaggcaggagaatcgcttgaactcaagaggcagaggttgcagcgagccaagatcgtgtcactgcactctagcctgggcacaacagagcaagactcagtctccaaaaaaaaaatatatatttaatatgccatcaaaaaaaaaaactacattgtgaaaaactgggtaatggtggaaaagaaaaagtagaaggaagcaaagacagaggaatagagggcatcatgattcatgattcctccccttgaagagtttatagtctagttgacatgatatttaagtaatcctcatggatttacagacctaaatgtttggcagatttcatgtattaatagaaggaaggaagtattaataactgagcaatgttaggaaaaggacaaaccagggacagccattttccttaattgaatcttattaacccttacatttaagcataagactaacaacagttttaagacttagaacttacatgatcatatttattttatttgatctttgcagtagtcataaaaggtaaatcaacacttacgtaatgtgcctcccaaatgcatgtaggtaatgtatgtaatgtcaaattagagatttgaaaatgaattggtaaaaatgtaatggcaaaaaaaatgtattggggaatgtcagtgcagaatttgaagggttctttctccagcactatcttggccggtgtaaatgattgtatttcgagaccttaaagaggattagggggattcaccagagaaccacatcctggtgaaaatattgtatagagacattaaattcctataattctaagattctgtctgtaccttcaaatcacattttagtcactaactaagcctgcttctttgaccatgaacatcatatctctttcacaaggaagcaaagtacctagcatttaattttctttctctttttccttttctgacctgaagaaatgtacagtttcattggggagacaaagaccaaccagccaacagaaaactgatactaaaatatgaagaataagaaaaatacattaagaatttttttctttagagcctgtttgataatgttttcaataaataacttctactaatttataaataattaatttataaatacgttaactgcttattccatgccagtataattgaaaagtcagtggttaaagagacatttagactatgttctctttatatgacccacgcttcctgcctttaagttttttcctaaaatcttcctgttatttttctaaatctagaatatgaagcccttgaggaatagcagctgagtttaaacagtacctagtgaaaggctgaaagaatcctcaaaccttctagaagaatgaccttaactgttgtgatcagaatggagaccaagtcatggtagagatccaagatgaaatcattttatcacctaaaagattgtcagcgtttttgattatagccatcttagtgggttggagatagtatttcactgtggttttgatttttattttcctaatgactaaatcatgctgagcatcttttcatgtgcttattgggcagtgtcacttccaatttaaaatatgtaattgagtaatgattttgcttgggatttttaggagaaatgcttataagtttatttgtagtaccataacatttatgagaatttaaggttgaccatttttataagtttagtttattagatttataagaattataggtaattgggaagattcaccagcagttagtggaaatatctaaagaagaaattgaatctgtttaatttataattgcagtttaaaatctaaataattgaaagccagtggtaagtgatacattttgacagatttgtaagttaagtaaaaacttaaaggtaactttaaaaactgggactaattttttgaattttttttgtaattttcataaatcaaatattaattaaaaaataaaattaaacttctagattttattttctgtgcacaaaaactactcctggcacaaaaaccacttccaagggctccaaaagcagctctcatcttcagccttttagcaaatgacttaatttttatcgtctaattatttatattaggccagctctaacatgcttcttcctttgcggtagatctttcaagttttatcttctgttctcttttcaggctttctaattataagaaccgaacaatagaactaagtattttaaaatgccattaaaaagaaaaacttaaaattcttctccttatttaaaaaaaaaaaagagagatcaaagtcttcctctgccacccaggctgtagtgcagtgacacagtcatagctcgttgtagcctcaaacttctgggctccagtgatcctcttacctcagccttccaagtaactgggactgcaggtgcataccaccacacatggctctctctcttttttttttttttttttttttctgagatgaggccttgctatgttgcccaggctggtcttgaactcctggcctcaagtgatcctcctgcctcagcctccctagtagctgcgattacaggcacaagctgccacctctccttagggttgcagtgagaattaaataagtcaatatataaacacctaaaagaggatctggcaagaggtatatggattagcagttattaatagtgttattacctattaataatgttactaattgttaataatataactaatgttagtcactaatgttactaatattattaataatgttacttactaaatcctgactagaggatctagtaagagttatatgtattagcagttattaatgttactactatgtactgcatattaagtatatattttttatattattaggttaaattcttaggagttccctaggatatttgctgccatatatagctcattttttcccctttggaaaatataatccaggttacaaacaatggatttacaagttaagcctttaggacataaaagtttataaatcagcattggttaggctccagattatttagtatttgctagattaaatccagtagtagagttatcccttgaaggcattaggtcttatgcacataaaagtttatgtatgaatatatgtgatcaaaatcactaactccattcatgagcgaatagcctgagtacttgaatttgaaatgaatgtttgctgtcttatcatttaagagtgtcaagataagaatgttttggctacaatttgtaataattgtaagtctctttgagtagaattctgcctttgttattttatagtctttatgcatgcatttaattcttccctgtacctgctgcaagaaaaatgtactcaaatgcatagccaatttcatgatttcagaagcacatattgaagtgtacctgctaatttctgttgcttttgcaggtcttgaatatttaagcattgatatgataagtgcctgataaatacattttgcatggataaattaatatacaggattaactagagcaagatacatcggagaaagggcacccagtgcccaggaagacccattagtagattacttacctagtcataagagtctaaactaggatgctgacaggtgaatggaggaaaaataaaagataaacactgcagaagaaaaattaataaaacctggtgactgcgtagctctataaaaatagttgtgattaaaatacaatttaaaatcatatctgctaccagccatgttctttatatcttcttctaacttctaggatcattattattctctaaattcagttaacctatacctgggtacttagttttcacctaacaaacataactaaagtaggtcagaaaaggtcaacatgcatataggtaggggtgcgtgtgtgtgtgtgtgtgtgtagtgttagtaaagattccctcttattaatgttgaattgctattgaagaaaagtgagaaagtaattttattccttaagaaagcagcttttatggcatagtcatgctttctaaaacttttaagataaagtaaggataataccttcagtattggtaagtgttcaaacattaacatcttgactattctgaaaataagataatatctaataggccaggtgcagtggctcacacttgtaatcccagcacttcgggagggtgaggcgagtggatctcttgaggccaggagtttaagaccagcctggccaacgtggcgaaaccttatctctactaaaaacctaaaaaattaactgggcgtggtgtcacacacctgtaatcccagctacttgggaggctgaggcaggaaaatctcttgaacctggggggtggaggttgcagtgagccaagattgtgccactgcattctagcctgggcgacaaagcaagattctgtctcaaaaaaaggaaaagaaaagccaatagaagaaatgaaagtggtagtaacacttagtaacacacattggttcttgtaatgagaggtccagagactaatttaaatcttttccagactttgtatccgttttatggtgttagttactctgagttatcattgatatatggtagcaacttctggcatccctcacatattcttgaggattgtaggtgtagataattgtagataatagaagtgagtataggctatatcattgattaaaaatagaatatttgagtaatttataaagaggaaatttagaatattaaagtaataagaagaaaactaaaataaataaatagaacattgctaagtaaatagttcacgtcaaagggttgccatacctataccaatttatttggaattctatcttgtcttttataaccttagataattctttaaaaactctgagcctgtttctaaatttgcaaaaaatatgtgatattttctagctcagtgccagggatccattagttcttgaattgtgtctctaacaatgatgcattctggtcttttcatgtccatggctttggataattgtctaatctgcatataccaatctttcctatttatgaatattatttctgctgtctgttagtcgttgacttttccccaggagtttatctgttcttttccttagctgtttctttttaaaatttttcctttcaattttaatttgcactttactattctatagttctcttctttatttcccctctttgaagccatctgctgccatttgttttgctttctgtattgtaatacgaagtgttttgatgctgctagatttatattctctaacaatgagtttatgagcattctgctttttaaaacaaacatagtgtgatgcctttacctctaataaatagcacttaatgattatgttaattagcattcttagcttagaaagtatgcatagatgcagaattttgtgctgtattttatattatgtagtgacagggatgtatttgtcacttttgcttgtcgtttttcctgcttgttatgcaaagctgccctgctgaataatttgtcataccaattctaagtaaattgataaattatgtattagcattttaaaatttaattaataactattaataaaacaccattgtattcaagtaagaattcatgagtattccagagacatctatgtataaataagaacttcaatattaagagcacgtgagatcatggctttctggggcaccactaagtgacagtgtcactagtcacaggttgatgcaaattgtctgagctgaataggactgcaaagcagaggcagtgtgaaacaatcgttttcttcatagacagacagactgtattcttttaaacaggagagcttgctatcacttttgaataataagttaactgacaacatactgtaaagaataggatgatttatttatttatttatttttatttttttccctctttagagaaattggtttttattatcactgtggtctgttccagagcttgtattccaaaatagttgtgggaaatagtctgttatcactcaactgtgtataacggtaaaaaatattagaaaacattttttcttggtaattattggtagatccacttggtggttatacacgaagtgtccagttacatgtatatctttgaaatattttagtaatgttggctatagtttggcacacatactctagtacattattcattcatcctttcaaagtattaaatacctacttttttcaagcactgtgactgaggttgactatatgaattaacttgaattatttttccttttttgatttaaaagcaggatttaatcgagaaacaaaacacaaccaatggaacctcatgtccacaattgttctgtagccacatacgcataataaatgtgcctggtgtaagagaaataagaccagtttaagttttcagattgattttctaccttcaaggaccatgatttaattgggggagttggtaggatatggacataaatggtttcttgctacaataacagatgtgatatatgtaggatgaccttataatttattgtctaaattgaggtacttttgagagtgaaagggggcatagtaatagtgagacagcaaacatgagtcagaattgtcctaggcaagcatggaccctatggtgacagtgattggatatgccagtgattggatggaaactctgaggaaggaaggagtagtgtaggtttgagtggtcacttaggcttcaaaggtgacctcagaaccgaacaagaacaatcagaaagtcattctggtgattcttgccaggataggatttataatgaatatattgctttggctgaaataggaatttggatagggaattagcagtagttggactgaagagtttggattgtaaatatttgatcttaagagttacttaaccttagtgtcccagtttaccatctataaaacggagataacagtacctgtcttatagggtcctatgatgttcaactgtgtacctcatagaaagtactgtgcagcacttgtaagtgattagtaaatgttagctgtctagaacaccctgacagaattttaaacttttaagaatgtttttgagagtacaggatggattgggctgagaaactgacagagagaatttgaaagaattagtaattgggtaagggcaagtgagaaaaaagggcaggagtaaatgatgactgagctttcatgcctaaaggactgagagaccaggagaattcagcagaaataaataagtcaggaaagatatctgttgttaagaaataagttcagttttaaacatatcaaatttgaggggacagtaagctatctacccgatcagaaatggacagctagcagacggagaaatgaaaatggcgcttcatggataattagtttgggaatattccaaatgggtgacagtggaagccttgggagtgaatgagatctctcaaggatggagcagggactgggagagagactgatgagggaaccttggaaaaacccatatttggattataaaaggaagaaaaaccaactgaaagagaggatcaaaggattaaacaagcaggaatagtcttcccgaaggatgtttaaccaaacactagttctgtggggtgggtaacaggtaatatgggaaagaaaattggttctgtagttaaatactcattcactgcaagaattctgtgcccttttaatatgttaacatgcatgacacatctccaagaaggaaacatataaagtagtgttttgtagatttacctgacgtcagaacccctttctccccagaatacctcttgggggttggtgttccagaaaacataactttgggaattataggaacctaatgaggaaagacgtttaagaagtaaggagttaaattgtgtggaatgttacagagactaaggaagatgacaaatgagaagaaggtttttgatgttttcattagatggtcataagtaacctttaggagcacagttcagtagcatggcttcaatagacacaggtttaaaaggaatgaaagataaagagttagtgataaagaaattagagcattggatttatgtaattttacctctattcaagtctaaagtgtgactgataagaatgaattggtcattattgaatgtttatgtgtcctatgtatattattatattcctaaataacgttctctttttacttaatgattttcagatattagtgaggaactttaacagtcatctagaacaatacctctgaggaccattagtttccttttcatagggtgaagtcatacattaaaatgatcttattttctagccatggcatcaagcattaaaccatttccccatgttttcttaaaagtatggggaaagatgcacctttttaaattctgtgtttttacagtgtccatcttatgtgaattttattctaatattaaagaccatctctgggtatattctgctctttcatgcaacagtgatacaaatatttaattgatagttatgctataaaagggggagtcattcttacattcccccgaacaataagtagattattttaatatcagctattttaacatttttaaaggtaacaatgctatgtcataggacttctgactgactttccattacaagtaaaattttgtttctacatcaatacattatgcccaacatatttgaaaaaaagcaaataaacttgaatttcagtgacctggttgtgttagccccattgcctgctgaggtggctgaatgccttacagcaaacccagagtactgtagagctagcaactgtgtttgatcatctctgtattttctggcgcatctagcctagtgcctttttaacacacatttgtgtgttcagtcttttgaagaatcagctgaaagtagaacaatcttgaacacactaataatacaggtatagctctcctccctcttagagattttggcatatgaaagattctgaattttgcagtgaagaaacttacttgaattgaaattttcttttatatttttaaattgtgataaaatacatataacataaagtgtaccatcttaaccattttaaagtgtgcaattcagtggtattttacatttgtgaagttttgctaccatcaccacaatctgtctccagaactcttttcattttgcaaaactgaaactctatgcccattaaacaataattcccgccgggcgtggtggctcacacctgtaatcccagcactttgggaggacgaggctggtggatcacctgaggtcgaaagtttgaaactagcctgaccaacatggtgaaatcccatctctactaaaaatgcaaaattagctgggtgtggtggtgcatgcctgtaatcccagccacttgagaggctgaggcaggaaaatctcttgagcccaggaggtggaggttgcggtgagccgagattgcgccgttacactccagcctgggcaacaagagcaaaactccgtctcaaacacacacacacacacacacacacacacacacacacacacacacacttccccattaagccctacctccattccctggcaactgcattgtttgaattttttaacccatttccaaacttatttcacagtaattaagaattctttttttcttagcatctacttatattccctagaagttccatgggtcagagaaatgcaggattagttttcagttagtatatagcagattaattaaggagtattttgtctcaaaagttgtgtaaatcctaagagaaaacaagcttttctggagaggctattcgaataagatagaaatcaaatatttagaaagaaataggaggagtcttgagagggtgttttggggtggcatcgaagtatgctggaacaagtcctgacctaggaagaagaaaacccaggttctagccagcctctcagggcatctctgtccttgtcttttccttatctatgaactggatgaattctgagactcctagttttaaaaattgttctgtgttgaatgattgaggaatattgtgaaaggcatagaatttaaagtagtactgagaatttgataatagcatagaataagtaggagagagggaatctgggaattgacacaacaaaggagcagacatctcaaaggggatattgtggaaggctcaaataatggtaaggctaagacaaataagtgtagacataaaagatttatcctgtatcatacctggatttattggagtaactagatggttagagagaagagaaagtactatatagtaggttctggaaatgtgccttgcgctagaactattcaaaagaaaacgggtgcctagttgatcttcagtaaatactggttaatttcaggctgtcttatccaaaaaacttccaccatcatgccgtcactaatgggaggtggacagaggaaatagaattgtcatcttcctgaaatacatgaaactccatcatgaatatatactactctaaccctccctgctgtcctctctagtgctttgcctttaccatttccctttctcctttcttagtttagtatcttcagcatttgggtgacagaaacaattgtactaaacagctgttcttaatttaatgagccatgtgacctaaagatactccccaaaacaaagatttctctagaaatcaatccagtgccctagagaaagtacttttgaattcattcaaatttgttatttaagttaatagtatgtatagaaaaccaaagggctaccattgcacattgaaatccggttaaagctgttaccttgtatcctagatgcaagggatatcctacagtcaggttttaaagtgataccataatttaatttcagaatcaatatgttctgtaagcttacaggattttgaacttgcaaaaaaagtaattttaacaataatttgcaagaattctcaataaaacatactgtcagtcttctcatggaattttaattttatcaaagtttcccaaactgaaagtaaatgtacattttaaagtactaaaggaaagagcattatatagttagcgttatgtgatttactaaactgatgatggatataatgatgataatttgtgataatatctaactattagggacttacgtgctgggcactaaatgctttatgaattgtgagttttatattttgattctgaaatgtatttataagaacccaaagttttctttgtttcttcactgatgaagaaaaaaaaaacagtttacatagaaagcaaggaggctaattaactattcctgttcattcatctctatagcccaacagctttttgttcatgttgagtgttcccccaaaaatattttagctaataagtagttgaatggtttctataattcaaaaattattaaatgttgctttggaatgtagttttccacctacattttaaaatgagtcaaaatattctgcaagttcacattccaagtaaatgatatgttgtaaaagttttatttgggaacttaagctagaggactctctgacctctcttatctacctcatagggtaggtaaatgtttccacaagtaaaaacaggaatctcactgagtgttctacctataaggatttgatattaacatttaataaatattagaatctacatcatactaaatgctaaacagaatatagaaaaagatcccgtagcttcttccatccatttagcatatctaaatgtaccctagtttacaacttcatgccttagtctactgaatacaagtaaattcatagttaggaattcagatgtattataggttaaaatctgttttcacagatggcttaaattacttcttcgcaaatatgattgctgccccatttcagtgggggagagaaatcctttcttgacttctccagttctattttgaaattctttttctactctttttttcaaaaaatgggtcattatttcatccaggatgattagatggccaaaggattttttaatgccattccctctcagacatctataagctagaatgtgtgaatcggggtagagggtgaggagtgcaaagcattctaggcagaaggaaaaacctgtgtaaaggccttggggcaagtaagaaattaacagttttgactgaaagacccctgtggttggagcctagtgaggggaagagtggtggagatgatgctggagaataagcaggtccatatagggaccatggtacagagttgctgagtcagttggtctttagtagagtgatatggtagctaggtgctgtgggctcagatgcacctgggctcaaatcacagcttatctgcttactagagtctctaaactctgtcccacaactctagaatgggagagtaatacctttttcagagatgggctaggtagaataaccaagtgcagtacctgaaatatactacaccactcaataaatggcaagctattatttttactttttataactcactgttccacaccctactcaggaatctcagacccactgctgcttcctttttattatttttaaaattcgtccagcaaatatttatcaagcacttacaattacatatcctaactatccctccctcctgtagttatctgtttgtatgtctctcatagcttcaaggttatgagatcctcaaggagtttcatattaaccttttgcaatccaggtaccaagcagtgtctgttttagaaaatgtttgaataaatgaataaaagaaagtttatgaaatacgtaattaccatattttagcgctgcaattgtttgaataatttttattttaaatcagtcttacataggaaaatgaatatatcgcttcctcattctttgtttcttttacagtacagttagcaaaaattcaaaatatgccctttataaattcataactctagaaaatgtttattttaaaatttacatattaaaataagtcactgataggtttatatcttctagatcaagtagctgttttaatatgatgttattttttaaaaactattcattttcaaatgtcaataagaaaaataaccagagaccgacataaacaccaaattataaaaagttgagcacttaaaaaaaatctttttaagacaattataaattaaccatgcagttttcagaaataatacagagaaatccccaacactgttcacccagttttccctaatggtaacatcttacataatcacagtgcagtatcacaacaagaaattgataatgataggccaggcatggaggctcatgcctgtaattctagcactttgggaggctgaggcaggtggatcacctgaggtcaggagttcaagaccagcctggtcaatatggtgaaaccccatctctactaaaaatacaaaaattagccgggcatggtggcgtgcacctgtagtcccagctacttgggaagctgaggcagaagaattgcctgaacccgggagccggaggttgcggcgagccgagatcccgccactgcactccagcctgggtgacagagtgagactccgtctcaaaagaaattggtaatgataaaattcacagactttattaatatttgtccagttttatatgcatttatttgtgtgtgtgtgtgtgtgcatgtgtgtatgtgtttagttctatgcagttttatcacaaatagattcctgtaccaactactacagccaagatacaggacagttccatcacaaggattctttgtgctacccttttataggcaaagtaacccttcctgtctccccttccagctggccattctccatctctataattttgtcatttcaagaatattgtataagtgggatcatatagtatgttaccttttaagcataattcccttgatataagtcgggagttgtttttttttttttccaaagatttgcaaaaagggtctaatacctttcccactggctacctgctgcttgttgccatttagcaaagaaggcaggaatgagcagtagaaaggcaaagggtgcttctgttgatggttttccctaaggaagactggcatgtgaagtagagtatcccaatactcattttattcttaagagattctcagaggagaagtgggaattctttttctgatcaacgtatttgtcttttggtagaaaacagcctttttaaagggcatggtccatctctgtaattatattttatatccaaagaccattctagtcagttccatcttccatcctccctctttctttcccgtcatttttttccatcctgaccaactaaaaacatattattttataaactaagttctatatgtaatttccccaaattgatactatctaacaaatagaaatggcagtttgactaaaaatggttctaacttgaaattacatgcattgaagagttcttgttgtatccattggccttacaggaaatcatcatggtagttctgcctcactaatagtcttgtctgatttgttttgtctcaaaagtaaatataaaaaatatataattcatttgaatgatctaaatgccatctcttaggaactttactacataatagctctcataccaagtcagagtccttattaccagttttcttttagacaggtatgtacacaaagtatataacattttaagctgtaaataagtcttatttttaacccattattgatgtgtcaaggatcccattaccctacaagcagaggtttttaaatgtattttatacttagacttagcttggcttcaaagaagtaaaaaggcctttcactaataaatatttaagtaataagtacttaatattttaaaggaacaagctcacatttatagaaattgtcatacatttactgagaggagctacaattaacattatttatctgaataagccctggaagattcttattatagcataggaacaattaactaataaccagcccggtatccagttatctgcgtgattgctttcaagatttcttctaaaggaaattatgggaatccagtgtttttctccatctttcttacagtcctaaggtatacttgacaagcatactgaggcagattcatggctctagtctagtagcaagcttgtctcatagatataagcataggcccaattaagaccaatctgttaattgtctatatctattaacctagtccgtttgaaaagtagacccaaatgtatacgttaatacggtaacttagaattaattttacttttcaaaatacctgactaaatgatagcatttatgttaactctggcatgttgctgacagtaaagatccagagcccaaaacaaattaaagattgaggtgttcacgcatttgaactatctgcatgaccacagcactaccaagaaacaattattatccattcctgttctacatactatgccactcattcaatacaatgccagaatgctgaagcctaggtttgaatcagctctgacctttctagtctgcactttcagttgcatcttaaaactgaaaaaacagaaatattagtcaacagttactggctgagcacctactactatgtgccaaacactgatccaggcactggatgtttcaggcaagagttactttactcagcagtgcagtgctgtgggtttattgttgctcttttcaattttggacataagcttctttcctgaagcagttttgctataagacttgataaatttttagacttatgtatttacacagttactgttgcagttgtcattttctcccccttccccacccagaagggtgattaggtttcctctgagtagaagattttaaaatcttaacctgctttttgttctcattttatacttccaaactactttcaaactctactgtgagttaacaaactcaaatgttttctggaactaggcagtttcctgagtgtctgaagcaggccagggggagtaaggagggagtagtagggtctgtgtcaaaccgaagattcatacccacctataaacattaaaataatattttttaaatttggttcaaacatatttagaggctatgagtttccaacattctgaacatctagataaatatgaactctttagaccattgatttttgaaatatgaaagtgtaatatcagtttattggcaactgtgatgtgtgttagttttaaattaggaaatgctgagaattttgtggcaggaacccagttaaatttatggagtacagtatgtgtgtcttgttttgtcttgttttggtttggtttggttttcctctcacaagcttttaagcttgtgagtggaaaaaaagagattgggaatgttcaaagataattgaacattatctagaacatctagaacaaggacatctagaacagaaggtcttaggttcaatgaatagtcttcaaaggatccatgaatatcttataactttatttttaaatgttgtatttctatatttctgtgcttaatgttttctataaaaagtaggctttgttgatttatgtttattttatttttttttttagagatggggtctcattctgtcacccaggctggagtgcaatggcatgatcattgcactgtatccccacagcctcgaactctgggtgcaagtaatcctcctgcctcagcctccagagtagctagtactataggcatgtgccaccacacctggcttttttttttttttttttttttaattttttgtagagacagggtcgcaatttgttgcctaggctggtctcaaactcctggcctcaagctgtcctcctgcttcagtctcccaaagtgctgagattacagccgtgagctactgcacctggccaacttcattttttagagcagttctaggttcacagcaaaattgagaaggtggcagagatttcccatttacatttttcccccatgcatgcacggcctcccctattatcagcgttcccccaccagagcggtatttattacaattgatatgcttatttgtctacttaagaaaatcatttatatttctttgaaagcccataccgatacagtacttgatagcgttaactttttaaaatattaatagtttattaggaatatcctgaaatgattgagtactctttgaattaaatgttactctattttaaaagtaatacagacttaatgtgaaaattagaaaatgcaggaatacatgaagaaactaaagatgaaataaggactgttatatttggtacatatccttcaagactttagtttgtacatatatatgtgtgagatatacacatccatgctattgaaatataaccagagttctgctttgtattttagggttttaaactgtcagaagcactatttatttatttatttattttgaggcagagttttgctcttgttgcccaggctggagtgcagtagtgtgatctcggctcactgcaacctctgcctctggggttcaagtgattctcctgcctcagcctcccaagtagccgggactacaagcgcgcatcaccatgctctgctaatattttgtatttttattagagaccgggtttcaccaggttggccaggctggtctcgaactcctgacctcaggtgatccacttgactcagcctcgcaaagtgctgggattacaggcgtgagccaccgcgcctggctagcacttttatttaattcaaagttataaacttataaactgctgtaccagagaggcaagaaaccaagttgctgtaataaaacattttggcagcaagagagtcctgatctctttatatggaatgacaggaaaacaaagtagaaaaatttgtcactgaagatagaaaatataggataggtaggataggtaaatgtagtcttagttataccttttctcaaccttattagtaaacaggttacttgtttagcaacccatgaatattctatatttcgtagcctgttatagcacagcaaaggaatttataacgaaacttgaataaacaagatgtttttagatccaagtaatttagtttttagtttttgttgatttttttgtcaaccttctcaccaatcagtttctattttatcaaaagctgcttcccgttttaaagggagcctcacatttcttatttgctatatatatatatataacttattatatatatatacacacacacacacacacatatatatatatatatatatatttttttttttttttttttgagacagagtctcgctctgtcgcccaggctggagtgcagtggcacaatcttggctcactgcaagctccacctcccaggttcacgccattctcctgcctcagcctcccgagtagctgggactacaggtgcccgccaccatgcctggctaattttttgtgtttttagtagagacggggtttcactgtgttagccaggatggtctcgatctcctgaccttgtgatcctcccgccttggcctcccaaagtgctgggattacaggcgtgagccaccgcgcctggtttatatttttctttgtgtgtattattcaacttaggctgccacagcaaaatacagtagacaggcaaaataccattgccttcttgctctccccacctggagggcaggaagagaagagggagagagcataggagccgagctctttctcttcttataaggccgctgtggtacagacgaggacctcacccttacgatctcactttaactttaattaccctatcctccagacacagtcactttgggaggtaaaacttcaatacagattttggggagatgcgagtcagtccatagcaaataggcatgtgttctgttgttcccacaatactgttttatacctggctgctttctctcacttaatatattgtggctatctgttcgtgtcagatcatacaggtctttatctcatgtcgtttaacagctgcatggatttccatggtaaggatatactatcatttattttcccatttccatattgatagacatcagggaaaatcaaaagtaggctttggtgtcacctttacagatcctaaagactaaatctatttcctttcatcatttttaaatattataatttgagtaaaagcccaatggaaattaattttaagcttaaaaaattttaagaagtattaagttcacataatttgcataactcttaattagaaagcttgaatttaattatattttttctagttaaacacaagtggctgaactactaggggcagaatttcttgggcattaatgactgaagaaccttaaatattccgtataagttcatagggtaatatgtatttgttattcatacattaagagaaaaccatgagtagtaatgtatctgtgaggactgaaattcatattgtgttgcatagatgttaggttccttgcttgaagaattgctcattactgatttgctataggaaataaacaaggtggtactttcgtagagtgtaatcattcttgcagactacttcttgaacttattcaagtggaactcaaagtttttggatcacttctttacagcaacatgttatcagatctcttcctgtattcagctatttggtataattccattctaattagaaaaagcagcaagaaattcttattgggcatattgaaagggtttttcacctggaatgtagattattttcttttatcttctaaaaaacttttaattgaaatatgtagatagaatacaggttctaatatgaaatctacttccactccatctaatgtgaaattcatttgcattacattgaatccagaaatgtgtacatgcatttttataggggagatattttataactttcaacaaaattttcaaataataaattatcaaattggtgaggtgctgggagtgacattggccatggtggtagtaaacatagtaaatcagtgactgctgtaataggcaccaatttattcattgtagactctgacatcttaaagattttctggtatttttaataagaaaaaaaattagtaactaaaaaggagagcttgggtaacctgggacctggcacaattcaaactggtgcaatgaggttctctgttctttatatataaagaaactaggctagatggccttaccagggcacagctctggactggacccaacttttagtaggatcttacttactcttttaacaaaggccaggagtaatagaaacaacacttgtatttctatgacttacagggaaatacatagatatggtgttttttaaaaataatattaaattaattacaacagataaaaattaaacatttgggaaatacattaacaatggtataagcaaatatatattgacttggaaatgtgaagccagtagatctcaaacactttaattctgttatcccccttagggttatcactgaggttgaatttatatcctttgtcccatgtgtcctaccttactccccctaaaaaatatatggtcatgcagttggggctaaaagagctactattattgattccttctttaaccatgataaagttctttaaaattaaagtttcttggctgggcacagtggctcacacctgtaatcccagcagtttgagaggctaaggtgggcggatcacttgaggtcaggagttcaagaccagcctggccaacatagtgaaacctcatctctactaaaaacacaaaaattagctgggcgtggtggtgagcacctgtaatcccagctacttgggaggctgaggcaggagaatggattgagcttgggaggccgaggttgcagtgagccaagattgtaccactacactccagcctgggtgacagagcagagactctgtctcaaaaaaacatacatagtttattgttaattcgtctaggttttaataattttcataggaaaaaaacttgtatatagtttattttcttttaattatattttttaagaagtagaatatcaactaaattttttttctgtttagtgacgagacctgcagtgtcaacatttttattaatttttgggtaaaaatgtatattctataataatagtgataacttgcaaaagttcaattctgaacattgttggagtgattaaatttaaaagtgtaatgaattttggttttcctttgttcatttattatggcaaatatgtctgacacacacacacaccctttaaataataggaaataaaatcaaatatcaaattcccattctttttaaaaaagttttatagaatttaaataaaaaccacaatatggcattggtaataatttaggatgtgattgaaatgaaaagcctttgagtcttcttttttacttaaaaaatttttagatttatgttaaaagaatcattgtcttctttcagataaatttgcgcctcattttggtaagcggaaaaacaaaagagttcctgttttctcctaacgattctgcttctgacattgcaaagcatgtatatgacaattggccaatgggtgagtgatatttttctcttgagtatgaataatgttgattctttatgccctaccttgtctcacaaacattttgaaactgttatataacatttaaaagaacaaccgaaaattgagagtataaggctcagatttagaggatcattgtacccttccttatcttgctcttcagcagtctcattcccaaatggtaaaggagcccagaatgcaatggctctgcttctgtcttagaactgttttaacgtaagtgaaaaaaaatttttttttttttttttttttttttttttttgagatggagtctcgctatgtcgccaggctggagtgcagtggcgtgatcttagctcaccgcaacctctgcctcccgggctcaagtgattcccctacctcagcctcccgagtagctgggacttcaggcacgtgccaccacacccagctaatttttgtatttttggtagaaacagggtttcaccatgtcggccaggatggtctcgatctcttgaccttgtgatccacccacctcggcctcccaaagtgttaggattacaggcgtgagccaccgtgcctagccaaaaaatatttttaataaagaaaaatgcagccagggatggtggctcatacctgtaatcccagcactttgggagaccaaagcaggaggattgcttgaagctaggagtgtgagaccagcctgtgcaacatagcaagatgtcatcactgctaaaaatttaaaaattagccaggcatggtagcacatgcctgtagtcccagctacttgggaggctgaggcaggaggatcacttgaggccaggaatttgaggctgccatgagcaattatcacaccactacattcctgcctgagcaacagagcaagaccctgtctcaaaaaaaaaaaaaaaaaagaaagaaaagaaaaaaaagaaaaaaaaacacaaaatagtgaatatacacacaccttcatatcagtaaacctatttttaccaaaacacaaagaggaaagaacaactatttttaacagataatacattctctgtggtcttctctagatagcctatttaaaattaagtttgaaacaaagttaacttctaattcatgtcagttcttatgttctctgaactactataaggtcaagataattaatgtctgtctgtgctttccattttcaagccagtaaccataacaatcttggaaaatgtgtttggtatttcttattttctttgattttttttttatataataagaccgtcagctgggcgtggtggctcacgtctataatcccaggtctttgggaggctgagacaggcagatcacttgaggtcaaggagttcaagaccaacctggccaacatggtgaaaccccgtctctactaaaaatacaaaatttagctgggcatggtggtgcacccctgtaatccaagctactcaggaggctgaggcaggagaatctcttgaacccgagaggcagagcttgcagtgagctgacattatgcgtctgtactcccgcctgggtgacagagcaagactctgtctcaaaaaaaaaattgcctccctcaagtgaattgttggtttattttcttcctttgaacttccccagtgtcatcttgatccttatgtcatgtatcatagtgatatgatttttttcagctgatttcacttaattttattagcagtagcaatttgaacttttaaaggacaagacttattttgacaaagaacatagtatatgtacaaaatgagtcaattagattagtgtttctcaaccttaaataatatacggagcttttctagaggaagataattcttgtagatctctagttgctgacttaaattatttttattataatgcgtattttaaaatgtagaaacttaaacccagttaaaactctttattcttcttaactcatatacacaatcataaaactaaaaaagattgattcagaaaatgcaaatataactctgaaaccaataatgttcaagttaacaacattaatgtgctagatgatgtatttttgccaaagccagctcactgcttacagcatgaatactgttgagtttgtcatgcctatgttcctacatagtgtttgatgaccaggttgtctgtagagtcaccataaaacctttatttatacagtataacaaattgttactcagttttctcataggtagaatgcatcatttacttgttaagtgaacccctgttctgatctcattagcctcctaacaattaaagaagtactgactgcttggcaccagtacagtcataaatttaatgcacacgtgagtactaaaaccccaaggctgcacttgggttataaagtcactatttaaatcatctagacaatctcctccagatttcattaaaatgaaaatacagattttccagattttcattaaaaaaaaaaatacaatttaaaacttcttgaagaggacttttagaccctaaggacatgtcttggtggattcataggcctaaatttaagaaatactgatttatacaaatactttcaactactggatctttcttcacattagtaaccaagcggctagtttctaagtcagggagatactgaagctataaaggttatagctaagaaagaatttcagaaaagctaaagaaatttgggatctaagaatattggctattctttatagccaggcaggaatagataactatcagtatgaaaagcatttttaaatacccaagaatgatgttgttctaagtgtgatacaaaaagattacctttatgagattttttttggggggagcggtcatagtaagtaatagcttttgatatatggatattatagaaaacataacacaaggcagaaaaagggtaatcactctgaaatttatttgggcagtattgtaacttaaggtaaaagaaatacttttactttcataattacttacttagatattaaaattagtttaaattcaagtataagtctttgccataaatagtatcccaaatgaacagaccatctaccagtactgaatattgattgtatcagtggatgttcccttattttcaaaaaaaagattttgattcccagtatttcctcaggttgccaaatctactcagcagttttagacactgcaaggaataaagagaaatactttaatttttattttacataaaatacttaaattaaaaatctaagtctatattgtatcacataatgtactaaagatcagcaaattaaatacttattgatgttaataacaaatgtgtggcaaatattaatagcagaaaatacttcgtgcaacatacttgttgaaggaattagttttccttagcatacccttctgctatttagtggaaatattactaacaggtggaatagtcagacacatagctattattgggtcaaaggttcaaaaaaatcttgttatacttaggatatgttaataacacctgaaattcttcatttaagctatattctaagatttctctaaattttagatccctggagaggggaagggagatagcatattacaccagtgaagtacgtggaaatcatgacactctgtataagataatgaaacatggggcttcaggtttctgcatctcaaaaaaaaaattcaagtatttttagaatatcagtctttgtttcctgtgaattaaacaattactgtcatttacctttgtatctatggagcacttccatcttgaccagaaatattctattaaacaataattttggaattgatgaattcaaagcaattcatactatagtgttagagacttatttgatctttcttctagaataggagggacctgggaacaatgggatcagaaggcaacaaagccttacaggagacagaagagggaagagactaaaggcatggagcgggggcaggaaatgacggattcatttctcctctgctcatttctgctgtgcctaagttacctagaggcagtggttttatcaaattcacattcatcattttgaatagtcaaaaaaagggcaaaagaaaagtctctagttacttcctttatcttctgtcactctttcagaatactttaaactatttttttgtgttaaccattatctctttctataggaaacaaacacattagaattgttgacaaaaaagacaaaggaattctcagatcattactaaactcaaagcttaaattgttacatctgcaagctcatgaaaattactaaacctttaccctatcataacactagtgtccttaaacctttattttaatggagtggtttccatcttttacaataatataaattataggctgaagttaaatattctgttacccattctgcctaccagtttgtcttattttctttgtgtgtacacttttctagctttcatgtttgtacagtacctccaaatatatataatttttttggtttcttccaagtcttcattttgggtgaggtgaactaaagttgtatcttctctaatgtttactaactgacttcagatagacaataagataatatatcaacattatccaaaagtaaacagtttttttgttattctcaatatcaatatattaactgttttttagatctttgttaagcctgctgttttctagccttaaatgtacattttaacaggtacaaatattggagcattataatactatgtgttaattactggtaattgaaattaattttaaaatgatatttctttttactcagtaggtctttcccaactcatttgtattaactttaaacttggggactacaatttggtacattttagtattctttaagaagcaaaacgagtctttttgcagctcttgctacttaaaagaataagtaataaccaaggttgcggtaaatgtatgaatagtgactgtttctaatagtagtaggaagctccaagggccttctttgtactctaactgatttggatctgaatttttaaaacaatatagtagtaccttaattatatgttggaatatacctaaccagtacactggattcttttcagactgggaagaagagcaggtcagcagtccaaatattctacgacttatttatcaaggacgatttctacatggaaatgtcacattaggaggtaacagccacctttgtaatgggatttaatgtctgtctcatggtagcatgattcgcttgttttaaatgttaatgtctttgaatttgctaaaaaaaatgataaattcaaactatgaattctgcctatttctggtatgcctactccttcacattgtatattctgttaaatttagttttaggactgtagtaagtatttactaccttgtgaaataaactctatcccagtataggtaggattctatacctactattttttaaatgtaacgttattatatttccaaataatatataattcagatgtagtattttaaacttaagactggacacacaaactaggaaaaatttatgatagttttcaaatatatgaagggatgttttcagatgtttctacctgatacagttgctaatcatgtgagaataaagtaggtggctgacattagagcagcattttagcataatagttgaaagaacagattttggaactagactatttaagttatatgttagctgcactacttactggctgtgtaaaccttgggcaagtgacttaaccaacctgtgttccagtttcctcatcagtaaaatggaattacagtagtgcctacctcataggttaagaagggtaaattactttatatattcaaagtgcttacgtgcataaatggtgcttggcacatagtaaacaccttaattgttagctattattgttctttatatatgattggagaaatgtagctcaatattgcccccttatggggtatattttctaccatcaacaggatttgatggtagttttgaaaataggtatttcaaatatattcagataattggaaacgtataggcaaatgaaatggtctatctaaatatatatttcactgaatatagtctgagtttttcctctaaacctaatatttaatctatttttccttaaaggtagaatatttgcattcattcattcagcatgtatttattaaattcttatgggccaacactgtgctaagcacttgggaatacaggattgaataagacagaagctctcccttcaggttgctctagtattacataggacaaacagataaaatgcactggtaaaaatcctgggcaataagggctaaagtagatgaatgcaaatgattttatgacaatgtcaagtgagtaaaacatttcaggctataatctcacactgagtttcactggtagtattataactggtctaaaaaatgctgctatctactaagagatatctggcactttaaaatggagcttttttgatttgtagctttttttttatagcttttgtataaatagatggaccaactcttaatgctcttcatgtaagaattgactgttagctccctggctatattgtacattcattaaggatgggaccatgttctagtctttttaaaattctccatggctcatacaagatcttatgtgaattaaaaattggtaaatgttggttgaatttaatctatcgattatatgagtgaaccttgaaatgctccatttcccttttgagtattgatctatgtgagcaatttcccaccaactccattccttaattatcttttctgttgtgacctcagagtttgaacttcatattaaagctcatagaatttgtgttaaaatcaaaactattgatttattcccactaaagtataattttttaccagtatttttttgaaatctgttttagaataatgaacagattgacttatgtaattattattgtaattctgtgttgctgtccttcttttcaaaaacaataaactatctctagtgtagaagcatggcctggacctccgcgttaataattgtagctggatgtttgagcaagtttggataacaacattcaactatttgtcttttgggtctcagtttttctttttagcctccctgtgttcttcaatgtgaataataaagaagatagcacacagggaaatacaaccatctttaaatatttgcgtggcctgtgtggaagaaggctttgtgtggccctagaacttgctctgtatagccctgtgaattagacttaggatcagtaactgaaaatcaaagacagttttctcttcaatataggaaagaatatgtgaacatgttgagctacctaaagaaagaatagactgccagggaaagttagtgagatcttgttataggtagtggtcaagcagtggatgaccacgaagtagtgggtatacagccatgggtggaattcagccattatgcagacaaagtaggaagcctgggcattctctgccattcttgaaattttctgcttaagtttcaggttgaaatgtttggttatcaaatgtcttaaaacatagccctgaatcccccctttttaaaatagaacctttatagccatatagagtttcatttcattaaaggaaaggtgtgacagcagccttgttaatcggagggtgaagaagatgatcagctaaagctttggcattcagtatggcccagattagcatttccaaaaatgtggctctgaaatagtgggcatgagactcatctaggatacttattttaaaatgcagatttctgcatgccctctctccccaacccccatctcctaattttactagtgaattgaattcctgggtgatttttatgtacgctaaaggttgaaaacctctattctggatattgtactgtgtcataggagagagcagaagcatccacagtgaaaggaagaaaacgcattttagattctggtattcctcttctttcacatttttaaatgttattaacatcaatacctactatttctagttaaaattcagatggagaagaaaaataatagctcccacgcattacatttgtaacttcaaatggtaagcctctcaggagctttccaggcctgtcttgacattttttacatatgtatctcagtttacctaccttttttctcagattcattttccttgctatctcaaaatgatgatggtagtatatactgaatgctttctttgtaccaagttctgtgcaaagcactttgcttggattgtttgatttaatggacacagctacaaagggcaggtaatggaattagtatctccagtttagttgaggaaacagaagcttagagggtaagtaacttgctgagagttacacagttggaagtagcagagatgaaaatttgtaatccaggtctgtcttattagagtcaagaagacgggtatgagaatgatatacagcttggtatgtgtacattttaagttcagttcaaggtttgaaatgttgatcaggctttcccaactatttagtgaaaattttaataacataaagtcttacttacattttgatttaagtcaggcctaggaagttattctaaaagcctcccttttttcattatgtatttatgggccatcgtgcttcatttgaacatcagaggttaaaagtgtagaccaaataatggctggccaactttaaatgagattggaactcaccttgaatatatgaaatagtactagtgttgaagataattaggattctttttaaaatctgcatgttaaccatcatcctatagagcaggttttaaaaagcaggtagctggagtggaggatcattattgctaagtgatgatcttaggccttacttcagtttgtagtttttgaagagagggtagtttgaggtgtcagaactaaaacataacaactatagaaacagttctagaagctaaatataccagctgcttctaattttatacacagagtaacaaagggatttaccatgaaactcagtatttgtatttgccttagtggacatgggtgtgtgttctatgtctgaaatatttcatgataaaatttattaaatttatgagtgaaaaaatgttataaagacttgattaggaaacagtgattattgataatgccaagaaagtgattattttaacctaatctttttaagaaagttcttttctaatggacgaatacagggtgagaataaatgtttaaaatcaagtttatttcttgcatttctacatcatagtagcctgttcagtgcagtaattttattaggcaatagacaagtaattagatttagaaatgaatatctcttaatctaaacttttacctaatatagaaaagagtattcttttaaaaaaaatttaatcctttctcctctaaaggtggcctctgatattagccaattacatattttttcttatatcatctcttaatatggataaatgtgtcaagcaaatggctatataactgcaaaaaataatttctaaattttaaatgttatttctgataatattaacctaattttgtgaaggtactctgagttaagttgaatctgttaaagaagtcataaaaaagcaatcaatttttaaaatggttttaaatctggatagtgattttaataggtcgatatatgtgtaactaatcatcttttgcttttcacatagcattaaaacttccttttggcaaaacaacagtgatgcatttggtggccagagagacattaccagagccaaactctcaaggtaagccatgcactggaaaagtatctcagttgaggcacaaagacaggcattcaaaaatgctaggtttttcttggatatgctgagggaagggaagtttgcatagtttatgaatagagattgtcaagcaaataaccagacatttttgaaacatgctaaaattaaaagaacatttattacagcttcttaattttgaaaaatgcaaacatttttaaaaactcaaaactactacttcctacacttgattgcctagcccattttcccctccagttctagaatttttataaacgaggctcttcttcgttttccctaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcggaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaatatttctcttctttaaaatggcttctattcataattctggtgtatttgcctattctttatttcactactgtttatgtctttttttctttcttcagttaatgatactcttcagtaaaaatcaacattgagccagcctttgctatagtttagcaaaatcaaagggaagtatcagccaaaatttaatatgccttcataccgtttttatttgtaactttttcgagcattccagtttgttttccatttttgtgttataatatggtcacttgttagccaaatggagtgattggggtggagtgattggggtgggggagaaggcacatgacctataattacaaacacagctataattgaaacacagctgcaggctgtgctggagtctaggcacagtttttgtggccagggtagggtggggttcttgggtgtgagcagtggtagttgggtgtgactcctggcttaccctgaccccctgccagttggtgtgtttccttcagaaggcagtggcttctatgaggcttttacacaggaggtggttgacttctgaaagagatcatggatagaactaaatgagaaacacttagttcttaaatatcagagtttaaagcagtactgaaatgtgaaaaccaatttcacttactacattattttatagtcttcgacagtgatgtcagatgtttgtcttttaatatttttcatattcctctttttcaaaatgacagctttcaagaaatatggagtaggcatagtaaattcccatttggggaaaggaaatgcccatctctttcacgtgagtcaaccaataaaaaaggagttgggtaaacacattttctaaaatggctctggaagtggtttgttgttagaagtcttagaagagtctggctggttttagaatgtagtaattacacattcaaacattatttggtatcttttattttctacacatgttcttgaagcttatttgatgtaagggaagtcttacaatgaagtgggagaaactttgctatagttaaataatacaaggaggcagcagaacctggaggggaaccgggacaagccgcagcagagtgggaccctcagaattcttgtaggaacatacaggaagacatctgggagttggccagttctcagttgtctgccagacgagatagtttttcttcttccctgcatgctggaacctgtttccccttatgtccttccttaccacatggttttccgtgggcatcactcacctgggttccattagggtgccactcccccagtgtttctcaggagcatttttttttaagtctgataattttaacacatctacattttgactgatgctgttcttcagtcctcagagttcagaaaaccacaagaatagctgggctttggagtcaagcctgactttgttctgggtgattttgaagaagttacttaatatctgagcttcagttttttcatttataaaaattaacacatagtttagagggttgtaaggtttattttaaaataaatatttagagcactgatttgtctgagaactcatgcaagctagcaaacctgtcagaaggccttatgttggaaataaagtgctgggcatcaacgtatactctaaactttatggaagtagcttatgaaaaggccagagaaaatgtggatgatgctgtgttcatttaaaaggaagatgagtggggacatctcaaaaataagctctggaatagaaggaaaataggggacccagtaatgacacagcttcagatgtgtatatgcgaggtaccaggtcatacatagagcttagacatgttaacataaggacataaacataactgtcaaaatctgagatgctatttgttactagggtacaaaaatacactgttcaaaagaaatgggtctaataaaggtgggaaactatatcaagaatacacaaagggaacttagacctgagagggaaagtaaatgaggagtatgtgaataatgaaaaaagacaaaaatatgattgtcaggttatattgtactt
